United States Patent 7,868,149 (PLANT GENOME SEQUENCE AND USES THEREOF) - sequence listing, part 73

SEQ ID NO: 39743 - DNA, 5366 bp, Oryza sativa
tgatgaatttgattaatggggtgcgccagtcgtctgtggtttcgatgtcagcaacggcgcgttctgcctcggtgtccttcgagctaatgtcgggggtgctcgggccagattcaccgttaacttctttcaccgatggcttcatcaggacgtcgagaaaggtgccggtgtcgagcggttctcgtctggatgcgcatcatgctaggtcgtctggctcgacgttgtccttgcggtagacgtgtcggacctcgatcccgtcgaacctcttctctagcttcctgacctctgcaagatacttggataactcggggttggagcatttgtagtcattgtgcacctggtttgcgactagctcagagtcccctttgacgattagtcgcttggccccaagtgcggctgcagctcgtatcccagcgagtagtccttcgtattctgctttattattggttgccctgaagttgaggtggattgcgtgcttgaattgatcttcggagggtgatgtcaagataaatcctgcccccgctccttggctgttgagtgcgccatcgaacgccattatccatgtctcattgtcgccttggttgtctgacttgttatctggcatggtccaatcggccatgaagtcggtgagtacatgagatttgatggctgttcgcggcacaaagtggatatcaaattggcttagctcgactacccatttcgcgatgcggccgacaacgtctttgtttctcacaacttcgccaagggggaaggaggggacaactgtgactctgtgggcttgaaagtagtggcgtagcttccttgatgtcatgatgactgcgtagagcagtttttgaatctgtgggtatcttgtctttgcatcatggagagcttcgctgacgtaataaactggtcgctgtactttctctctctcgactacaatgacagtgctaacggaatatggcgtggcggcaatataaaggaataattcttcattaggttggggagcaacgagtacaggtgggtttgataggtagcgcttgagtgcaataaattcctcttcggcttcctgtgtccatacaaatttgtcttgtttcttcaacaaagagaagaaaggctgtcctcgttctccgatcctagcgacgaatctgcttaatgctgccatgcatccggttagcttttgtacctccttaagtcttgtgggcgacttcatgttctcgattgctttgatcttctcgggatttgcctctattcctctgccagaaacaaggaatccgagtagcttgcccgacggtactccgaatgtgcacttctctggattgagcatgaggcgatatcgtcggaggttgtcaaacgtttcccgcaggtcgtcaattaatgagtcgcttgtcttggtcttgacaatgatgtcgtcaacgtaagcctcgacattgttgccaagctggttgctaagtgcgccctggaccgtgcgctggaaagtattcccggcggttatcagtccgaaaggcatcttaacgtagcaaaataccccgaacggtgtgatgaacgctgtcttctcctcgtccttttttgccatgctgatttggtggtagccaaagtaagcattgaggaagcttaatagctcgcaaccggctgttgaatccaccaactgatcaattcgagggagaggaaagtgatccttggggcacgccttgttgaggtctgtgaagtcgacacacattctccattttccgttggccttccgcaccatgattgggttggctagccactctggatgaagtacttctctgatgaagccagctttgagaagtttgtcgagttcttctcgtatggcttattttcagtctggtgcaaatctccgcagtctttactttactggcttggcatcgtgtcgcaccatgagtttgtgctcaatcacctccctggggacccccggcatgtcggacgggcgccaagcaaacacgtcgacattatcgcggaggaaggtatgagcgcgaggtcctatttttcatttagtgtagccccgattttgatagtcttgtcggggttagcctgttgagcggaatgattttgatggccccgtccggcttcggcgtcttgtttggcttgctcactttcttgggtggctcagacgtggcgggtggggtgggcgtttgctcgaccatgtcgaggctccgcctgtcgcactgcaccgccagctttgcattccccctgaatagtgattgttcccttcggtcccggcatcttgagcacttgatatgcatagtgggatgcggccatgaacttcgcaagtgcagttctcccgatgatggcgttgtaagctgtatcgaattcagcgacatcgaaagtgatctgctctgttcggaagttgttggcttggtcgaaagtcacgggcaacgtaatcttgcccagaggtctggacgatgattggggagtaattccatggaagggttgatcggttggtgtcaactcactttgtggaattcccattgcatccagagtgctggcgaagaggagattgatcgagctgccaccgtcgatgagaactcgcgctaccttgacgttccgaatagtgggttcgaccacaatcggatatcgtcctgggataacagatgtcttggggtggtcttcttccgagaactctattctctgctcagaccacttcatcttgggtgcagcctcctaccacgtcgaacagacttcacgttccactttcttgtattcccgcttggaggagtatgttgtggagccgctgaagatgtgtgagacgtggaggtcggagcctgggtacgcaggatccgattcgtgaggaggtgtctcctcgttcttctcgacaacgcgtactcgcttgcttttttgaaacgccatgtgcttctcgagcgactttttgaaaacaaggcaatcctccagagaatgtctgtccgttttgtgtatggggcaccatgatttctttgtatcgctgccttgtgggtctgggcgcttgggagggttcgcgtattctgctgcgaggacttccgcttaagctttccttttcccgtttttgcgatttttcttcttattcgactcagatgcgtctgcggctggtttcttctctcccccagtcttcggcttgtcgttcttgcgtcttagcgcgtcatccacatgggcgcaccgctcaacgatctcgaataatcttcgggtagttgtgatgcgtcttgtcaccaactcctgggtagtgtagcgatctctgacaccggacttgacttgaaggcgcgagttacagaagcgtcggtaatttcgggaattgtgtttctgcactcgttgaagcgccgaacgtattccctcaatgattcccccgagttctgtgttaacgcgtgtaagtcgtcttcgatcgcgtggcgcttgtatgttccttggaaattggcgacgaactgttgccacaggtctgcccacgaagagattgagtaggggggaagatgcatcagccatgtacgtacagaacccttcaacgcagttggtaaatagttcgccaacgcgttgtcatctgctctggcagcataaaacactatcgagtagacttgaaggaattcttctgggtcggtgctcccatcatacttttcaatggccccgggtcggaatctctcaggccatcggacatcacgttgggaacgaccgaaagccctacacccagcactaggggcggtgggttgtcggcggtcgcatgaccttcgtggatgtctgtctgacgatgaagaggacgcggatgatgacgatgacgatgggtcgcttggctccggcgtacgattacgaggatgacgacctggatcccgggaatcttgtcgttgtctctcgctattatctcggcgccgatctccttcgtcgtcgtcgttgcgacgacggccatgaccagtattgtttggcccccgccgttcgcgatcgttgcattctgggtcctcgtttgggcggtttcctcgatcatggcgccgtgaagaaacatgacgccgagagcgatttgcgtcgtcccgtgtgcgccgtgcttctcggcggttgttaatttgatctcgaagatcgctagtgccacgaggtggaggggtagcctgtcgaggcaattccctccgctccggatcttcaccattggcgtcgccggttggtggctgatcttggtgtgctgcggtagcggcctcttcgaacgcattgctgaggttggtcaccgactcccgtaatcgttctgtccaacgctcgaggtcgtcgttcagaacaggatcgtaaggagtttccctcagtatagcttgaatagccctgatgtgctgggccggagtagtcgattgattcgccgcttctgcgttggcttgtgctgatgtgccaacgtcatcgataactaatacttcccatggcgcacttgttgttgatgacccgtagtcttcgaggagatgtaagaccgatggttcgtgaggatcgagatcgattaccccaacgaatcgatctgaggctggagtcgctccctgttccttgccgttatccctagcggggacgtatgacttaggagacagggttttcatggcgccgaggaggactttgcagctcgagagatcgtgattctttgtcttgtggataggacaatagacatcccgagttggagaaatacactgaattccacgttccttgtaggcgcgaatttcagcacggacgttgatgaatacccagcaatcttgaagggtatgtttcttggttttgtggataggacaccagaagtcatctttgtcgggcccgtgatttatgtcggagggacaagatttggccgcatcagaatccgtctcgagtttggatgtagtcggtaatccgttctccgtttcaacgggtggatttttcgacatggagccgtcttggttcgtagccactacgttctcgttttcagtcattggaggaccggttgagatcggcgtcatggtgtaaaccgggaagacgatttcgccgacatgagtccataccagcattgttgaagttgagagtgcttggctggagctggtgttgatgttgttgtcgacgaagcttgatggcatagtagtagaaccttgagtaccaagtccccctacctggcgcgccactgtcgacgggtgatacccgtagaccggatatagagggtattggggtacgctggtacaaggatctacgtaatacgacatcgagcaatcaaaagacaagaattatactggtttaggccccttgacaggtaatagccctaatccaattgatgtgggattatacggtggaaaacataggttacaaaggaaaggatggaacttgtcagatccggcgagattgtagtcgagctcattcgactagctcttgacgacttggctcctcgcaggctctgacttcgtaggctgtgtgggttatgttggcactgagat

SEQ ID NO: 39744 - DNA, 2614 bp, Oryza sativa
cccaatcacgttctcaacataatcaatcagacaaagacaatgatcgccgcatcagttccagtcaacctggaaagcattcgggtgccaactggcagtcgggttccatccctccaatctgaagattaccatcaaccaagtctcagcatcgcggggtcaagatccaatcacggggggtcatggtctgctcacgggggcagggatcatcatgaacatttagttcattcgccagccgataggcacagagagtgacgcgctgagcagcctcacttgccatgtcgctggcaacccattgacctacgtgacacacttaaccgctgctgtgcagaaagaggtgatcggcggcatcgaaccctggactgctacgaatatgatgaagatggagtcgcagctttcacaagcgacctgcgtcgagtggattggccggctggttttaagccgactggcatcgagaagtatgacgaaaaaatagatcctgaaccatggctcactgtctacggtctcacaatccgcgcagtaggagaagatagcaaggcaatgccaaattatttaccagtggccctagctgactctgctcgatcctggcttcatgggttaccacgaggcaccataggatcttgggcggagctccgagatcacttcatcgccaactttcaaggcaccttcgagcgtcccggcacatgttttgaactctataacgtggtccagaagcccggtgaaacccttcgggaatatattcgatgcttttctgaacaacgcaacaagatctctgatatcacagatgatgccatcatagccgcattcacaaaaggagttcgtaatgaccttctagtcggcaagtttggatgcaagcctcccaggatagtcaagcaaatgtttgagaaggccaatgagtatgcaaaggctgacgaagccgttcttgcttccaaccagtcgggcagccactagaaatccaagaaagatggaccaaccgtaggggcgagtggaagcggcactcataacaaagatcacaagcggaagcccgaggatctggtggcgactacaacacattcttcccgtcaacaatcgcgagtcaacaccttcgacaaaattatgaatgctcaatgttcgcatcacccaaattccaaccatgctgccaaagattgtttcatctataatcagtttgccgaacaatatgccaaacaagcgaagaagctgactgatggagagcaaagcacctcgaagaaaaaggacgacgatgacgatggcccacctggttttcaagattctcgtaaggagctcaatcacatcttggttgggccgcaagcctatgagtccaaacggaagcagaagctaactgataaggagatcaataccgttcagtcggacacacctcaataccttcgggtggtcggagatagcaattaagtttgactactcgaatcaccctgactgtcacaccctaaaaatcccaaatgtataaattgttgtttaattggaattattagaaataattttaaaagcctagaagagaagatctaattttaaataataaattccaatataaaagtgggccagataaaattttattaaatacttcacttgattctatagttcctagatttttctgggatttatttgagccaaggaagcatttttaataaatggaattgcatttcatgaataatttaaattgaaaaaggttttaaaagtctccttttggctttgggccgaaagtcggcccaaaagctctctctctctctctctctctctctttccccagcccagtcagcccacgcgcgtgcgccctcgcccgctgtaaggtggggccgacttgtcggactcgtcttcctcctcgcgccgccgtgccctagccacgccgcgcggtagccgccgccgcccttccaattcgatcgcgtctttccttctccggtgaaatcaatagaggggaaatgatcgccttgatctcctctatcttttctcttttggaatcatcggctaatttcttttggaaattggtggattcgagttcgattcggatcaatctctctctcccgaaccctaactttccatcgccgtcgcccgttgccgtggtccttcgtcgccgccctttagccgctataaaaggaccgccgagccctccgctacccaccgctaccttcgccttcgtctctcgtcgctggtagagccctagcgccgtgtagcttagcgccgccgtcgccgccgttcgtacagccgtgcgtcgccgccgctccggtcgtcgtcgtcgctcgggaaggccgccgtcgtgatcgccaagccgtcgcctacctcgtccacccctccgtcatcgccgtaggtcaccggagcaccgccgtcgtcgtcaagccgaaggtcgccgccacttcttcctcgccgccgtcgccgtctgttgatcttccgtcgctgctttggtccctggtgagttcgccgtgtcgtccgcaacccgtaggtgccgtccgttcgcgccgccgcgccgtcgttcaccggcgagcatgcgtcgtccgagccgtcgccggtgatgacgtcaccgctgacgtcattgtcgccgtgtctcgtgaaccgccgtagactagatcgatctcgaccgtccgatttggttagagtgatctcggccgtt

SEQ ID NO: 39745 - DNA, 2927 bp, Oryza sativa
tgacgcaataatcccctttttttttttcaaaaataattcattattgcgtcataattcaattgatatctatataatggtttaatctgatttaatctttaaaaattcataactaattcatcttagctcggatttagttggttcaagtctctaaatttttctaaaattgagatctacatgttaaaaatatccacatgtactgttcatgcttgtttatgtgctgttttggtgattttgctcttttctctttagattccgacgttcccggagagtccgattttgcaggagaagactttgaagagttccaaggccagcaaggcaagtcacacagatcccaaacaaccctttgagcatgttgatcccgtttaaagctattgtttctattcaactattgcatttattttcgaatgtcattgggtggatataacctattgcctttgttatagcctttttatgttgattacctattctttgtcacctagttaataattggattagctagaacattatatggttttagctaaagtgattaggatgcttagccatgcttagagacactagctcatataaatgggataacttatgattcactattatttaatgatggcttaatgatagctcacgatggttgatcgtgattggttaattaattaatttgccaactaaaacttgataatggtgggttgtgagcacatggttttgatggtcgtgctcatgacaattaaggaccggttcacgattttcggttgtgaaacattaatcgtgcgaaccacaagccagcgtgggcaacggctttactttctgtatagtgtggttcattgtagagcaccagactgtgaagtggcggagataagcccacgggggtcgctggggagtccatgccttgtttataagggggtgattatgatccaggaacggtgcactgctttgaattgtgttatgcaggaggtattgtcacaatctctattcgggtacttgtcaagtatcgcgacgcatggttgacatgatgttgaggttgtgtcttgtgggtacagtggtacacctctgatcagagtttaaactattcgaatagccgtgcccgcggttatgggcgggtctaacaatgtctttcgtgattagtctcacacttctcactatattaaatgatgatgttaataacttgtttagctcctggtttggaatggtatattcctggtttggagatagaactgtgcagccgggattggttgttcagaatggttgggcctatgcaacacgggtgtattgtatagtgttgatttaatattgtttaattactcaactgttttactattctctcaattgcttattaaatgctgtttatgcaaatgagcccatattatgccatccttcgttatccattgcacttgcatatttgttgcgtggcttgctgagtatgtcatatactcaccttgcagtcattcatcagaggaggagttctacagtgatgctgatggtgtggatgattaggcgtagccctggtcaagctgcctgtggagaggagtcgcctgtgctgtttcttttattttccgctgcttagaactttgttgtttgagaggaactatctacctctgtaatgactttatattcgcttattaattagagtaataattgtactctattatcaatttgttattgtgtgcctcggctgatttctggacgagggtttacacacatgtaagcgtttggaattttggatagaaattccgggcgtgacactgaccgagtggtccacccagggtggtaccccctggtactagacctagtggttcgcaacatcaaacttcggttatccctcatcgatggtggcagtgcactcaatattctttttgccaagactctggacgagatgcaaatcccacgaaccgagttgaaaccgagtggtgcgcccttccatggagtcatcccggggttgtcttcaaccccactcggccagatcaccttgccagttacttttggcactcgggagaacttccgtacagagaacgtttgtttcgaagttgctgactttgagacagcgtaccatgctatacttggacgcccggcgttagccaaatttatggttgtcccacactacacctacttgatgatgaatatgccagggcctcgtggagtcatatctttgcgaagcgacatcaagaaagctgtcacctacgacaaggaaagctgcgagatggcccagactcatgagattacacttgcccatgaatcaatccgactggctgcatcaactacgaccgaaggagtagtgcctgcaactaacatgccaaagaccgaagaaggcgatgtcaaaactaagaagattcctcttgatccatccgatctctccaaaactactgtaatagacgcagagttagattgtaaataggaaagcacgctcatcacctttcttcaagctaataaagatatttttgcatggaaaccatctgatatgcctggtatcgctagagaggtgattgagcactccttaaatgttaaagatgacactatgcctatcaagcaacgactctgctgattttcttaggacaggaaggatgcaatcaacgaagaactgaccaagcttttagcagcatgcttcatcaaagaagtcttacatcccaactggctagcaaacccagtcttagttcggaagaaaacaggacaatgacgcatgtgtgttgactacacggatctcaacaaatcatttcctaaagatccttttgggtcagctttttggattgctactcgggatatcaccatatcaacctaaaggaatccgactgcttgaaggcctcatttattacaccgtttggagcttactgctatattactatgcccttcgggttgaagaatgctggagcaacttatcagcgtatgatccaaagatgcttttcaacatagatcggtcgcaatgtagaagcctatgttgatga

SEQ ID NO: 39746 - DNA, 3998 bp, Oryza sativa
tgcttttagggtgaaattgaaccctgaaaagtgcaccttcggagtactgtcagggaagctacttggctttatggtgtctcataggggcatacaagccaacccggagaagatcaatgccatcctcaacatgaaaccgcctagctcccagaaagatattcagaaactgactgggtgcatggcggcgcttagccggtttatttcaagatgtggcgagcgggggatgcctattttcaagctactcaagaagactgataatttctagtggggtcccgaaacccagcaagcccttgatgatttcaagagactcctcacgactccaccagtcctagcttcatcacatccgcaagaaccattgctattatatgtgtcagcaacatcgcaggtggtaagcatggttttggttgtcgagcgagaataggagggccatgttcaaaaagttcaacgaccaatttacttcgttagcaaggtcttggccgactccaaaacaagatatccctaggtagaaaagttattatatggtgttttaattaccgtcaggaaattgtcctattattttcaaagtcactcggtcacagtagtcacatcttttccactcggcgacatactccataatcgagaggcaactggacgtattgcgaagtgggctttggagttgatgtctttggatctatccttcaagccacgaacgtcaatcaagtatcaagccctggcagattttgttgccgagtggaccgagtgtcaggaagatacacttggggagaaattggagtattggactatgcattttgacgggtcaaaaagactctcgggcactggagcaagggttgttatgttttccccgactagagagaggttaagctacgtgctatggatacactttcaagcatctcacaatgtggcagaatatgaagcgctactccatgggctgaagattgttgtatctctagggattcagcgtctggtggtccgtggtgattctcagttggttatcaatcaagtcatgaaggattggtcctgtcttgatgacaatatggctgcatatcgacaagaagttcgtaaattgtaagacaagtttgatggtctggagttaactcacgtgcttaggcaccacaatgaagcagccgacaggctagctaatttcggatctaaacgggaagcatctccttctaatgtctttgttgaacatctctatgagccgacattatcaaagaaggataaaactgaagatgaagagaccaatgaagtagggatgattgatgtcgagtggagagagccaatcatcaaatttttaactcagcaagagttacctcaagacaagaatgaagcggaatggatttcttgatgtagtaagctttatgtcatggttgaagctgagttatacaaaaagagcccatctggaattctacagtgatgtgtttctcttgaggaaggcaggcaattgttgcatgatatccattatggaatttgtgggagtcacgcggcagcacaaaccatagttggcaaagcatatcggcagggttttttctggcccacaacggtgtctgatgctgagaaggttgtgtgaacgtgtgaaggttgtcaattttttaccaggctagttcatctgccagctcaagagttgcaaaccatccctctttcctggccttttgctatttgggggctcgatatggttggtcctttcaagagggctaccggaggatttactcacctttttgtggttgttgataagttccccaagtggattgaagcgaaaccagtcgttactattacagctgacgaagctcacgatttctttatcaacattgtgcatcggtttggagtacctaatcgaatcattacagataatagtacccaattcactggtggggtttttaaagatttctgtgaagactttggtattcagatttattatgcttccatagcgcatcctatgagcaatggtcaagttgattgcgccaatggtatggtacttcaaggaattaagacactggtttttgaccgacttcgtccctatgctggcaaatgggttgaacaattgtcgtcggtgctttggtctctgcgcactacgcctagtcgggctacgggccagtcgccgtttttcttggtttatggtgctgaagcaatgttgccgagtgaagtggagtttgaatccatgagatttcacaattttaaagaggagcgctatgagaaagaccgagtggatgatctcaaccaactagaagaagctagcgaggcagcattaatccagtcggcctgttatttacaaggacttcggcgttaccataatcgcaatgtcagatcacacgcatttttagtcagggatatggtgttgaggaagattcaaactatacgggatcggcataagttatctcctttatgggaagggccttttatcatctctgaagttactcggccgggttcttatcgactcaagcgtgaagatggttcggtcgtcgataattcttggaatattgagcatctttgtcgtttttatgcttaggcattatttttgtacattatgtttctcttgactgccaacatcaagtatttcttgagttaccagtcgggggctataataataataatggagtgtgatttttatcaattcaatttgcctacttgatttatcattgccctgtttgatttttagcttagtcaataaggactgaaagttttttgacgacttttgcgggttctaggctcagtaaagtttgacaaacacttttaagaaatcagaaactaagtttaaattttcaagcacaacataaatatatcagtactacacaattgaacctccattgtcagtattacatgatcactcgtcagagtcatcttctccatcatcagagttagcaggactaaggctagtgttctgaaacctatctagtacatcaacagcaattctttcagcagttttttgggcatcattaatcagatcatgtgcgtcttcttcacttgtgccagctgcaaagccatcaatagcatcgacattgattttggggtacagagacttggtcattgccaatgccatgcttgctcccatatttccagcctccttgatatttttgaagtacacatctagagcagtccttaacttatcaaaaatttctactgtgtccaaggagctcgtaccactattgctcaaatacatggcctagataattggggtagcagtgttggcaacttcgcctctagcttttttagcaacttcgactttgttgatcaagaagtcgaattgtgcctttgtcttccccttatgatctgcatacaacaccaatcaaggaatttagatgcaacagtattggctaaatttcatttatagttagtcagaagagttaccttcaaattctttgaccgccaaatctttctccttgggtagagcagcttcgtcttctaaggctttgattcgcttttccagttcggagattttggctgcttgaactgtagtgcacacaaaacttatacagttgctaagattaagtttgaacagttgagcaggaataatatttacctttcgaggaaccactcaattcaaagttggcatcctggagctcggcaatcctatccctaagttcatgttctgtattcctggcctcctccttggtttcatgcagtttggctctggtttcttccagagtaccaagatgagggaccagcttttcaagggtatcggtttttgcctcgttccgaagatggattctctgcgcaatactatgttcacctcaacaaattcaatggatgacgaaatatgactggggcagtatacttacgtttaaaagacgagtagcctggttgagagtccttgtcagcagagccacttcaccgtcctctttttgcttgtttatcacaataccctgtggctgcatctcgtcgtcccaccatttaaccaaaataggtggccgagaatcttcagttgatttaatccgaagaatttcttcttcgtcgccaatcattgggccttcaagtatataggcagcaatgaaataataagggaagtt

SEQ ID NO: 39747 - DNA, 2155 bp, Oryza sativa
atcagagtttttaccagtcggatcaatgtcggatggtttcctaaggtacaagagggtattaccaattgatttcaacaaacacagatccgaatgttttgatgaactcatacctggaagatcttcggatttttggcattgggtgactggttgttttcttcttcggtggaatagccttttttggctgcttgccaactgggccatcgtcactatcgtcatcatcgcttacgatcatcttcctttttcgagaaaccgtttgactgggcggaatagcatctcttttgggccacgggttgaatctttggacccccggtagcttggccttggtgatgccacggagaacgacgttgagcggttggagggtcggatttcattagggcatttccctatggataagcaattttgagattattcccaagaatagcatgataaaagtccaagcatttagatatttaccgctggaggaggattgaaggcgttgtatggcacgatcggcagcaaatgtgagaagctgaccacaataccagatgagaagattttatacatcctctccttcatgatcttgaattcgagggagttggggtcttctcggttgggatcagtctttccgtcgtactcgaaggccgtgcgagatctctctttgattggagccagtcgacactttatgaagtgctgagtaatctgctcttcttgaaggccttgttcctttagcctcagcagtcggtccagcaactcaagagcttgagaagcttcatcgcccataggaagtgagttctagatgtcttgatatttcagagggcagcatgaatattcgtgtagcgcaggatctggcttttggatgtaaaaccagctagcatgccagcccttattggaggttttgaagggaagagtgaagtacttctggcatagggtgccacgaagctggaagccggatcccccaacgatgcagggcttgttcttattcggttggggtttcagaaaaaagattcggcaaaataaggcgaagtttggccaaatgcccaaaaaaacttcacaaagatggatgaaatttgctatatgaacaatggagtagaggttgaggtgatagatattgatcctataaaattcaaggattcccctaaagaatctggatgttggaagagcaaaaccaccatagaagaaatgggtgaagacgacaatctcgtgagtatcgggggtcggaaaagcctcaccaaatgctggatgccatccgatgttctccttggctggtaacaccccgtgcgccatcatctccttgagggtttcctctatgacgtcagaaggcacccattgactctcaaaattttctctctcttccgccatggatgaaaatggggtggagagatttagagcacgaagattgacagggaaattgggggcaggggttgtgcggaggaattttgccgaaggaagctgatttgaaggaggtggattgcggtacagttgcgaaccctagcttttggcggcgcaagcctgttactgtagcaaaaaatggggaacgcgcggctgttgtggcgaggaagacgatggggtttccttcggtgcgatttttatcgatgggtatcggaaaatgctaatgggcctaggcccaaacagtgttttcagctcaaatacactctcggtgtggctgattgtggtctcttgggacttaggcgtatttttgctcaggcaaaattgcccataataaataaagcccgataccattaaaatcctttttccgcagttagtaaatttcttggaattactacgatgcatacaaaaaggtgcccaacagttaaaaacgccatgttatttttgttgactttttctataaggtcacaaagctattagggtttaatcaggacgagtggtttttaaagctgttgttccttctgagcacttatatgcttcatttttctgatataggctcaagttacaacttaggttggttaaacttgtcggtcagtatttattcagcagttgataaatccttatgagtttttactcggattttttatcacaaatgatgtatttagctctgaaatagacgatagatctttagaatgcgtttatcactcggatctttatatatcttctatgtttcatagggagcttaatgatttaattaaatcagttggcaaactcttcgaatggagtcaca

SEQ ID NO: 39748 - DNA, 1612 bp, Oryza sativa
tgcaaagatggattcgaatgagctctgtatgcaagtcagatactgatatggtgctgggttatggtgtgccaatggcaaaacatcccgggggcacagcctgtagatgacaacgcagcttggtgggctgatctcaatcaactacaccccaaacctttcaaattcagggttaaaggatctcttctcgccacttggtggaacgtttggttggaaagaaacagaagaattttttaaaacatctcttacacagaggatcgcgttgcgagaatagtaaagtccaacccccctaattgtcttttctttttcggattccctttgttttttcaggtttctcccttcttctccttcgatgtcttcccatgtattctctgaactgtttttctctcctctaataaaattccggcagagctcctgccgtaacctcaaaaaaatatatggtgctgggttaaaaggcttaatgacatggctggggaaaaaagagtaggtcattattttgaagaacttgtgcatgttagagtatattgtattggttgtattgaccttttaaacaggtatcagatatatcagttcacagacaatacatatgtgaagcttgcaaataatccttgcccagcactagtcaatgatgaattgcaaaatagtgccctgattgtgctagctagctagcatatatagaaataaaaacatttactataccacatttaatagtctagaaataaaaataaaagctaccatatatagaaaattaattgacgctagggcctagggaccagaactccaaagcgcaagaaatgcagtgaacaacatccattttctgtatgtgcgcacataaggccttccttacctcaattcagtttctgcagtgatgatttatgttcaggcagaatcctcttgcaccaaaaaccagggcgtgttaggtctaggatgcatccggaagaaagaccctatcctagtacttgtttgggaagcaaactgatccttctgtgctgtgttaagagatggtgttagccctcacacaagccatttgccaacaatttgtgcctacaggacaaggatgggcgcattgggctagtggatcagctcatagaggcgtggattatatatggtgaaaatattacttgctgtttagtgaatgcattatatacatttcattcgaagaaaaaaagatcacgactgtgaaccatccttttcctattcagtttttctccaaaaagatacgatgagtaatgtatcctcgaagtgagtaatgttttaacgaaaatgttgttcgtcaccacatcatattattgtcattaatttgaaaatacatacacatatattcacagtacgccactacactggtcaaggtcacctgtgacgggcccaaaccctcacctttgatggttttgggcttggtcagtgatcagtggtcactggtaagtccagtcacctttgacgggtggccggccgtcagtggtgacatccacctctgacgggcaagttaatagaaggccgtcagaggtgttggtctaagctagactagggcttgttaggacccgtcacaggtgtctcatctctgacgagcccctaaataaaggcccgtcagaggtgatgatctccggtatatagtagccgt

SEQ ID NO: 39749 - DNA, 1116 bp, Oryza sativa
ctctataaaaacataattttttacatcgccagaaattataaaaacatcttttttacatcacaataaattatctagccaagttcatgagtctatttggcatgaaaacgtcctttcttgttcattatttctgcaagaataaaggcgcacacttcgcctctgatagcgggggggttgatgggtgagatcttgaagccagctctacctttctgtttaataaataagaggttaattagcacgttttgaatagtaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcgttcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgtgcagtggttatgtagcattagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagttccatgtattgcttatgtagctctcggcaagcaatacccatcacagcta

SEQ ID NO: 39750 - DNA, 745 bp, Oryza sativa
  unsure (1)..(745): unsure at all n locations
aggcaagccggtcggtgaagacgtagacgcccaacaacggcggcataataggccagccgtgcaggcgaaagcaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataataggccagccgtgcaggcggaagcaccagtcggcagcggcgaaggcaagccggtcggtgaagacgtagacgcccaacaacggcggcataaaggccagccgtgcaggcggaagcaccagtcggcagcggcgaaggcatgccggtcggtgacgacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccaatcggcagcggcgaaagcaagccggtcggtgaagacgtagacgcccaacaacggtggcatataggccagccgtgcaggcggaaacaccantcggcggcggcgaagcaaacccgtcggtgaagactaaacgccca

SEQ ID NO: 39751 - DNA, 776 bp, Oryza sativa
ccaattaattatagtttggggttctgaaggttttgattatgactcaatgttgagaatcagtataatttgagttaccattttaatctggtggtctattattatttgtagttttaggatcaaaacaaaacaatcaagcctaccggaggggtaagggtaggaataccaaaaaccaaaacttttaggggaattaaaagttactctgaaattcgatgaagtatgtgacgaagtccgatgtgatcgccagatgtacacttgttagactgctggtctgaccggggcgatatcgttggtccaactgtcctctgagcaactattgtctgaagccaccgccagtctgaccgtcgctacctcgccaatctgaccgctgagatcaggagaaacatcgattgaagaactcataaaaataaatcatctttattacttctaattatgtttacaaaacacaacaattacacttgtctctcaacttttgacgaaactcgaaatctaggctaaacctaaacttttctctcaactaataatctcacaaaatctatacctagaggcatcaaccactcttttatttataccctgatgtggttgtacaaaaaccacaaatccactttgtagaaaaagtcataatttagtaggaaacctacccatacaagtaatccacctgatcaaactccaatcgtcctaaatttatactacttctaaattcgacttcgcatcccaaacacacaaaactcattttttatattgcatgaaatcttcgctactatgtgcactatcattta

SEQ ID NO: 39752 - DNA, 1049 bp, Oryza sativa
ggtgggaggttcattcccgacgcatcctaatcctacgtactgtagacaggacgtcggtctacaaaaagatttcgggaggatcatgaacgtgttcttgtacctataccactactttaatttcatgctctttagtcctatatatagttttaagaagtttaattagctgattctaattaatttccagtgtaactaattaactgctccatgatgctagttactcgcgatgtacaagtatgctgcattgaatttcaactagttgattagggttcatgtacaataatggttgttgaaacaggtacagtctgtttaagtctcctaataactgcacccgaggtccgtaataactaaaatgctccccctcacaacctacccccaccccggacatcgccgttgctcgctgctggcgcaggccgtcactgtgccggaggaagctgaggaagcccatgccggcgaccaaatccaaacttgatcaggttagtacttgttcgatccatacatatattggttttcattgcacgctccatgcattccaaacaagctaaaagaaaatgaaatcttaaataaactccgagcaacataagagtgacatttaattgtatatgcgaccaaaggtgggtttcttgctaccctatactagcaaggttatttttatattaccaactactaaccctttttctacaaacctttaattggatagcctaaaacctttaattggatagcctaaggctgtgttcagcaccacatgttcccaactcctctcgctcgtctttcatgcgcacgctttataaaatgtttctataagaaagtttgttaaaagaaccatattgatccatttttgaaaaagaaattagctaataattaattaattacatgctaatggattgctctgttttccgtgcgtaggagattggttaccatctcctccaaacgaactcagccaagaatggcctaatgccaaaatgataaggaggagtttccatgtgcggctaaggccgttgtgcctgtatatcttgttgacaaggtgtccctccttccctaaatgtttgacg

SEQ ID NO: 39753 - DNA, 8701 bp, Oryza sativa
ttggcatgccttgggccgggcctcaggccatattgctatctatattcagaacccatccactaatttgctatctgactttttttttccgtctatatattaaccgtggcatggtgcccgggggtgggggggatacatctcgatgctttgctaggtcgctctagctagctagccagccaaccgctccattccaatggctatgcatccacgcctcttgccgccagtcaccatgcacggctgcaattaaatctgcaagtgaaacattgattgacgctgacgatcatctggttgcatctacgtgtaaaagagaatgtgagaagcagcaccagcacatcacgttcgtcgtccgatctttcttcatccttgccacagctcaatccaatttgccatatgttgttagtgagtagtgacaagcgaggaccttttagcttactttgttaggtttctttctccgatcctcttctcagagcttagagattgagcttggatcattggacgaagctgcatcaagcccattttgccgactcacttgccatatgcatccatgatcaactaattgttgaatggtaagatttacaccaatatttgtagttttgcagcctttgtaatttatatgagttcaaccactaattaaaagcattactcttttcattagtaatttaacctgcccttaatatcatgtcattgagaaagtttgtatcggttggcaaaaaaaggaaaaggagagggaaaacagtggatgatttgatagaatcatagaagagggcaatggataaattttaaggtaatattataaagcctattacgtaaatattgtttttgacgtaattcaagtgctaagcagtaacaccttatatatctatataaattattatttagatgttatattaaggggctcctattttgataggaacattaatagctcacttcgacggtagaaaatactcaccatactttgtggagaaaatatgaaggaggagaagaaccgttcatcctcacttcattatcttcttaattaaaagtatatagtgtttgtgtatatgcgctgaattcggaagtagattcagaaatgttttccattggttacacctttagacattgtttacaaattgcttgttcaagaaacaaccgaattttattgtagcacacaaggactagtctgctccctgaacagataattggacttggataggggcttctttcctgatgcatcctaaccctaccgcacactgatttactagctagaggttatctttctgcatgaacagaagtcatcactgcagaaactgaattagttcaatgtgagatgaactggtgaggatcagtctttgtgtatggatgtacataaatggatgtggttcaccgcatttcatgggcttcaacagccttcaattagttgatttgatatatgatagcttttcatttggagagtactattggtgaaatggaagagagacagtggagaaaagataattgttgctacatatgacaacagtgagagtcaacttttagcatttatcaaaggaaattttgatgtatggagtgaagaaaagaaaacaagagtgataaaaaaaattatttcggtgcagtaataattaaaaggctttgttgtgtcaactattatagaaagatagtttttaagtgatatttattaaatatataaaagctttcctacatgcccttacattaattcttgaagcttgggttagtttctaccctgcccaaataattaaatataattaaattataacctaattaatacttcgttgtaaaaaggatgatgtactacagtacagtgggtaggccaacaccccaactattaatcataaattaacaccaaatattcaggattttaatcacccaatatcaaatcccatataaattaaatgtctcattttgttcatcacaaaatatattaatcaaaacccttgatttcacaggattgagctcatttccagccagagaaaggacatgaagacaaactcactcgatcacttgtattaatcgattacccttttctttgttgtaatagtttttttttttttgccttcgtataattatgtttgattcgcttggctttgattcggaaaaagaaccccatacactaaaatccacacgttttttaatttttgtgccatttaagtgtgttaaagccttcattgctgaacactttttaactgccagagcatattttctaacaatatttgttctgagctcttctttttctttgtcttgcaaattggatcactatacaagccatggaaataaagatcaacagattttgttaccttgcgtaactcgacgtctgttgacagtatacgcattaattttcttgcacggaagaatcaaaacaagttgaaaaaatgtggtgcatacagtccactttaacaaacttttatccattcatgtccaaatcgattaggtgtgagtcacaataaatgttctatgcaaacaagctaatcacaattatgaacagcaaaaaaaattgtgtccgttcttgagatcactttagtctttatagctatatatagaaaccacccatagatagctatccctctcataaacaaattgatagttaagattttctgcaacaaaaatatggcttccaacaaggtagtgttctcagtgttgcttctcgccgtcgtctccgtgctcgcggcgacggcgaccatggcggagtaccaccaccaagaccaggtggtctacaccccgggcccgctctgtcagccaggaatgggctacccgatgtacccgctcccgcgttgccgggcgttggtgaagcgccagtgcgtcggccgtggcacggccgccgccgccgagcaggtccggcgagactgctgccggcagctcgccgccgtcgacgacagctggtgcaggtgcgaggcgatcagccacatgctgggaggcatctacagggagctcggcgcccccgatgtcgggcaccccatgtccgaggtgttccgcggctgccggagaggggacttggagcgcgcggcggcgagcctcccggcgttctgcaacgtggacatccccaacggcggaggtggtgtctgctactggctggcgagatctggctactagctaggctactgtagctagctgtgcatgtatgtggtgtggttactaaaataattagtgttttccttttgtttggaagcatatgtgtggtgaataaatgatgaactccgatgttcctctctataaatcttgatgattcgctagctatccgtacgtcgttgttctttgatttgatgatgagattgaaaaatggaatgtcatgctaaggagggtgcccatgtcggtggccggaatggtgccgctgcagggctgtggtggccatagggtcgtcggcatggtgaccgtgccgacggtgtattgctatgcagcctgaagatccccctctatagtaaggccacttattttagaacgaaaagagtgattctaattttcacatccacgattgctgcgtccctatgtatctgaagacaatctatctatctattctatatctatactaattgggcattttccagagctctcacgttatactaattgggcacttttccagagctctcacgtcaatcagattaatctgaccattgattaactagatcgtaaaatcatgaccgtagattaaatattataactatggacctttaattaaagcccaacacgtgtctgggccaccattcaatctatacaggcttccttcaaggtctacaaattgtacccatatcggtctcagcagtcggactcgactctgcacgcgacgagatcacaacacggcaggctacgtcgatctacttgaccctgcagccgaggaactccgtcgaccggatgcattggcgaggaagtgttttatcgatccaagatattgatctctgcaggtacgatggctatttaaaatactcaagtgagcaagatctgattcaatctttttagggtttcattcagttgtttcttacatgtttctcatctaaactaactataaattaatttaagattaattaacaggatacctttgtgcattgtagatgtaatgatgaatcatcttatatgcatcagtcgattgtagatgcgatggtcaccgatggataacctagattcaaacagaactttggatttattgatgaatatgtaaacacctgaatttaattatagggtcaactcccacatcatgtaatatgatattcttgatttttttattttaattgaaataaagaattaattatgttgctgatcttttttttattgctaatgagaaagttcactataaattaataacaagttttaagtggacatttcctttttccagataagttaaacatatatcgctaacaaatctgctccatgcttcatccaaatacatttgtttaagtgaatctatgatttctcgaaattttaatttagcatactaatttaatgtatgatgtaaaagtgctaattaaaatcgcgtatctaaaaacaggagcatagtaccaaattaggagaccacacaaggacaatataggtagtgattaattccaaaattcaaaattattaaaacatggaaatgacttatgcttcagatgtgtgacgatatatattactttcgaattttgttattttcaaatctacctggaaatctgcagatgatctcagcagttaattagcagctcaagctacctggaaatctgtagatgatgcgcgtgatcatggacttctacatatgtgctatacttaatttttgtttgtaaattgtgtgtccatctgaaacataaaaatatgatacccttagaatactctagggtgaaatgctataatgggatatccgtacgtttgtggatgaaatctgtaaccctaatataccagaagtatttatgcgctattgctgggaattatatatttatagtaatgccgttaagaaataccaatagccaccgcaccatcgccgccccaatctggtcagggtcgtgggcatcgaccctgcgacctcgagggagaaggaaggccccattgtcaccatccttgcagctgcgcggttttcggctgaccgctcgggcggcagcgaggcggaggagggtggaagacgggggtgaggaggaaggcgctggttgccgccgaccgtgtcggccctgcccctggagcgacacggggcccccgttagtccgacatatgacaaactttttgtgtatggcttttattgatgtcatgaacgaacagaatgtccaggaagcagatggactagggagtctaaggcgaacttggtaagatctggaatggactgtgctgctacaaggatggcaagggatgctatttgacaggtcatgaaactaatacctagttatcatatttaacaagccacgtacgtacgtaatagaaattactaagaacattacataaaaaaaatagaatttcaagaacaaaactatagaagagaggaacgtcgtccattccaccttttattacttattactagcggtcaacccgtgcattgcacgggttactgtgaatgacaaaatattaaaatttcactggataatgataaaatatattgttaaactcataagttaaattttgtttaaaagaaagttgatacaaaacactttcatttaaattatagtggccaaaaacataattagtaatttcttatataacccattctaatatttcttctattactttatgttttttttgaaattacataatttcaaaatttagtattagaaatatagatttatactcgttttgctgtctcttgtgagcattttgctataaaatagtttagcaattttgaattaatatgtacagaaacaaacttggtttggatttaacctttttcacgatttgatgattcctattgtggagattatgggtaccccatatccacacggcatggttatccgactagtaataggggataacatatatgtatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggggcatatgtcacaacctgatcgtcagatctatactacacccggcggattcaaatccccaaacaggagtagggtattacctctcattgagagggcctgaacctgtctaaatcctttgtctctgcatccatccacttttaggtctcgtgtgctacccccttttattattgccgaaatcatgtttcgacagttggcgcgccaggtaggggttgcgtcgagtttcctatcaacaagcgcgatggaatcaatttcatgagtcgccgacttcgttttcgctttgggagttttcacttcctttccgtcgaccacttcttcaagctcctcttctctaacttgatccaaatcagtcagggggaaactcaatctgatttttatcattatttatcgtattgatttttaatcccagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggcctgcctccgtcgccgccgattggtgcctccgcctacacggctggcctattataccgccgctgttgcgcgtctacgacttcaccgccggcctgccttcatcgccgccgactggtgtcctcgcctgcacggctggcctattatgccgccgctattgggcgtctacgacttcaccgccggcctgcctccgtcgccgccgactggtgtcctcgcctatacggttggttggtcacaccaccgttcatgggcatccacgtcttcaccgaccggctggccttcgccgccgccgactggtgtttccgcctgcacggctggcctattatgctgccgctgttgggcatctacgacttcaccaccggcctgcctccgtcgccgccgactggtgtcttcgcctatatggttggttggtcacaccaccgttgttgggcgtctacgtcttcaccgccggcctgcctccgtcgccgccgattggtgccttcgcctacacggctggcctattatgccgccgctgttgggcgtctacgacttcaccaccggcctgcctccgtcgccgccgactggagtcctcgcctatacggtcggttggtcacaccaccgttgatgggcatcgtcatctacaccgccggcctgcctccgtcgccgccgactggtgtccccgcctatacggtcggttggtcacaccaccgttcatgggtgtccacgtcttcaccgaccggctggccttcgccgactggtgtttctgcctgcacggctggcctattatgccactgttgttggacgtctacatcttcaccgttggctcaccttcgttgccgtcgactggtgtttccgcttacacggctggcctattatgccgccattagtgggcatcttcgctttcaccgtcgaccgccttcgtcgccgccgactggtgtcttcattgttattgatggacgactttgttccctcattggccacttctgccatcaccaaggggaatattacaaagctaagtcatcatttattttattctttatatgacatttttccttttcctctgcctcacgacatcaattggtcttccattgagtagtgagtcgggggctacagatgttatatcatattttttataatatttatcttgattgcttgcgacataatctgagtacaaaagtacctatcgagttatggagttctatcttcctatgctttccatttggtttgccaatggatggttgcctttgggccgattcctagcacccgggagctcgttggatggaccgagtaacgcaaggtgctaagtattattcggaataaatcaaaagcatagagatgagataaatttattttctgctcttaataattgcaaaagtacccgagtagtaaattctgattcgtgaaactttgttctattaatggcgaactcatgtcactcatatgcatgtctgggaagtgcctaggccgactcccgatgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgcttccgcctgcacggctggcctattatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccaccgttgttgggcgtctacgtcttcaccgactggcttgccttcgccgctgccgattggagcttccgcctgcacgg

SEQ ID NO: 39754 - DNA, 6134 bp, Oryza sativa
cctttatgctgccgttattgggcgtctacgtcttcaccgaccggcttgccttcgccgctgccgactggtgcttccgcctgcacggctggcctattatgccgccgttgttgggcatctacgtcttcaccgaccggcttgccttcgccgctgccggctggtgtttccacctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgctgccgactggtgcttccgcctgcacggctggcctattatgccgccgttgttgggcgtctacgtcttcaccgaccggcttgccttcgccgctgccgactggtgtttccgcctgcacggctggcctttatgccgccgttgttgggcgtctacgtcttcaccaaccggccgccgcatccgccactgctgactggtgtttccgcctgcacggctggcctttatgccgccgttattgggcgtctacaccgaccggtttgccttcgccgctgccgactggtgttttcgcctgcacggctggcctttatgccgccgttgttgggcgtctacgtcttcaccgaccggccgccttgtccgccgccgactggtgcttccgcctgcacggctggcctattatgccgccgttgttgggcgtctacgtcttcaccgaccggcttgccttcgccgctgccgactggtgtttccgcctgcacggctggcctttatgccgccgttgttgggcgtctacgtcttcaccaaccggccaccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggccgcatgattctgctagtgttgattggccttaccatcttcatcaccggtcggtctcgtctgctgctaactagggcccttgcctctacatttggtttatacagctaccactactgatggacatcatcgtcttccgccgtcgactcgtgttcacttcatcacggcaacacaactttgtcatcatggtggagcgacttcatctttattatcttcggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctactccaacaacttcaaatatttcggtttggacgagttggacaacaacatcaactctcctccaagtgaagcatctacaacagctataacattaatttgatggattattgtcactaacatcatctccagcacctctgcttcatcgaccctgacatctccgctgttgctaatggatgattatgttttcgccgacttattatttcaccttgacggttgacctactacgcaactgccgatagaggatctcatcgttatcatcggctgctacatcgctattgactggatcaccgacatcgtcatcttcatcaacatcttgttaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtgggtttcgccatcaccgttgatgcgcgtctatgtcttcatcgtcggtttgcttttgtcaccaccgactgttcttttgttgttgttgggcgcctacatcttcactgctagctgacctgactgttgccgactggtttcttcgcctccatggttatgcaacttcattacctttgattggtgtcactgtttttactaccactgacattttccgttacttctgatgagcaatttcgtcttcatgttggtcatttcatctccatgccgactgcatcagctattgccaatagacaattttgactatgacagaaggacaagctatatgctcaggggctcatcaactcaagcgtgaggattatatctccaatttggacttgttccggatacattccacatggattcatagtcatgagtctattttatatgctcaaagactggaccaattattattccccgtaagggctatcaaccgaatacttgcgccagtcgggattcaattattatattacccggaagatttattactcgggagcatgttatatgcgtcatcctttaaagggtgtcgaaggcatattttttggcctaggcctaatatgtctgcagcccatattttcaggtgtggcctatcacgttcttttagggacttaggcactttttgcttaggccaaagtgcgcgtgatcaagtgcccaataccttaaaatccttttataccacagttattcaacttttttaggagttggtacaatgcatcttaaaaggtgtcaaacagtaaagctttatatagctgtcccgctgacttttttatataagtcaaggtgctgtttgggtttttaagcaattgattggatacaatatcattgctttttgccacgtaagtgtgcatttttattgaccaatattatggcttaggctgattatatattgtagtcattttccaggcggttggtaaatcctttatgagtttatttactcggattttataccacatatgccatatatttccaggtgtggtggaaccatgtgtcttctagggacttaagcacatctgttaaagcagtgtgcgcatggggtatgcccaatactttggaaatttctttattcacagcattcaagcttctttatagttgttttgctatgtgaactttcaaagatgttgtcaactttaggttgtacgcatcatattttgccaagcagtcggtatatcacttggattatattattcggggattcacaccgcatatgctatatattgatatcaagtcacttggttgattacaattatcaaaaccactcagttggtacatctatttgatgcacctgactttaatttttcagcccttccacagtctttatatttggtaaaagtactcgggagatcatggcgaggatgattgaagcactcggctttggagtaatctagttcgagagaagattatctttccgactgtgaaggtctcaggggctactgtggagattatgggtaccccatatccacacggcatggttatccgactagtaataggggataacatatatgtatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggggctaagaagacaacctgatcgtcagatctatactacacccggcggattcaaatccccaaacaggagtagggtattacctctcattgagagggcctgaacctgtctaaatcctttgtctctgcatccatccacttttaggtctcgtgtgctacccccttttattattgccgaaatcatgtttcgacacctatattcgtagttattaaatatcaagttgtattccatgtggagtagtctcaaatatatatagcatcttcataatttagttttaaaattcctaattaaaaaatattacactctgtttgaagtcttaattattgttttatcgtgattaaaaattattccaaattttggcgtgggaagattatagtagagggaatcgtactaataatttatatattacttgtaataaccatagtttaagcaggagttaatgtaattcatagggtagaatgacacacaagcataatactacttattttcatattaaatcatctaagctaagtggaaagaaaagagaaaagaatctattcctatatttctagtatacatcttatacatacatcctaactataagattaactagctaataccctcttttcgatgccctcctggtacttcgagaagccacccctgactaccgagttccttacgacaggtcgtcatgaccatacaaccggagctaaatacggaggagtaccctccccaggaaattaacttaggactatatacacacgcggaggaatacccgtactgacctgtcaccatcagcgactcacctctcttccgtagcatataacccaaataatcatacccagtaatttagacaccacgcctaattaccagatactactctaatatcatcatcatgacatagagtaattacataagcaaacactatacccgtaccattgcatctcctatataagctagcagtataatcaatataacttgaatataaagtaaagttggcattcatatacttggaaagtattacaataccagaattgaataaagaagaatattctaaataaagtacaagtcttacaaaagaagaaaggagaactgctagagccatgcccaaactcttccgaagacttccagactctgatttctattctattcctactccactagcttgagaatgctaaactaagcttgagagagtatgagagaactttgctcgaagtgtgtgaagaaagtgaggagatgaaggccttaaataagcaggtaatgatggttatgacggttggaaaggtcggtaataccctccaatcgccatagggaagcaatccacaccgtctatcgccaaccctggatccatcggctgcacggcgggttcggccgaaccaggcggtgggtttgtccgaatgaggggacggcccaacccagcccattttcggctggcggcctcctcttctgctgttcacttcagacttgtgaattttgacccaattggtcatgtcatttctgcattcttggcccactcattgataagtctgattctcctcatcgtccgattgattgattgtctgttgtgatgttgattctcctccattttatgttcattctctgcaagaggttagtaatcccagtactagtggaatatttattattctaacacaaatatgcattgcaaggataactagctctctattattttggtagtattgacggtcgaaactgatcgctaacgacagtcaacagtggcgtcggagcgtcaggctgggcatgcagaggcggctgggtgcggaacggttgtgcgtggaggcggttgggtgcgtattgacgatcgtaatcgatcagttttgcaagttaatattactaaaataaaggagaactagttatacttgcaatgcatatttgtcgtagaataaactattttcaagtaccactaggattctaacgtcttgcagagaataaacacaaaagggaggatagtcgacaacaaaatagacgatcactcaatcagatgctatcgagaatcagacttatggacaaatgggctgagaaaaccaaatttaaaagatccaacaagcccaaaattcactattttggataaaggaggcagagaggaagcgatctaccgaagatgggccaggtcggcccagcccatggttcagccgaaccttgcgtggcgccgtcagatgcagcgtttggtgggacggctgggattgatcccaatgatggttggagggcgtttccgacctttccaaccgtcataagctgcctagaaaaggccttcacctcactccctccatgacacactcaagcaagaagctccaagctctctcttaagtttagtttagtattctagtgctagtggagcaggaataaaatagtttctttagtcctcggagccttcggaagaattcgggtatggctctagtagctcttccttcttttgtaagacttgtacaattattagaatattcttcaaaatatatttacagtactttacttcactctgattattggagtacccactttccaatgtattatttga

SEQ ID NO: 39755 - DNA, 2448 bp, Oryza sativa
gaatgcattggggtgggtataatgttcattcgtatgattgctctaagtcataacaataattgtagagtagtatttggtagtataagcgaggtgcttagactattgaatatcattatatggggttatatgctgcgggtcagtcgaggtgggccgctgatagtgatagctcagtataagtattcctccatattagtatataatcctaagttacttttctagggaggttacttctccgtatttagcaccggttggatggccataatgggttgtcgtaagaaactcggcaaccaggagtggtctctcgaaacaccaggagggcattgtaatgggggtattggctatataattatatagcagataatattaactaaagttgtatgtatattagaggtgtaagaatagattattttcttattcttttccattttgcctagacttattatttatgagagaatgagtttttatgcttcgtgtcactctacccttgaattaaattaacacctgcttagactgattattacaagtaacatataaatattagcatagttttctccattataatctttccacgggactaaacaaatatgatacccttgtaatacttccgggtgaaatgctactatagtatatccgtgtgcttgcgtatatgatttgtaaccataatataacataaatatttctgttccattgctgggcattatatttctagtaatgtcgttaagaaataccaacagtgtgggggtggcgacggcgccggacatggcttccctggccagatttggccccttcctgggatgacggtggcagccaaggaggcgggaagggagatagcaagcggcggggaagggggaagacaagcggcggagtggagcaggagcgacggtgaggccagatccatggcgggcgctgccagatctggagggggcgaaggtggaggaaggggagaacgaggtggcaggcggcgggggcataggagaggtggtggtggggcagcggcgactacgctgggagccaccagagctggcaattggcagccgtaggagcaaccaagcaaggggcgcgagatggcgccggaggcgccgtcgcgacatgaggaggtggtcgtggccttagacacggcggcgacatccctcacagttggcaacatgcaggggagtttttgggcattggcgtcgactcgtgctccactagtggctagacatcctcttcttcatggagctcttcccccccccacccccctcctcctatggccagcctcagatctggtcacgggaagatccacgaggagggtggaagccgatactacagaaacacaaataggtgccggtttaagatccgacacttttgaggttccacgaatcaaaaaaaaatccggctcgatgcatcggctagtcacgacgaaggaaacaaatgcggatttcttttttctcggaaaataaaacgaatagagtaaggtactatccgtcggaatgggaaaacgttcagaaattttgtccggatatccacatacatagatcaaattttagaaaaagcacttatatatacataacattttcatacggagtcagatgaagataaactttagatcaaattgtagagcttgatgatatctacaatttcttgttgactattttattatttgagatcatttttgagtctaaatattcattataaaataccatatctatttttacaaaacctcatatctccaattcaaacgacatctaatggagatgtgttccatatcaaaattgtagagctcaatgagatctaccacttggtagtttataacatttgtattttaaaatgtttaaagtataaaacaaacactacaagttttgaagatgtgaaataaaataaataacatctctaatttatacaataagatcttgataagtgatatggtaagtaagctatacatgtagtaaaaggtcgtgggattaaaaaataaataatcatatttacatatatttacatgtgagtctcttaggggaattgccttgaaaatcaattttcacataaggttgtagtaccgcctccgaaattgtcgatataaatgtttgagaggatttttatataccgacaaatatttgttgccatattcgttcatttcatattcactaggtatctttatttgataatattcgatttgatttccgtatccggttctcgattctgattccaattccgaaaaaatctaaaatctaatatgataaagctagtttccgtccgtttctgtttcgttttcatccctacatacgtgcttcttctggccgtatataatgtgccgtgccttgttaatataacccctgttatccaacgtgcgcattaaagctatctaaacttgtgtttcagaaaaaactccaacatatatgcttgatcaggcaagtctagtgttgcagcgtccggaggcattacttttaaaaatatctgtttgaaactatatat

SEQ ID NO: 39756 - DNA, 8513 bp, Oryza sativa
ttgtggataattgattttagttactggcactggttttttcagccgaactcatccacagatcatctcccgacatcccaaatcatccacaatcccaaatcattcacaacaacaaaatcatcatccacaatcccaaatcatccacaacaacatatatagccaacaaaaaatcatccacaaattaagagggaaaaaaaggaaaagaaaaagaaaaacatccggccggccgaccctccgcgtgcgcccggccgcctaccgcccagcagccgccgcgacccctctgtcacgcccctccacgtgcgccctaccacctgccacccggcggccgcgcctccctcagccgccgcaagcccgccctgctcgctcgcccactgccgcgtgcgagaatagagagaggaaagggaaaggataagaaaagagaggaggagaataagggaagagatggttgctagaggataagtacgaggaattatatactatgcaccgatttttaattccggttggtgtttctaatcgggaataaaaaaagtagggggcaaacacttttttaaccgggactatgtttagtcccggttagtgtgttaccaaccgggactaaagatcataaaatggttatgggcttttcaaccgaggctaaagatgatttttagttatgattctttttggaaccggaattattgtggttttcgtccaacccagtaaagatcggttcttcaatagtggtggttgcttgatctctgctctgtctatctctctctccgtgaacttgtgaccttgaccaagagaggagagagagtggagatagttgtggacagatttgagcccattggtggtagttgaggcgaatggagaacagaggatacacttctactatttactagtgcactaccttcgtgtttgtttttttactggtcagagacccaggtttgcgtcgcccacagtcatccgtcgtcatttgcacggctccaatcttacccgacatcaccttcctcgactctgctctgcgcggcataaccggcattgtttatcgctgtgttgcattgtgtgctattggcctgatcacagtgcatgcccatatggccatatgtgacaagccttcgtaggatggaacatgtctactatgccaagcttcgggttgccgctagctgcatgcgtcgtccccttcggaccgccactacaagttatgtgtggcttatatgacacaggttataatgtcactatatcatctaatttatgacattttatttgaagcattttaacttaatgacaataaaaagttgtgtgtcacaataagtgtcatatagctagtctagtgtcatccagtgacaatatttactatgtcataagacctatttatgtgtcacaaattatttattgtattattttaaatatttttgtccatgtaggcaagccttattgccacatcagattttcttttctcattttcagatgggccaacctggtgctagcccaacagccgcttacccgaaatgggccaacccgtgcgctaggccgagcagccgcgcctaactcagcaaaatggctaaaaaatgttaggagttaggagtcgaacccgcaagctaaaaattgttgggagttgcgtgaaaaaattgtcaaaaacaaagttatatgacttatcgaaatctaccaattttattttagttatttctccatctgagtttgattgatctatataaaatttgaattttaaaatataagaaattcaaatatatatttttttgtgtagtaaatgatttcaaatgaaaaaattgtcaacaaaaaatttgtataacttatcaagatctacaacttttgttttggtcattttgctatatgactttgtttcaataatttgaatttgaatttcaaattatgactacttcaaacaatattttcaaatactaaatgatttcaactgaaaaagtcatcaataacaaagttgtataactcataaatatctataacttttattttggtcatatcttcatctggcaaagtgatattaacattgttcacaaaatttacaaatctctcttatagtttataaaaccatattaaaattttgtgaacaatcttactatcgcttcgtcgaatgaacaaatgaccaaaataaaaattgtagattcagatggattatacaactttgttgttgatgaatttttcagttgaagtcgttcactaataaaaaaattctatttgaagttctcaaactttgaatttcaaattcaaattgttcaaatagagtcagatggagaaatgacaaaaataaaaaatttccgtctcgatgatttatacaactttagttttggtgacttttccatttgaaatcatttattaaccccaatttttattcgaaattatcaatttttgaaaattcaaaatttgtattgttcaaatgaacttatttgtaaaaaggactaatacaatagttgtagatctcgattagttctataattttattatttatgattttttcatttgaaacaaaaaaaatcgacctaaaattacatttaatgttttcataaattgaaattaaaaaaaaaacatatgatcattcctgtttcggcccaaatggcccaactatttctgaccgtccatcttcgatctaatggttctgatcgccgtccctaaccctagccctatataaaaccctcctctccacccctcctctctctctctctctccaccctcagccgccacactcccatccattctcctctcctttcctctcctctcctctccggcggtgggtatcggcgatgacagcgtgcggcggcgtcctccttcgccgcttaccacgccgcctctatctccgccgccaccacgctcgggagcggtggatctgctagatcccgggcctagggcggctagatcgagcggcggcaatccccgggcggctcgaggacggcgtgcggctgcatcgacgggcccaaccgctagccgattccaaaccacgttggccacagcatcctcgcgccgcccgctgaccacccccccttcctcgtgctcctccgcgcatagcagcagccgggtcagagagagtgccgacacggcgtggacgcgtccgcaaatgccagtgctggtcctcacgctgatagctagtaggcccattaggcttgtttagtgtaaatgagacccaaatttccccatctgagtcatctgaccatctcctccaacctccgccaatccccatccccaatccccatcggcggacgggggctgctgtggtgcgcgccgcgcgggagggcagggtgaggtgaggagggcgcggccaccaggcttccagagctgcggctgtggcatctgctccggcaaggcggcagcacgaccagccgccatggcccaaatgggcaggcgcgcagcgcaggaagagcagagacagaggcagggtgggatgaatggcacaacagcagtgcaggcgtgcagcacccagcgacgacagcaagcaagcgacaagccaacaagccaagcatccatcactccatcaacaggtgcctacatatgtgaacattaatcaatctttggtactatatctatctatactcagtactgtacttcctatttgtgatgtattgttgaaagcatgaatcttaggaagttgaggtattttttgagtacctactcttctatctagtttacaaatagatgatgaatcatcaacttataattagttcttgtttaccgtgcttaatgtagacttgttgtgataatattgcatcgtataataacatgcattgagatttttcgttatgtgctaacttctgtggtaattcgtaggccacacctaaaattttttccgtcctccgccactggtgtggctgtgatgcatcaagcgccggtggttgatatggccgagacttctgtgccgaatcttggcatgaagcccaagatctctgaacggacaagcaacaccaaggccacaatgggcacaaggtgagcttgtttatttcttgtattaaagaaagctgaacggttctgctcgttcatagcttgatgtcacattccttttaatcttagagcaagagatgcttttgtatgattaaggatgaatctggattcgattttgtatggaataactcttcatttttgtgtgcaatatgtggactaaggctaaggctaaataatacttttgattaaggatgaatccttacggatgctgccgtcatgcacgttgtccacctgtgcgttgtcatgcggcagataaacgggctggagcagcaatacgtatgaacataaggtatttgctataatcgtaggctttagtccagacatgataattttgttgttgtcctgaaatttattatctttattttatagttgctgctcatacaatacatgtgaggattctaccattaaatgcacaatgacccaatttgaggatcagtttagcactataaaacctgatgggattcaagtcagatgccgtaaggtacttgttcttttttgcactggacttcggacaactctgtctgtttctatcaatgaaactgcggccaatgttttctaacgtaaatgcaatgccccgcgggggtttacttgagtctactaaattttgcttactcatgtattataggattcatagatacattatgccactggggtacatgtaattcaagtacaataagaaactactcaattgtttggcagcaattttgcatcatcagatgctgaatagtaagcactcctactcaattaggttcagatgatattttggtgacactgaacttgcgaccattgtgcttgtgggatgttatttaggtgctgctgtgcttctggccgttgtgctgttgctgctgtgcttttggccattgcgctactgctgctgtgatgctattgcagatgtgctgctgttgctctcgcagtagcaggaatatgaaatttgagagtttggatatgtactgaattggtggatggatgtaatgatattgcatttcaagacttctggaatgtgaaatgcatgtgacattgcaatcatttgtggaatgttaattcatttgaatctgattttgtatgtgctgaaatatagtatctgggctgaattgtatgggctgaaaaaatatcagttgagctttgtgggctgaaaaaattatttgggctggaaaaatatatgggctaaattgtgggggtggaaaaatcatatgggctgaattgtgcgggttggaaaaatcatatgggccgaattggtgtgggttgaaaatttgtacaggctgcattcataaacaaacaagcaaaaaatatactgggccagctagcaacaaccccagaaaaaatatatttgtggcccatgagctacatgggctttagcaggccgaatcttattttgtgactttttttttaaccatgtcaactgttatgtcagctgccacgtggcaagccccaggattttatgacaataaagcattgtcaaatgcttgtgacaataaatgtacaaacgtcacatactaaatttatgacgtggctttttgacgtttggaattacgtcaactgatttcatatattatgacataataaaatgttaaaaatccacacacctcttatagtgcgtggtatcgctgctcatgcttacttggcactgcatctacatgaaactgttgttgtggcccctttggcgatagcatcaccactctcgtcagactttcaccatcatcaacttttatccaataccccaaatcacaaatataccggccgatgcattaagaaccggtactaaagctatttataatcggttctaaaagcctaggtacctagaaatatatatctttagccccagttggtgttaccaactgatattaaaaatacatctttagaaccggtttgcagcaccaaccggtactaatttttgtggatctttagtcttggttactgttatccgatactaaagatatttttagcactggttgataatatcaatcgggactaaagatatttttaatacaagttggttgttaccaaccagtactaaaaatgcctctagagttagttcaaaatgaaaatacctttatccaagttaaacgtgtggagtaggtaagatggtaacacagataatggttgagatgcgagatcttaagttcgaatcccacatcctatatattttttatttagtatgcatctttagatcttaagtctcggttactataaccgagattaaaaagagtttagaatcggtattaaagatcatttctctagtgtgtggattggttataagttttacgctttctttaaccactcttatttattgtagtctattagggattatggaatatcaaagttctggatacatgtgtagctcacgattcaatgacaaacatagttgtcggcaagaattcttagagtgtgttttcaggtcaaaaattaaaagtttggttgaaattggaacgaagtgacggaaaagttggaggtttatatgtgtagaaaagttttgatgtgatgaaaaaaattgaaaatttgaagaaaaaatttggaactaaacaaggccttaatttgcaaggaaaatttacaatgtgagctacctccaccagatgaatcaaataggtccccgttatctacatgtgcattttgcctatatttttcccgcatttccccaactgctcttattcaagccagtttattagctaatttggtggaatatcaattatagtatggtacgtcgaactttgtaagatgtgaagaacttgtcaaagttctgggtaggtgtgtactcgctgaagatgccattgtctccgggtatcactacttgcaaggacaaatgacaattaattgatgagctaccgccacatgattttaacgcatgttttcaaacctctcttcgtcgttgtttattacggaattctaggaatctcaaagttctggatagatgtgaacgtacgtagctctcaagattccattgcttaaaaaacagggttatatatgcaagaatcctttgcacgttacccagatgcgcaatgcctatatatatttattacgcatttcttcaactgctcatattcaaggtagtttattagccaatttgagataatatcagtgatagtatggcagctcgaactttgtaaaatgggaacaacttgtcagagttttgggtagatgtctaggtcgaacaagattcaatttgtttcacaaatacgaatcggattctttattagtttttacgaaattgataatacacaattctgaaattacggactttccatttttaatttgaaataactaatttaatttgaaattttgaaaccacaaatgtgaagttgtaactaacgtgtgcgcttcttttagctagagtcagtataataaaaaaaatataaaacctacatatttaagctatgattaaaatttaaaatatatctctatactctataatacccgtgcatcgtacgggttagcggctagtgtaactaatgcatgggctttggaccatgtgtagagctatattttgcatgaaaacttgcacttctctctttttttttatatatatctcctttctacctaagctatagttggcttatactctcactggaaagttgacgtgcaacttttataacttttactacctccgtctcaaaatgtggataggtcttatctcattctaagttactagacgggggagaagtacattgtttttttctattataatatataaaataaataaatatttttttacttttagtacggtactttttttctattatatatatatatatatatatatagacacacacacattatcctattgtatttaaacaatgacatgctctttaaaatatatgtttgactatgtatagtcaatgatatattttgaagaccatatcattattcaaaacgtcataattaaccggagggagttgccaactattaaaattgctcttaggcaacttggaatatcaaacgatgcaaaatgtgaagatcttgttaatgttctgggtaaatgtgtagctcaagataccatttgtttaacaaatatagttatctggaggaatactttcctaggacaacttacaactaatcttgttactcccactcgattggatcatatagcttccggttatcaacatgtgcgttggctatatctttttacgtgtttcttcaaccactcttatttaagggagtttatgaggcaatttgatgtaatatctgttggcggatggcatgaggctcttcaaccaaacctgccgaaacccatggcgaaggctatagagcaagaacggcgcaaggcgaagagtcgtacaagcgccaggccagaggcgtctcagacgaagggtgcaaggcgaagactatctgccgaaggaggatgacttcgtcttgacaagttcgcccctgcgagggccgaggaagcctttttggcccatcaggccggcgatcgccagacggcccatcaggggcccatgagcccctataacattatgtacccctgtaaatgcctctttggtaagggtaatcatgtaaattcccctgtacaacctaaaccctagtaataagaacctgtaatggggctataaatagtcccctagggccgggctgcagga

SEQ ID NO: 39757 - DNA, 2908 bp, Oryza sativa
acaccttggcatactcagctagcaggtctgcgccggggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacactcctattcatgtcggcgaggaccttgttaaccctttcttccacccttgcattcatgctagcttctagttcttgaatgacctcaaccttaagttcggccttcaaacgagcgtccctctcttccttggagactttccatttcctgtattgggagctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctatttgttcagggatgtctgaaaacagggcagggacattcgctgctgtagcggctgcatcttcttgggcccatattgcctccttgccgatgtaccctgcggtgcccagccgatgcgggtgctcattccgctgttgcagtacgcgatgtgcctcgcttgattccctaaactcttgggtggtcttgagagagcagaattcctcccacaccgcttcggttatttgagggtattcatcgaacgacgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcctgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtccctcccgacatcgacgtatgttgttcctgctgcaattctgcagcacaaacagaaggcaatatttgctaaggggtgctagctaaaatttatgtggtcatgtggtgaaaatttatcctataaattaccatgaatttcgggttgttggtttgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccactgaatcaatcatgcaaatttaaaaaacagcagcagcaagggtacagaatttgcatgattgacataaaacagcagtaggaggagtatatatgccacaggggtagcaacagcaggggcaaataacttaaaccaccttgtctaaatttactcctttaatcattccaaaagaaaagagcaagtgcagaaatctgttcttatgcataaaaaagaccaggtggcccaaattctggtcttatgcataaaaaaagaaacaagtgtagaggtatataaccactctacactggccatttaataaggaacaagtgaacaagtgtaggggaaaaaaatgaacaagtgtagataatctgttcttattgagcaattcatcactagccatttaataaggaacacattgggcagcagcagcaagggtatataaatcatcaaagaatgacagaaaacaaaatgcatggagaactttggtgtctaggtcggttccgtccatggactacactgacctatcctttttcagctaaatgtaaacatgatccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcgaaaaaaaggaggaatgggggagggtggcggcatacttggaaaagcggcgtacctggagacggcggcgcaggccgtagtcatcctgaatcctggtggcggcggcggaaaggcagtggcgaagaggtcgaggcggtcggtggtggtcggggatcccg

SEQ ID NO: 39758 - DNA, 2617 bp, Oryza sativa
tcacctgtgacgggcgccagctatgtggccgtcacaggtggcctcacctgtcacgggcgccaaccgtggagccgtcacaggtaagaccacctgtgacgggcccaacactctgggccgtcacaggtgatgtcacctgtgacggccctacagatagagcccgtcacaggtgagtttgcctagagcaattttattttattttatttcacttagttcttttattttccttaacatattttcacatacactacatatttttttatacttaattattttatttcactatcagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactttaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactagacaagttctgcaacctggcattcggttcttcagccactcgttgaaagaagacatgtgcttattcctgacccaactctttgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctttcggtggtttactctcgatgatactcccctcggggtgtgaacggttccatacataacccttaaggatccccaggtacctttcgcaggatacatttgcgtcatgaacgttggaccacagcactttgtttgcctcacaaggtgcacggaaagatgttccattatgtcaaagaaagttgggggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtggaacgagcctactgattcttgatgagtaacagatggaacctttataccactcaaacatgttagcaaatcaatcttctcttctttcgagagagtgtagcaggctgaagaaaggtaaaccctgccgaattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccaaaatattgacttctttttccacatgctcctctcttttgtcttttgtttttccacatgctcatctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccatcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatacttttgtgcatatgcgtcccatgttcgtgtgccctcattccatagcctttcgaagtcatcgattatcggttcaaggaacacatcgatatcggggctgcagga

SEQ ID NO: 39759 - DNA, 3768 bp, Oryza sativa
  unsure (1)..(3768): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaagggtttacatcggccgatccattagaggaagtagacataggtgatggaactaaaccaaggccgacttttgtaaacaaaaacattaaagccgattataaggttaaggtaatcgagctacttaaagagtatgttgattgctttgcatgggaataccatgagatgccgggtctcagccgtgagcttgttgagcatcggcttccaattaaaccgggttttaggccttataaacaaccacctcatcgttttaatcctttattatatgaccgagtcaaagaggagattgatcggttgttgaaggcggggtttattaggctatgtcgttatgcggagtgggtttctagcatagttccggtggaaaagaaggggagtggtaagattagagtttgcatagattttagagatttaaataaagctactcgtaaagatgagtatcctatgtctatagccgacatgatgattaatgatgcctcgggtcataaggtgattagttttttagatggtaatgccggctacaatcaaatctttatggcggaagaggatatgtacaagacggcttttaggtgcccggggtttgttggtttgtttgagtgggttgtcatgacttttgggttgaagaatgccggtgcaacatatcaaagggcagtgaatttgatctttcatgatttgctaggtattatcttaaaaatttatattgatgatattgttgtcaaatcggatggtatggaaggccatatagccgatttgagattagcttttgagaggatgcgccggtatggtttgaagatgaacccacttaaatgtgcttttggtgtgtcggcggggaagttcttaggatttatggtgcatgagagaggagttgagattgatcctaagaagatagaaaaaattcgtgatttcaaagcgccgacatgcaagaaagaagtccaaaagttgctaggtaaggtgaattttttgaggaggtttattactaacctagcgggtaaaatcgatgcttttgttcctatacttcgcttgaaaaaagaagccgattttacttggggggcaaaacaacaagaggcgtttgaagagttgaaaagatacttgtctactccacccgttgtgtgagcgcctaaagccggaaagccttttcggttatatattgcctccgaagacaaagtcattggtgccgttttgacgcaagaggaagatggcaaggaatatatcattacatatttgagccgccgtcttttggatgccgaaacgaggtatgtttttatagagagactttgtctatgcttatactatgcttgtaccaaattgatgtattatttgttatgtagtacatacatagttacttgtcaagccgatgttattaaacacatgttgcaaaggccaattctaagtgggagaattggcaagtgggcatatgctttgatagaatatgatttggcttatgaaccattgaaaactataaaaggccaaattgtatgtgattttatagtggaccatcatatagatgttgcttatgagggagaggtttgcttagttgaagttataccttggaagatttattttgatggttcttcttgcaaagaaggtcaaggcataggggtagttttgatttcacctaatggcatgtgttatgaggcatcggttcgtttggaatattattgcacaaataatcaagccgaatacaatgctttattgttcggcttacaagtaatggagatgattggagctaaatatgtggaggcctttggtgattcggaattggtggtgcaacaagtcgccgggatctacaagtgcttggatggatcactaaataggtatctcgattcatgtttagatattattgccaattttgataattttgctattagacatattgctaggtgtgataattctagagcaaatgacttggcacaacaagcatctggttataatgtaaagagggggttatttctgatattagaagagccggtgcttgattttaaatttttgtgcgaaattggcaaagttggggaccagaggcggtctggccggcgttgcacggccggtctgaccggtgaccaggggcggtctgaccggctgcatgccgccggtctgaccggcgtccccgagcagtctgaccggccctgtgtggccggtctgaccggttctaggcaggatgctggggacacgtttcaagtaattttgaggccgaattaattgtgaattcggatatttgtgcccaggatacagaagaggattggagaattcctttgattcaatatttgaaagatcccacacttaaggttgatcgaaagattcggcgacaagcattcaaatatacattgcttgatggagatttgtatcgccgaaacatagatggtgtcttgttgaagtgcttagatgaagatcaatctaaagtggctatgggagaagtacatgaaggaatttgtggaactcattaatcggcccacaagatgaattggttgcttagaagagcggggttttattggccaaggatgattgatgattgcttcaaatattatagaggatgcgaggcttgtcaacagttcggcaatgttcaattggcgcccgccgccgtgttgaaccctataatcaaaccatggccgttctagggatgggctttggatttcattggtcaaatttatccttcgtcatcaaaagggcataggttcgtgctagtcgctacggattacttcaccaagtgggccgaagccgtgcctttgaagaatatgactcataaggaggtaattgactttatttcgaagcatattattcatagattcggtattccgcaaacattaactacggaccaaggcgcttcttttatgtctaaggaagtaaagagttttaccgaatcttatggcattaaattattgagttcttctccttactacgctcaggctaatggacaagccgagtcgagtaataagacattgttaaagctagtaaaaaagaagattgaggaacacccgaagaggtggcatgaggtgctttccgaagcattgtgggcgcataggatatctaaacatggtgcccctaaagtcactccttttgagttggtttatggtcaagaagccgttttaccggtagaggtaaatcttggttctcttcgttatatcaagcaagatgatttgtcaagtgaagattacaagacgttgatgggaggcaaccttgatgaagtcatcgacaaacgcttcaaggcattaaaagagatagagaaagagaagaagagggtggccaaggcgtacaacaagagggtgaaggcaaaattgtttccagttggagacttggtttggaagacaattttgcctttgggtactcgatccaaggagttcggtaagtggtctcctagttgggaaggtccttatcgagtttgcggcattgttcgagggaacgtatactttttggagacactacaaggggagcgttttcagcgagcaatcaatgggaaatacttgaagaaatactttccgagtgtttggcaagacgcttaggaagaactatggccggtaattggattatcgtcctaagatcaaaaacatgttctatgcttttagattcacgtcgttcatcaaaaaggcagggggcatatgg

SEQ ID NO: 39760 - DNA, 2517 bp, Oryza sativa
gtcagaccgccggttggaggccggtcagaccggccacagccagtctgaccggcaggctcgagtccgattctgttgcgtcgggtttcgaggtttccttgctcgggaaggcatgtttcaggtttcctttggtttctatcccaagttggacatggagaagggcctgtagagggcaagaccaacccctatataagggacaaggccggttcattgtaaaaatcaatctactatcaatcaatcgaattgttcttttcatattacttttagttttctcttagtttgtccatctttgtcggtttgcgccgtaaaccgtccgccgccgctgcgagagtgcgacatctctttgtaggtttgtcccgaaaaccttccgttttgcccacgagacgggtagttatctagaaatcggctccgctagccggtttagttatcaaaacccatctacatttagctccttgctagatcgaggtggttggcgactctaggatcactgcaaggcttgaggtgctgcgatcgtgcttgtcaactgtgtcacaaaaagttgccaacaagagtttgactaattcaacgtctctcgttcaagagacaaactgtgtgaaggcctaatataatgtatgtgcgtgtggtgcctgtatacttgaggaacagtgggatacgtatatgtgcagattgtgtactgctgacttttgctcaattaagatttgaggactttgcaagtagtacttgaaataaatttatctgacatttcataacgcaagaaaaaggcacatgcatctatgtctgacagtcacatttcattaattaaggcaatcttggtgaaattatgcttagaatattttgtaaaaaagatggctgcattaaagcattatcattcgaatgttaaggacaaaaaatgatatacatattgtcaaactgaatgaagtgaatggctagaaaaagaagagcactaatacaaaccacccaaatgtttggccctggtattatatcctatacaatgttagtactgcaaaacctcttttctacagctccataataatcaataaaagaaaaataatcaaacagggtcaccaatcaatgatttcaatgatgtcgtaagtagtcacctgtttttacatttcgtgaggattcattttttttagatagtggattaaaccggcctctacacctaaaggatgtacacagcctaaaagtctcttacacgagcacttagactcacacccttacaaaaggtttaacgtaaattcgagtgaccataaacggacacttagacaatgacagagattagccaaaatagtacttaagacaacaaaacaccatggtgcaaagaaaagagagcattaaacttccaatcttcttcttaagttccaccctctcattgcaaagaaactagaaactctcttctccaatatcatccaaccatcttttactctttggccatcttcctccttaagcagcgaagaccattgttttgcccaaaaagtccccctaaaaatcacctgcaacaagaaattagtattggagccattaaagactacatcatttctgcacaaccataccgcccagcacaacgctgcgacccctacaaagacttgagtttttagcttaggttgaacccccccttagccaattacccaataagctagcaacattcctaggcggatgaattccaaaagaaatgaagacaacattccacataaatcgtgcagagggccaacaaaagcaagaaggtggaatggatccttaggattcccaaaacaggcatttacccttccctttccattttctcttgaccaaattggcttttggtaggattactctacttcttaagtaccacaaaaaaaaattaattttcagcggtaccttgagtttccagatcatgtcattttttggaatgacgtccctgtacatgagctgtacatgatagatttatacatcgagttaacagaaaagagcccattttttgtgcctcccacacgaagctatcgttctgatttgttaaacttactaaaataacctctgcaactacctttaaccaatcttttagatactttcccactatagccctccgaaaggaaacatttaaaggtcttgtactcataacacctgctactgactcattcttgttcctcactatgctatacaactcaggaaaacgtgtagcaaaaggactaatcccactccatcggtcttcccaaaatctaacctgagtcccgttgtagacccttaaagatccacatgaaaggaaggtatttttaactgtcattagaccggacaaaaagtgagaatcccctggttttttttcgacatgagtcagagttttctttcataggtatttgtttctcaagagattttgccacactccttcctcattcataagcttatataaccatttgcttaacagacatttattttgtaattcaagattttgaatcccgagacccccgcattcctttggtttgcacaaaatgctccatttggccaacctgtacttctttttatgctcttcactttgccaaaagaatc

SEQ ID NO: 39761 - DNA, 33917 bp, Oryza sativa
acatgccagccaccaaattaaagagaattggtgataacgtgtccccctgccttagtcctttttttgtttgaaagaaatttctgatttcgtcattcactttgattgccacactgcctcctctaactatttgatcaatccaacgataccgtaaaggagagaagcctttcatcctcaaagtttgttgtaagaacctccaatccactttatcctaagctttttcaaagtcaagcttaataaccaccccattcttcttcttcccgtgcatctcgtgaattgtttcgtgcaaaataacaacaccttccattatgtttctcttgggtaaaaaggccgtctatgaaggtctaatgatcttttgagctactagagctactctatttgctagtaccttcatgaaaattttgaagcttacattcaataagcagataggccggtattgttgaatttgtttggcctccttatgtttgggtagaagagttatgataccaaaattcaggctgggtagtggcaattcttctttatgaaagttattgaacatggccattaggtcctttttaatgacttcccaaaacacctgaaagaactctgcaggaaatccatcaggacctggagccttgtgtgttacaattggaagatacctgctttacttcctcctctgagaattcctttgttaggatgtcattttcttcatttgagacttgaggaatgtcctctattctagactccctcatagaaaaattattttcctctggggtccaaagaggtttttgtaatattttgtaatgtactttctcagctatacgtcacccttgaatacaccctcctcttgtccaactgaaaaattcgagccttccggtgctttccgttagctatcaaatgatagtattttgtatttctatcaccatccacaattctttttgttttcgcccgttggtaccattttatctcctcttcccttagcaaaagtgctaatctattttttaaatagttcttgaggtttaactcttgttttgatagacattgcttctcagccttcttgccttctctttcttgtatgctccacttgtatttttcgcccatcccctcaaaaattgacgcacccgacgtatcctattttgccatctttccaactcagtccccccattcacttcctgtctccatacatccgtaccatgtcatagaagccatctcttcacaaccatccaagctcaaacctgaatattggttgtttaggagtattaacacccgtgtccaacaatagtggtgtatggtcggaacgttccgtactcaaagctcgattcgaagctagaggatacttatgttcccattcggtactcatcaaaattctatctagcttctcaaacgttggttttgacaaggagttagcccaagtgaatttacacctagaaagttccaactctcttaagtccaagctatcaatgaccgcgttaaagaggaaagggcacttctcattgaaattatcattggtcttttcagaaggatttctaataatggtgaaatctccaccaaacaaaacaggtagtgactccttactgcaagaattaaccaactcaacaaggaaagcttctttgtattcctcttgggccgccccatagattgccatgaggatccattgaaagccatcatccttatttttaatgtggaacttaatataaaactcaccttcatcaacgcttgaaatgtcaaagaccgcctcattaattcctaacaaaatacctcctgatcttcccctaggtcttgtccaatgccaaaagaaatcttggccttcacaaaaactcttaagactagcgttggagaaaatatttttacatgtctataaaagggcaataaagtctaactttggttttttgagggatccgaaagaaatctgaatttagccaagtctcccagacttctgctatttcataaattcccctcatgatgccctctttttgcgaatagcgactctaaccttcctctttcccctccttatttcagcatttttcctattagatttattggagaatttttgaacaccacaacttaggtggtctttctcctcatccatgacttcttctactaaatcaccacataagtgaccaagaacaaggttatctaactcttcttctccttctgaactaaatcccttattgttaacctcattacacaaacaattcgacaagggtaaactcttagaaattctatcttcttctacttctctaaggctcaaaatagaatctgaaattttactgcatgaacccccaagatctaaccctatgttgagcaagtctgaaacgatagaagcatttgaaaaagaaagaaacgaattactcgcattattacgtgattcaaggtttttccacgcctttcttttcccagccttctccacggcgtgtgcctcatccatgccggccaatctggagctagcccacgtcggagtagtcacaacctcgctaacatttgcagccatcaagatttgctcctcctcctttgctttctctcctctttcaattgcagcagaaaggttgttctcttccatacccactccctgtccaacgacttcttcttccatcacctcatcataaaccttattaagcacattttccattgccgcctcaacaacctcctctgctgccatctcagctctgtccttctctaaagtgcagttgccgagatcatcatttgctgccactcccgttcctttccctgcaacatccccttccttcccatcctcttgcatatcatccccttagctctcttggtttccctcgaaatttctttatcaacaccgtgttcctcctccttctcagcctcctcatctcgatccccatcctcctcctgttctatctccacctcgtcaccattctcgtcaacccccaatttctccacttcaaatttcaactcaaaataatgatctccaatcactacgtccagatttttcggaataatccttggatttaaaacagcaataaacacccttccaaactcacttttccttgttgttttcatatcaactgtttgggtggcccctaataaggatcccacagcccaaagaggaagaaactctctcatcttctttcgtagccaaacaccctaacccacactttcggtaaaagaaagccttcctctttctccgaccactcctcaaaaagtaaacggatgccatttgatattccactttctttcacatcagccctaccaaaagcaatggctctcttcaaatcagctctcgatggaaagggaactaagtaagagctgatatcatgctcaaccagttcccacttccactttgccggaaaaagcttacacaactgcgccgccatctgttcctttgtaagctgcccccctgtgcaagcaaccaaagccatctttgattctttcttccccttaagtaacggaggatgagggatatgatagaaacctaggccctccaaagcgtacccgacagcatgtgccactggtcttggttgcttaagcacgtggtcatgtgaatcacaaatatcacaatatatttctattgaacatccttagccaatgtgacctttttgataacatcttgaacaaaacttggccttggactgagttttgtgacgcctgcctccctcattataaacttcttcctcctcgaggtcaccatccatagacattttctcctcttccagcccgagaacaattccttcgagctccttcttctctacttgatcagccaacacctccctatctcctatctttacttgcttgctgcctccaatcgaactcgcccccattgcctcctttgctttccggatggttgttgctttctctttggaaatcccctgctgccaccttccctcattaccttcttgcatcggtcggtttgcaggacgctgctgccacggtctttggatgccccaggctggtccctctctacccggccgccctgcatagccgccccattgcgaccgaagcttcgcggtcctctcggtctaaagccgctccgctgccactccctcctatggcctccttgctgaccgtagccatacccgggctgaaaacccatctggccgacctcaaggcttccgctaaagaaagcctcatcttcatcgcgaaacacctcctccctgctagtaccccctccaccttgcctgctgcgatcattcctccacgccatgcctccctcctcttctcctactcctttgtgtgcggataacccttcgccgccggccaggaagccaacagtcgcactgctctcgctttcctttctcttttctgtaaaaagcgaacacagctgcacggtgtggcattcccttgcctgttcgacttgtaccggcgtcggttcccctcctgtggcccttttaccacggcccaagtttgcaagcagccggcccaaaccactagtaaacttgaatttaaaccttctctctttaatccccacccagacaaaaacctcttccttttcttttcctctcacaccgattgacaacaaatcgaccacgtgatctgtctcctcggttctcgtcaccccctgtcccctcgcatttgaaccttgaacagtgaaggacgtgcacctttctgtgcgacacttcttgaatcggccatagtaccccgggaagataaattagaattcatatgaatttgaaaattctatgcagggttgcaaagctatctttctgaattattagatcaggcactgaagaatgaatagacaaaaaggaaatgaaatcaaacaagatggctgcagtctattcaatatatagttgcaactgtactttacaggtcacttccttgccatgaaggaacaatctgtaaatacaaactattaatgtgtcagtaattcaatttgtagtaatccgttgtgagcatataaaagagagaaatttaatcttgaataaagctaaaacagtaagggtaccaggaatcctaaaatctaaaaataaaagaggaaacatcttgagcagaaatcgagtaatcattaagatacatagccatagggcctcttgattccgcagctgtctgtaggaggctaggagcaaacacacaagaaaataaaaagaaagggaaaacagtggtgctaccttggagatggaggttgggagagattggcctagaggaagccagacctgtgttgtcagtgagcgggagaagacttaatcagcatcttcagtccatgggaacggtaagtgctgctagcttaatggatcaccaaaaaaacagctttattaaccatcagaaaggtttaaaacaaaatctttttactccatctaccaaaagcagaagatggtggaaacaacaaaatctttttacaccatctagctttgatggctaaatctcgcacttgagtgcaacaagtgatttgttgtaataaccaggagaatacatactatattggttaataaaatccaaaatggagtctgtttggcaatggaaaacaagcagagatgtttacaacacttccattttctcataatattttttaaaggaaattttctgataatttagaaacatataaggattgatgacattttctgataatctagaaacattttctgataatcccaaattgggcaatctaaaagatcaacacagacagtatatagagaagaagaattgcagatcatcaaccatatcctgtatttgtatttgtatttgtagttctagatacaacatactgaaacactggataagtacaaacttcttcctttcttagcctgaagggaatcaaagcaaaaaaaaaaaaaatccagaacctgaatccctaaccatcatagacaaatcaattattccataccccagaatcataggtgatgtagcagaggcagacatcgacaggaccaagatcataggtgatgtatcagaggcagccatcgacgggaccaatgggagagcctctccaggcgtctaccccgtgtgggacggctgttcgcaaagaagccagccaagaaccatggcgaaggtggccaaggcgcttctatgccggcaagcgtggagggatccctccatcccgttgggggggcgaccgggccaaaggtggggaaacgtgcatccaggtgcccccattggagggaagtggtgtgtgggaaagggaggggttccaggaggggatctgcggtggaggtggagcgacgacgagggatcgacagtgggcggcggaggatggacgcctggggttgtggtggcgtcgcaggacggaggtcgtggcacttggcgtggcgatgccggtgtggcatgcgttggtcgtgatggaggcgcaagagggcgaggggattggggatggaggcgaggagggattggccgacgtctgatcccgatggtgaggagacgcgacgatgacggtggcggcgacggcaatgcaagacagcaagagggaaagggaggagaggagatagggtgacgagagggatgtgggttgtgggggtgcggtgctgcactgctgcgtgatgcggagcaacgcgggctgacggaggagcgttggatgtgtcggaggatcctgaaaaagacgtgagccgttggattgcgcaggactctccaccaccactactgattttctaagtagtagagatagagattggtccacctagtcagatttccgtctatatatatcttttatttttgtccctaataaaaaaaactgatctgatttttctccttcaatttgccttcaaaactatcggaagaggttgtgattctccgctccaaaacccatctacaaaaccatctcattgactatttccctgtacacaacgattctgcccaaaatctctcgagtctctacagcacctccaccttggatggcggccgccagcggcagcactattccctacagccctggccgcacgtcgccggtactgtggtgcccaggccccagaaccccagatctagtccggccgtgcggcgggcgtgcatccttgatcgggtggttcactggttctggggccgttccccgggttgcctccccggcatgtgcttgccgcactgcagcagcagccgcatcaccatgatgtattcacttgctgaatttgaaggcaatcaacagcaggttagcataacagttacttcctccgtttcacaatgtaagtcattctagtattttctatattcatattgatgttaatgaatctagataacatttatattgatgttaatgaatctagatagatatatatgtttagattcattaacatcaatatgaatgtcgaaaatgctaaattgacttacattgtgaaacggagggagcatgtaagatcgcacaagatcaaacaaacctatcagagtgaatggagcatgtaggatcgcacaagatgaaacaaacctatcagagtgaatggtagggaaaacaaaaaacccaaaaatcttttgcggaattaaagattaacctcgaacggagtcgatgacaaagctctatcgccgttggtcgaaccgccttcctaccgtcggtcagtccgccgaagcctcaccggtcagaccgcccaaagaccagcggtcaaaccgccactatcccaccggttagaccacgcgcatacctgcagttagaccgtcgggacacagagacaccagtaggtgacaaactcaaatatgtagattataactttcgacattattgcatcaactagtgtttacaaagtgcaccaacagcactcctcaccaaaatctcgaactaaactcgaaaccctaactttgtctcaattcaagtctctctaaaaccgataccgggaggcctcaccctccctctctatttatacatgaggtaggttgtgcaaagcccacgaatctaacacgatttagaactcctaactcacgtaagaaaccctctcttgcaagtatcgaactcatctctttccttatttcaatcaatcttaccgaattcggactcccttccaaattcaactcctctttccatacatacacaatccctcttgtataccatatgaatttcttcatcatgacgtgtgttgtcctctagcctttagtatcccacatgatctcttgatcctggacatcaacttctcccaagttgactccgatctatcaccggcaatactctcccgaagcctcaagcaatacctgcacatgcaacaaccaagaaaccatattccgagcacaagttcgtcccaacttgactcacattagtataataacagtatcaatacttatagaaaccatctagaagccaaatccccgaaggaaacatccaaattcaacaaaacaacccgaaatcgaacacgattaggatcatgcctgtcagaccgtcaggtcggccagtctgaccgccgcaacacttgcggtccgaccagtggcactcagccggtctgaccgccagggtcaaccgaaaactaccacttcacaaaaacaaccgtcttaaaaaaactccaaaataacattagcaaaccaccaatattttcatcacaaaatctaaatcaactctaggattttacaatctccccttgatgaaaatcattggaaaacaacaactggtttggggggttttgtgaacaatccaaaaagcatctcaatgccaaaaagtttcaaagaaaaatctctcacttttgaaaaaaaaaaaaattcccttctacttatggacattatgcccaatttggtacctttgttctcccccttttgacaatgaggtaatgaacatttctttttttcgaaaagctttgctataacaaaagtatttaagaacatgtgttgcaataacaaggtagatagcatgacaatctagttaacaagcatgcatagaagtgtaaacatgaatctaagatattgtcaataagatcaaatcaacactaaagattcatgacttcaaatgatttataatgcaatatattcacaagcacataggttgaaaaataaacactatacatatatacctattgcatttatcactctttcccaaattagcttcagcacaaaacaatcaagagaaatttttaacttttatttgagcctttttgctcattttttctctgaattatgtcgggtacgtccttgtcattaagactgtttccaaggattcgacacccattatttttgttcgcatcaaatacatccttgttgtcaagactgatttcaagaattcggaattctttttttctcttatagatattttttattctcttgcacaatgagcaatttaaagctatttaaggaatagcaattcaataaagcatacacataagcattaacaaatcaaaccatatgctagcatcaatattgcatatttcgttaattcaagtgaaagattatgtatcatgtatcatatcacttaaaaacaatatcaaaagctcatataaaaactaacatgcatacaagctagtctagtcatcatattatctaacatgtactgatagcatgctcaagtatataccaaaagtacaaacaaagctcttcttctttttcaattttgtattttttttatattttccatttttatcacaccatgcatgaattaaaacatgaatgcaaaaagaaaaataaaaagaagaaaagaaaacatgaatgcaacagagagccaaaactcccccttaattgatgccaaaaggacgaacaatccccaactcgcctcgaaaaaaagcaaatcaagaagaatccaacgatttcgtgaaaatatccgccaattgcaattgagtatcaacaaaagccaattaaacatctcccttctcaacatcatccctcaaaaagtgatagcgaatgtcaatgtgttcagtgtgtgagtgttgtacagggttcttagcaatattaatagcactagtattatcacaaaagaaaggaactttctcaaaagtaagaccataatctctcaaagttgaaataagccaaagaatctaagaacaacaactagcagcaataacatattcagactcagcagttgattgaacaacattagattgtttcctagaagaccaagcaatcaaagaagtaccaagagaataacatgttccacttgtacttttcctataaattctacacccactacaatccgcatccgaataaccactcaagcatatagaagatgatgtagaataccatattccaaatacctcatgatgcgtttaacaacttgacgatgtgaagcacgtggagaagcttgaaaacgagcacataaatacatagcaaattgaatgtccagtctcaaaacagtgagatagagcaaagatccaatcatgttcctacactcctttgatccacaacttcaccatcttcatcgagatccaacacaacagttgatcccattggtgtagagattggcttgcaatccacactacaagagatctaatgatagatgacactccatttatgtcacaaacattgaatttttcatcacgtttcgtaatctatgacgctcacgtgacgaaaattcatttgtcacctatcatgcgtctctaatggggttctatgacgaaaccctattttttcgttattaatctagtgacgatccttctgccgtcctaacattgtgacgctcatattcattattatctagctaaaaaacgtcataaaatatcatgtggcctgttaaggcccatgtagtgagcaacctatctttgggctaggccttgttaaggcccatgtactgagaaacctatttatgggctaggcctatttgaagtccaattagattttaataaattcagcccaattatactatatccatctatattgaattaaatattgagtgggctctacatattcaaaagacctaatatgcccaagcattacaatgaaattgcatctgggtcatgcatacttgagaagcccatatatcaaacagatttagccagttaaaatccaatacaaaacccaattaacatccacacatctgacatctgcagtactatgaattaacacgtggccaacccagccacttgtccaaatacaaccacaatcgctgaccaaattaaaatacattataggctcattatctaaacaagttcaattatatgacagcttcactgaccaaaaattatttcacatgtgcagttacatcaggtcctgaatagcaaaataaacaggtttggcacattactatcctaatcgagtcacaactcaatcaccgtccaaaacaaagtcatatgtccaaataatcattcaaattaactgacctgaacaagtcacatgtcaaagtcgcaccaactaaaacactacaaccatctcatcatgaatcagcatattactaagactggccaaaagaagaattattaaggccaatcaactgacgaagaagggtattggtctcctcaaatttccaatctcttccaactgttgctttcttgttgcttttgattcatctatcttttccttcaaggaatccaacttatcctgccacaaccatacaaaatattacttatattgccttttgctctctgtcatgaacacactagtatatgagaggtaacacatgtagcatatttctatcacacgtagcaaggcaacatgaagccaacaaaacgcaagcatgtaatatcttttattttgccaaccatacacaacatgtagctgaaagcattcatctcttatgaaaaaaaaaatccaagataccatagatcaagaataaagttacaccacagaattactaaaattacatcaatgcattctatagtaagtttcttttatagttggattttaattatcagaactagtacttgggagcaaagaaagcaatatggaagaaaaacatatagcacctaagatttagctataggtgttcaacttctccatttaaaattcagattataacttaatagaagcaacatatatgtacatacaaatgaagtgaagtaaaattaatcatgccacaagtaacaattcctataaactaagacctaattcatgtcatgcagatgtagttactctcataaaacaacccatgaacatatagtactacaacaaacaattaaaaattaagacagttgcactattagggaagaagacttgatctaatgacaatatgtgcatactaaatgaagtgaagtgaagtgaaggatatatgagatgtagtgcgtggggctagagagtttacatctagtatttgcaatagaggggttccagcagtgcattgggttgctttgtacttttgccagttgcagctgagactcttctcgcgcgcaagaagctaaactagctggcaaagaggacatcttcttggatgagtcatcatgcaagccaaatctctgtccaacaataaaaacatgaatgaatgttattgggcaagataccaaaacactacacatgtcatctctaactagtaaagctgtaattaggtgcacaggactcttcaatttgtggtgcgccatcgatggttccctgaataatgtgcaagtaatttctgaggaataggcatcatgtaatgaaatcgtgtaactgcatatataagggtgggtgtcaattgcaaacagttttacatgacagacaaaaatgcagttcaattacctgatttatcagtgcaagcgtgcagtaaggtggtgggaagtagagtgagaaatttgtactactagtaatgaaaacaaatctgaaattgcaggaacttactcctattaattggaccttgcactatctataagtttatgcagtgacattctgcggcataacattttttttgcaactgctaccagattagataagggcgacctgcgagaactgcacgattactggggagggaggacggcgatggaggcaatgtcataggccttgttcattcaaacaacatacaaataaggcgccgtgctccttttccacatccatcggccatcccaattgtaaaatcaaaggtgttttctttattattattctgtgatgaacaattgacaatggagattattggttttcatatttggaatttattcacgaagtggttttggagatgattggatttcacaggtgatcgcaggatttgtcattttatgtgaccggtcatacctggctctggtagccggttagaccggcgtgtatcgcgcggtcagaccggccgacattgtgtcggtttcggttttgggttgtttgtttggatatccgtgattatttcatgattatggcttctaaatggatactatacgtatgtaatactgttgtttactactaatgagtcaagttggagatagcttggtctcggaatatggttttctttgttcatttcatgtgtaggtgactcgatgcctcgggagagtatttgcggtgatggaccgagagtcggcttggggataagacgacgtccgtggtggacagagattatgcgggatacttaggctagagttgatgcacgtggttgatggagattccatatggcatatgatggaggtattgtgtgcgtatgggatgcggagtcgaatttggaaggagtccaaatttggtacgattgttatgtaaagtttctttcttgtactagagggtttcctaaggtgtttaggactcttagtatgagtttggttcgtggctttaggctgcctacctcgggtataaatagagggggagcgtgaggcttcccggtatcgcttttgagagtaattgagttgagtttagagttacggtttcgagtttagtcgaaattttgaaggagtgctgttgttgcactttgtaaacacagagagaatcaataaagtcgtcatccactttaagagttcttcgatttgtgtttcaccgggtttcggcggtctaaccagcaactcaccggcggtcagaccggcggcaagcggcggtcagactggcgacatacgggcggtccgaccggcagcggcaacaggcacggcaggcatctcagcggttcgaccgatcgatctacatcggtcagaccgacgttcatcaggcggtcagaccggcgcatatacttcggtcagaccgcgatccgtcgatttcgagggtaacttttatttccgctaaaagttttcggtttttggtataccaaccattcacccccctggttggcttatttattgtgtttcgatcctacaatgatttgggatgcaagttctagaacatggatataaattaatatgtattgaactacatgatatatatgcaatttatcaaaccaaaatcagtctgatagcatcaatttgggataactagctagcttcaccaataacttgactgaggttagtgaggttatatctttaccatccctaaatctctactaattactacaatatagccatgcatatattaactgaagttgcaactgcaaatcttacctcatagtccaatttttaagacttattcgaatcaagctataacaacctgtttgtgccactgccatatttcgccttaattagagttagtttattttgggcaggccaaattatttagtgtcgccttcatttcctggatatttgtgtttagccatttaatctgacagatgtaccatgcagtctcaacagctaactactatacttgctcactgatgatcatgaaagcttagacatcaatgaacatatcacgatactgtgatggtgtatggaaatatcacggtataccattaaccaagatggcatgaaattatccttcgttttttaataattaaccaagaaacaggaatatcccgggaagcactgttaacatgcttgtatatctaataacaaggcaactttaattttcttgttttctttctgaaagtaaccttcaacaatgaaccgtaccccacacaagtttgttttaattaattatcgtttataattaactaacagaatgagttgattcactgatacatatttcagacacatctcatagttcaaaatgtaggatcgaaacacaagaactaagccaaccagagaggggcgaatagttggtatatccaaaaacccaaactttttgtggaattaaaagttaccctcaaattcgatgtagatcggtctgaccgaggttgatccgccggtctgatcgcgcctataccgttggtctgaccaaagttgttagcccggtccaaccgcctgaagatcgcttctgcctcctgtcgccgtcgctggtctgactgcaggtaagccgttggtctgaccaccgcaaagccgccggtatgtcgccggttagacctccgaacccgggcaaacacaaatcgaagaactttcaaagtagatgacaactttattgcttctctccgcatttacaaagtgcaacaacaacactccttacaaaaatctcgactaaactcgaacacctaactaaaatatcaactcaatgctctcaaaagtgataccgggaagcctcacgctccctctcaatttatacatgaggtaggaagcctaaagccacgaaccaaactcatactagaagtcctaatccacataggaaaccttcttgtgcaagaaacaaactttacaaattaactccaatcataccaaatttggcctccttccaaattcgactccgcatcccatacgcacacaatacctctatcgtatgccatatgaaatctttaccaaccacgtgcattgaactctagcctaagtatcccgcatgatatcagaccatcacggacatcgtcttatccccaagccgactcccaatccatcaccagcaatactctcccaagccatcaagacatctacacatgaaacaaacaaagaaaccatattccgagaccaagcactctctaacttgacttattagtagcaaacaacagtattatatacgtatagtatccatccagaagccataattatgaaacaatcacggaattccaaacaaacaacccgaaaccgaaaccgacacagagtcgcccggtcagaccgtgggctggccggtctgaccggcagcacatgcccggtcagaccggacccaacaaaacaacagcacctgtagatcacttgtaaaatccaatcatctccaaaaccaattcgaaaataaattccaaatatcaaaaccaataatctccaatgccaattattattatagaataacaatcaaaaacactttgattttacacaaaatatatttttgggtaaaagaacataagttttcactgatacatttaagacaaatctcataaacaaaatcccgtatttattttattttgtgttctagtaaaacatttaatatgttcttcaaagatttgagattgcgagcaataaatagaagtttgcccaagcctccatccttcttggtattagtagtttcttttgttaaaaaaattggtaatttgctttagctgtgtgtgaaagaaagcctagaacaggagcaaagtcttgtacaagaaaggactacagagaactactaacaaagaaacagaagctaccatggttttccagcaccagttcagagcttagaaacattccgaacaaaaagataagcggcgtacttcattccataaccttttttctttttttgcccaaactaaaactgcacatgaaccgccgcaccctgaccgacatagacatggttgatgtgctctgcaattccgagcaccattccgtgatccatggccttctgactttgcagagagagattttctggcttaccgggcaaacaaggaagagaatcgtacgtctttgttcccgaatgcatcctaaccctaacgcacaatggtgatcgggttgatttgtgcctgaagttagatgattatcattgcacttagaaactgaattagctgaatatgagacgaactggtggcaaggcgttgtgcgtgtggatggataaatggacgcagtggccttttatacgcttcagcactccatcatctaatatgctaaatagcattgtttgcttttctgagacaatatcagttgtggtagggtacgtactcggtatatgctagcagagtcagaacaacatgttgcaattaagtcactgctgcagagaggggttaactccaagcttccgataagtatattttctttggataaatgtgtggtatcttttcaaagggataaggatggcaaaattggtcaaaataacggagaaattgtgaaatggaaggaagtagtatgtttaaggtgaagccaattctgttgttgtaaggtgaatccaaaaatatcggtggtatagagctaaacatccagtattttctacggtattaattgaaccgtattttttgaataccaatgaactaacatgacttgcaagcaaaaaccattaacttttgaggttttcttccatatttgaagaggtatatacctactcacaatttcagatttaaacaattaaactggttaaattgattagataaaaaattaatgtctaattagtcgttgcgaggtatagagaggtatatataactctccatgtcaatccaggggtatatactgtaaaatcaaaggtgtttttggttattattctgtgatgaacaattgggcattggagattattggttctgttatttggatttatttacgaagtggttttggagatgactggatttcacaggtgaatcacaggttcattatttcatgtgaccggtcagaccgggcaggtgctgccggtcagactggcggtgatcaaacggtcggaccggccagcccacggtctgaccggccgacactatgtcggtttcagtttcgggttgtttatttggatatccgagtttatttcatgattataacttctagatggatactatacatatgtaatactattgtttgctgctaatgagtcaagttggagatagcttggtctcggaatatggtttctttgtttgttccatgtgtaggtgactcgatgtctcgggagagtatttgcggtgatagaccgggagtcggcttggggataagacgacgtccgtggtggtcagagatcatgcgggatacttaggctagagttgatgcacgtggttgatggaaattccatatggcattcgatggagttattgtgtgcgtatgggatgcggagtcgaatttggaaggaatccaaatttggtacgattggttatgtaaagtttctttcttgtactagtgggtttcctaagatgtttaggactcctagtatgagtttggttcgtggctttaggctgcctatctcatgtataaatagagggggagcgtgaggcttcccggtatcgctttagagagcaattgagttgagttttgagttagggtttcgagtttagtcgaaatttttataaggaatgttgttggtgcactttgtaaacacagagagaatcaataaagttgtgatctactttgatagttcttcgatttgtgtttcaccgggtttcggcggtctaaccggcggcgcaccggcggtcagaccagcagcatcgcggcggttcgactggcaggcacacggcggtcagaccggcggcgacaggagtcggcggcagacgttcttggcggttcgaccaatcgatctacatcggtcagaccgacgttaatcaggcggtgagaccggcgcaactactttggtcagaccgcaatccatcgatttcgatggtaacttttatttccgctaaaagttttaggtttttgggtataccaaccattcaccccctctggttggcttagttcttgtgtttcgatcctacatatacctctagaatgtaggtacatacgttataattggcacaaatatgtatacctctagaaaatataagaaaatttcacaagtatttataaagataactttccaattatattctaacttgtacgattaattttgattccccattttatggagggtaaaaggagatgtacatatatatcatgtatggagagctatatacctctcaaagtttgagagaaaatcacttaacctttttaccttttcaacacttattttactactcgatatcatatcagtcccctacactccagccatttcattcagactactgcaatacgtccacgtatcaaccgatccaatatataaaggccattcccaacccaagaaactagacatagtttccataaactctacatcatcaagaaactagtactagacactactctttcaatgcaaacactactattccatacttaaatttaatgctacttatctcacatgatgtcttcgatgttgtgtagaaactatgtttcatgcaagacatggtttccttctctttcttcatttatacatttgccacattattttttatcctaggtggcaacttatttaatgctatggacaccatcttagttattaggttgggaatggcctaagccagaaagcaacacatccatcggaccttccgaattctgtttttcactttttttttcgaaagctacaaaactctacaatgtgtggtgagctcaatctgtgtcacaagtgcgagccacagaaaaagaaatgtacttttcagataaaagatcatcacaatatcctgcagctttaacttataacaaagcttgcaagaaaaacatgataattcattgaatttgtcacaagtgatcggtcgaatttgtcttgacgtccttcctcttgcttcaaatacgttgcaatatcaagtcatcacgaacaaaattaatcttaattagctaaccaaagctcatcaagtcaactagtgatcacattagcattagacaagcttgtcttctcggcaatcatgctgttcgatcgaactcgccgccgtgatggtggctaaggcgacgtcggcgagtagtgccgcgtggggaaggccgtgttctggtcggcgccgtccctactgttgacgtaaatcgaatataatttcagtagttgatttaaatggcttaaaacttctaaaacttcgtaactaatttatatgaactctaaatttagccaatctggaggactgcgaccgcaaggaaaaagcatatggaagctagattaattgaagaagcaaggtgagtcacacgttccctgcttgaatatgtttaacctactttatgaaatggttgccatttagaaataatatatatatatatatatattgctaattacgtgggatacgggattactaaatccacttgcttaacgccaatttacttggtatccactccttatcaatccttgggtataataattttatcagcttgggttaattatgttgaccaagctatgcttagccatacttagttcatctaatgggataatcactttactcataatttgtatattgacgagcttaattcaagctcgagatattgtaccattatttgttggtcctaatttgtccaactaaaatatgtcttaatgatagactatggatgcatggttttaatttttcgcacccatgataatgatggacctttttgcgggaatctctgaaagacttaccgtacttaccacaaaccaataggtgtaattgctaaccttttagtatagctctcccctttcataggtatacaagcgagtgtggccgtgaaggagtttggttgaacaggatggtctaagcagcttccagattaaccgtggcataatgaaggggttgtccatcctgattttagggatggtggcgaaacatgcagtgtggggtgtcaatggttagggaagggttatgaggaggtggttggttgggcttgttcaatgtgttgtaccgttgttaagtggagactaatcttttcttaattaatcaaatattttactatttttaactacaaatatttacaattgtctttatccaaaagagtagatcatgatacaaaagactactatctttgtttccccttgcacaattacatcattggtgttgcttgctgagtacagtggttggtacttagccttgcctaattttctattctcaaatttttagtgcctctgtgatgaagacggagttaaaatatcaagcgttgtaccctagttgagtactcctgtggactgaagctaaacacccactaggatagtccttttccgccgttgcattcttttcggtatgaggactaattgtcacttttgtaaatatttatgctttatttatgtttggatatgtacaataacatgtcatttgatgtaccttgtgttgattcctaaacaaggatttaatacacaaattggtctgaaaaaaggaaaaatttctgggtgtgaatcaccacacggcacaacagctcccactcaaaaaatgacacggcaacatagagcctacaccgcttctccaaccacatgaaaccatgctgccatagcataagtaggtggttattgttgctgagcttgccacctagttaggcagttgtgactctgcccatgcgaatgctccgcaactcggtggaaacatccagcactgccacctacatgcacggatcctcttctgctgcaagcaccaagaaagtattttcaatgccgaaggtcgcccatgctatgccgagaagacaccaaattggccaaactaccaagaacatgtgaatcccattgtttttttgtctagtgctctagtcttctagcaaagaccttatcaaaggtgtttgaagagtcaagggggataaagagaagtttgctcctatggcaacaaacggatcaatcagctatacataccgcctccatctctttcaataggaagtaccgcagggcttcaagaatcatgaccgacctcttacattggctacatactctgacactgatggtttgtgtttcgtgcaacggctctggctatatcctcatctccacctccttgtgatgttgcaagcgaagtttatcttgattaatgcgcaaacactggacgaacatctatgttcgtttccgatgcatcctaaccctaacacgtaatggtgaggtagttgtccatcaacataacttagattagcctatcgtgcagaagctgaatcagatgagcatgagacgaagaggcaaggtcttttgggggactattatacaattgtggtaggatatatatataattcgtatgctagcagagcaggggtattacgatgcaattcagttcctaagagaagggtgaaataggacaaaacaatggagaaattgaaggcagtggtatgttcttgaaccatggagaaattcaactgtaataaagtgaggagtgaagccaaaaatgttgggtggtataaactaaacttcctgtattttgatggtattaattgaacgattcttttttcctttcaatgaactaactaacctgacttgaagcaacaaccactttgtaccttttcggaactttttttttctaacacgatatcaaatgagtctctacgatcataaatgtgaaagtatcaaattatcctatgtgtaaaccagaagcaaaaacatccatcggcttttccaaattctgtttcttcaaagctcacaaaactccacaatatccagtgagctcgatctgtgtcaccagtgcgagccagagaaaaagaaatgtaacttttagataaaagatcatcacaatccacctttaatctatcagaatgcttgcaagaaaaccaaggtaatcaataaaaatggtacaagtgatcgatcgagagtttgtcttcacgtcctttctcatacttcaaatacgttgcactcccaatcccaagtgatcaagaacaaaattaaattttctaaattacaagcaaatcaaagctcatcgaagtatagctatggcattggcatcagacaagttcgtcctctccgccatcgtgctcgccgtcctcaccgtcgcggcagcggcggcgggctacggcggctacggcgacgtcggcgagtactgccgcgtggggaaggcggtgtcccggaacccggtcccatcgtgccggaactacatcgcgcggtggtgcgccgtcgccgggggccgcctggactccggcaagcagccgccgcggcagctcctggagccgtgctgccgggagctcgccgcagtgccgatgcagtgccggtgcgacgcgttgagcgtgctggtgcgtggcgtggtcacggaggagggcgaccgcgtcgccgggatgatctcgcagcacgcggcgcccgggtgcgacgccgcgacgatcgccgggatggcgagcgcgctgacggactacggccggtgcaacctgcagcacactggtttctttggctgccccatgtttgggggtggcatggattaacttccttagtaattaattaattaggcctttgcttaattaattatttaattagttatccgggttactggataattaattatcgatatttgctagtagcatctatcatgtttggatgctgctttctccgtgaatgtgatgataataataatcagaagaaataaataagaagagttggattcatcagctttccagtatcatcctcacaagcctcatggtcaagactatggaacctatacctgtcctgatggtgaagagagtgccactctgatgcatgcggtgcatatgcttagtgctatggatgcagtaagtgtggagcgagccaaagcagctcatgacagggaaaactggaatcgaggcaagatttgcaagttggagagcaaggtgtaccgtctacagaaggaattagctgaacttaaaggagaaacgccgccgccaacacccaagcttcgcctcactgcaagaaagagaacctgtccgccacctcgtctccagttagcttcgaagattcgcgtgatgggtgaagctgtgcccgatcgtgctgaacctgtcatcgacatcataagtgatgaggaagaggaggaagaccctgaagaaagagagccagctactccagaggaagaagatccatcgcttcgttccgacgcaaggcgggattagtcgcttagttagatcgttgccgtagttcactgtgattagattgtttgtttaagtttgcttgtgagtgtgtgggttttacttgttgcttacatcattggtgggatgtaacagcatgagtctagttcttttgcttgtcagagtgtaagatagttggtgagacagtgttaatgcaacttaaatgtaatcatacacagttaagagcaatatagaatttaaattaattaaataactccgttctaagggtgtctctctgtcgttctttcctgttgtctctgcttatcgtcagatggtgaacacgcgcactggaagtggaagtggaagtggaagtggagctactaacaatggaggagatcccacgctagctcagattctggcccaacaaacacagctgatcaatctgttagtgcagcaggcacagaatcagcaggcaaacaatcagaaccagaatccacccccacctccccaaaacaagctggcagatttcttacgtgtgagaccccctaccttttcaagcactaccaatccagtagaagcaggagattggctgcatgcggtggagaagaagttggacttgatccagtgtactgagcaggagaaagtttcttttgcttcgcatcaactgcatggacctgctgctgaatggtgggatcattttcgccaaggcagggctgaaggagagcctattacgtggcaagaattcacggccgctttcaaaaagacacatataccaacgggtgttgtagcttctaaagaagagagaatttagagcactcaaccaaggatctcgttcggtcaccgagtacctccatgatttcaaccgtttagctcgttatgctccggaagatgttcgcaccgatgaagagcgtcaggagaagttcttggagggactgaatgatgagttgtcttatgccttgatgtctacggatttccgggatttccagcagttggtggacaaggcgattcgtcaggaagacaagtataaccggatggagcagaagaagcgcagggctgcccaattcaaggcacaacagggcagtaaccagaggccgcgtctcgttacgggacctcaagctccatcgtaccctcaaggaggatcttcatcagttgtccgcccccaacgccagttctacaacaacaatactggtaatcgtggtaatgacaaccgcaacatggttgctcgtcctgcagcaactccagctcagaaccagcccgtcaggaaggaacagggaagcaagccaggggtgtgcttcaattgtggtgatccaggacattatgctgataagtgtcctaagcctcggcgcgtgaagaacgctccagccccgaataactccaatgctccagcaccaaaggcacgtgttaatcatgttgcagcagcagaagctcagaatgcaccagatgtggttttgggtacgtttcctgttaactctatacccgcatctgtgctttttgattccggtgctacgcattcttttttgtctaaaagttttgcgagcaatcatgggatggaagttattagtcttgggagacctttactagttaataccccaggcaatcaagtattttcgacacagtattgtccttccgctactatagaaatagaagaagttcctttcccatcctcgcttatcttgctagaatccaaagatctagatgttatcttagggatggactggttatctcgtcacagaggagttatagattgtgccaaccgtaaggtgactttaaccaatagcaatggggaaacagtttctttctttgtgtcctctcctaaatctcatggtgtgatcttaaaccaagttgctctacaagagatccccatagtacaagactacccagacgtgtttcccgaggatttgccaggtatgccacctaagagagacatagagtttcggatagacttggtacctggaaccaaccctatccataagagaccgtacagaatggcagctaatgagttagctgaggtgaagagacaggtggatgatttgcttcagaaaggatacatcagacccagtacttcgccatggggagcaccagtcatctttgtggagaagaaagatcatacttagagaatgtgcgtggattatcgagcgttgaatgaggttactatcaagaataagtatcctctacccagaattgatgacctgtttgatcaactggaaggtgctacagttttctccaagatagatctccgttctggatattattaacttcgaatccgtgaggaagatataccaaagaccgccttcacaactcggtatggtttgttcgaatgtaccgttatgtcatttggactcactaatgccccagcctttttcatgaatctgatgaacaaggtgtttatggaatatctggataagtttgtcgtggtgtttattgatgacattcttatttactccaagacaaaggaagaacatgaagagcatcttcgtctagctttagagaaactacgtgagcatcagctttatgccaagttcagtaaatgtgaattttggttgtccgaagtgaagtttcttggtcatgtcatctcgtctggtggagtgcagtagatccaagcaatgtggagtcagtgttaagttggaagcaacccaagacggtttccgaaattcgtagtttccttggacttgcagggtattaccgcaggtttattgagaacttttcaaagatcgccagaccaatgactcgtctgcttcagaaggaagtgaagtacaagtggacagaggattgtgaacaaagtttccaagaattgaagaaaaggctagtgactgcgcctgtattaattttgcctgattcgaggaaaggtttccaagtgtattgtgatgcatcccgactcggtttgggttgtgtgttgatgcaagaaggaaaggtggttgcctatgcatctaggcaattacgtcctcatgagaataactacccaacgcatgacctagaattggcagctgtggtgcatgcattgaagatttggctttcgaagaaggagattatgtataccttcgggttacgccgttacgaggtgttcatcgtttccagaccaaagggaaattggcaccgcgttttgtgggaccttttaagattgtgagtcgaaaaggtgaagtagcttatcagttagagttgcctctgtcaatggcgggaatacatgacgtattccacgtgtctcagttgaagaaatgtttacgtgtacctacggaggaagcagatcctgatcgtatagagcttcaagaagatttaacttatgttgagaagccagtcagaattttggaagtaagtgagaggaataccaggaatcacgttatacggttctgcaaggttcagtggagcaatcattcagaagaggaagccacttgggagcgagaagatgaatcgaagtcaactcatcctcatctgttcgccagttcttctgaatctcgaggacgagattccgtttaaggggggtaggtttgtcacgccctaaaaatcgcctaatgtaaaaatacattgtttaaatcatttttagaaattattttaaaagcctacaaactaaaccctaattatctaggaaaattttcaacataaaaatgagctagataaaattttattaaatactatacttgctcctctattttctagatttttctggaaattatttgagcaagggaagtatttttaataattgaaacaacatttcacaaattattttaattttaaaagttccaaaacccctccctaaagccgttgggccgtttttggcccaacatctttcctctctcccgcgggcaagccggcccaagccggcccagcgctgcccgagtcggctcaagccgagccgcccacccctccctcacgtgggacaccgacatgtggggcccacatgtcgggcccttctcctacctccggccggccgccgcttgccaagcccgaccgagccgccttccgcctccaaatccgctccaatccgaccccgattcttccgggtttttgaggggtttttatccccactttctcctctatctttacccccaagattcggagcaaatcgttgagtattctctccgaatcgagttcgtttcgaatttatccccaaaaaccgagtttagattttcccgagtcgatttcttgcgggaggagtccgatctcttcaatccaaggctataaataggaccacctcgtcgccctctttcgttttccccatctcccgagctctctcgtgctccgtagtgtcgccgccgcgcgtgtctagctcgccgccgccgccggtcatcttcggcgccgccgcgccgccgcttgcgtcgtcgccgccgcttgccgccgccgccgttaggtgcgccgtggtgaggggaacctcggccgcccgtcccctttcgccgccggccgccgtagctcgccgccgccggtcaaccgagccgccgccgtcgcccttctcgttgccggccgtcgtcgttcgtcgtttgtcgttgtggtgagtaccgttgggttcgtctcgtcgtcctctacgtgtacatgccctccaaatccgcggccgaccaccctagctccggcgaggtcgccaaccctagccggcctccgtaggtgacgtcatgctgacgtcatcagttttcctttttcccgattttctaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgattttgtttaattgctttagtttctgacgttccggaggagagcgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggtcataatttgattagcatgaaccttatatattggattggttcagctaaatgttatatgtaggtttgcttagccatgcttagaaacattagctaattaaaggggattaaatataaattatattatattattcttattattatggttatatttaatggtcgctcacgatggttaatcgtgtgatgttaattaattgataattaaagcctggttaaggtgggttgtgagcatatggttttgatggttgtgctcatgacaattaaggaccggttcgcgagctactgttgtgaaacatttatcgtgccaatcacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcatcaatgttaataatgtgataattaatttggctcctggtttggaatggataattcctggtttggaggtttaatttgttcaactggggttggttgttcaaatgtggttgggcctatgcaacatgggtgtgttgtatggtgttatttaatattgattaattattcaactgtttttactattctcttaaatatttattaaatgctgtttctgcaaatgagctatattatgccatcctttgttatcctgtgcacttgcatatttgctgtgtgacttgttgagtatgtcatatgctcattcttgtaatattcattcatcagaagacgagtatctcagtgaaggtgatgatctggaggattaggcttgttcttggttaagatgcctgtggagtggagtcgccatagctgttccgtagtttgttatagttttatctttccgctgcgtaaaatgttattctttgagaggaactatctacctctgtaatcttttattatttgcgaatattaaatagttatttatttgtactctattatcaatttgtcattgtgtgcctcggttgattcctggacgagagtttaacacacatgtaagcgtttggaattttggatagaaattccgggcgtgacagctgctacggttctgcttccccgcttctgatcgcttgcgagcatgagagattgaaacaaggagggcctccggaaccacagcttcgcctgaaatctgcaccgagtaggcgggtgatcaggtttttgaggagtgcttccgcatgactgctcctcgtcttctgttcgtcgtcgtcgtctgctacaccatgtctggtgcctccgcagctgccgcgcctagagatggaggcgcactaggagccggagccgctgcgaacgaaaacatcaacggaggcagttctgcctcacaatccagcggagggacattcacagggtataacctttgcttactgttaattcaatttttgatacctctgttagtcgcaattctattgcgttcattgtatgatcatgatgcttattatattttaagcatgctcctagttatgttagattttatcactagatcaccccacattgttcatgccatggttattgtcttaatattttggattaaaatatgccgatatatgaccatatttccaacaaaaatgtagtttaaaatttacggaacttgatcgcttaaatatcaggcaaactctaattaattttctggttgcttcaatcataagaagatggtccaaaaataattagacatacaagcattactataaaatttactttcatagtcccgagtaataattcttttacgtaggttaataaaaggtgcaccctgctgtgacgagcccagggtggcctcagccctgaaggtacatttattctccacatgtaaaaaatatttttcacagatgattccttaagaaaaccgctagtgacatagtctgaactatccatggataagtcggttccaatggccattatttttgtattattgtatagtagtgaaggctgcatacttaatcggtacttaattatccattacaaaacacagaagttgcaaccatgaatcttaaggttgatccataacatagtaatttgtacctatcaatttctagtttcaataaattacaattttactccaacctgttcactaaagaatatcgattggagacttttccaagagatcaatatataagaatataactttgagcacttaatttcaaaaacatcaaaaaggagttattaataatgtgaaagcttttattcaaaccagctatgctatgttgaattgatatgccgaaaacctatattctaaagaataattgtagctaaagatttaacttatcactacttaaaaaaacacgtagagatcaaaattataggtgccggaaaagctaaaaccaacacctcctatagtgcttttctctccccatgagctgaaaacatataaaaccggcacccttaagcgactataggtgctggttctaaagaaaaaaaatgcacctatactacatatatgtgcttttttttctaaaacaagataactttaatatattataagtgtcggttagttaaaaaccgacatgatcttttaaaaaatcgtcacctataccaaaccgagccgagcacgggccttatccacttcgcgcgcatctgcggccctatctcttctctccctctctctccctctttctctctctctctcgcctctctttgtccctctctctctcgcttctctgtcgcggcggcagtccggtggaggcagcggtggcggcggccacgacctcccctccaccaaatctggccacaggggaggcggcgagatgggaggcagcgatggcgcctgcgtcctcccctccgccagatccggtggtgttttcccaatcggggctcattagttgggaactttgacgtattctcataggtgccggtttaggagccgacaccttgaggttccagaacctaaagataaaaaagcggctcaatgtattaactcgattcgagccgatccattgagcagatccagttcatccccacaggaatcaaagaacacatacaaggtcaaagaacacgtgaacacgtgaacttcagggacataaaaaacattaacatctagaacatcaaaaacacgatggcagctggcgtccttctccacccctgccgccgtcgctgcatagagaggaggggtggtcatggggatatgtaatttgatcctatatatgtgagttcaatcagatttccatcacttccgaatgtgtgtatgtttggtttctagtgcctcctaatcctatgtacgctcactgaaacagtctgccctcccactatggttgctgttccatttacttgcactctgatagtctgatgtaagttagctcatatgggaattgtccatgtttgggatggttcggtctggctagccctttattatcagtcaaagatcaactcctatagtatgtactaatcctccacttatctatgctttgtataaagttaaagcctattaaatctaaaactcaacatgcaaccgtgccacatcatcacccactagcaataattacataatctcatgcaagcatagaacatgatgtacaatttatttaatgatacaaatcaaaatgcaagcatatctaataatcacccgtcatatcatttcactaccacagaatagggattcggtgccggttgggaaactcctttcgatgccggttttcccaaccgggaccacgaaggcggcacaaatcacaggagattaaaggtgccggttttaaaaccggcacctttgaggcgcacacgagccaaaaaaaatcggcttgagtcgatgcaagccgtcaagccgatcccaaatattgcatcaaaaccatgaacacatgaactaaattgcctcaaatccataaacacatttagatcacattgaacaaatcacgaagaggaaataatacaaaacacaaagagggagggacaagaagggaggggaagagatcgatccgcggcctccagccgcctccctcctgccactcgctgcctttgcatcccccctcccttcccttctgccgccccctcccttccgccgccgcatgacgcctcctccgctgggccccctagctagggttaccaaaaaagctcggagctcgcaaactgctcgacctcgattcacattgggctcaattcgagctcgtctcgaactctaaatgagtcgagcccgagcttgtatccaggcttgcaagcctcaccgagcgagctcgaatagctcgacgagctcagccactcacatttgctctaaaaatcctcgatgttctctgacattggctggttctggccaagctgtcatgccctctaccttgtttgcatcagacgttttcgagtagctcgaatagctcgaatagctgggacttttccacttgctagctctcaataacttcaggcagcaagcatacagaccaaagcacacataccaacaaagggtgtgtttagttcatgctaaaattggaagtttggttgaaattggaacgatgtgacggaaaagttggaagtttatgtgtgtagaaaagttttgatgtgatggaaaagttgaaagtttgaagaaaaagtttggaactaaactcggccaaaggctgcatgcatggcatagagtgcatcgccatcaatggagtgcactcatttcccgtaacagctgcatatgtaaactgtaatgtatggttgctagcatgtactatagcatattctagtagtactactgcttcaaatattggctttctaacagcgtgggacaaggattgacttcccactatataacacactcgaagctcggcaaaagctcgaagctcgaacgagccgagctcaagcctgtcttgaggctcgaagtctgacgaggctcggcttgagctcggtttgactatttatcaagctcatgccaagactggtaagctcgctcgagctcggctcgttgacagccctagggccacccctccgcgggatctggcagaggaagcaaagggcaggggaggtcgcggccgcctccgcctccgctggccagacgcccgccgcctccccttccactggatctggcggaggggagggcgcagccaccggccatgggagagaagggagggaaggagaggggatgcgagtcgagtaaaagattgacgatgggagtgagaagaacaggagacgcgagttgaaccttatcttcttctcgtgctggtggggcccaccggctcatcgatttgccagctcggctcaattagtaggtaatggttttttataaaaaaccggcacc

SEQ ID NO: 39762 - DNA, 13946 bp, Oryza sativa
cggtatactcatggagaagatccgtctgcagttcactgacattgcaacctagcaaaggatccatatgcccatagggttgatacttgtgctgtataagctgggttcccactgcctcccaaccctacaggttacgtttgtcatgttggggtagggatacctcgtgagtgtattctggaaatagctaggatccttggtcgttaaacactctgtggtttgtatatatgtatggacatgtacactttaagtcatttaattgccttgaatctgcacttcaatatttaggttgctcgtttgggaggatttcctcccatgtgaaatatatatgtaacttatgttgtttggtggctaccttgatcatccaaccttcggattgttcgaatatgtgaagacttgaactacatacatctttcattgcaattatttgatatggctggccaatatcagtctgcagtactgataacttcagtgtggtcatcagtgacagtgaggttattatgatgagaaattttatggtccttgatgttttgtaccaaattttatacataacatattgctttctcaagaactgtaagatctctattgtcaaaacatcattgcacaattgggattctcatgatgttgaaaatatattccagccaccaaatataactagccacatagtcatgcttttgcgtgacttttgttccatttaagaacttccatacatggtttattagttcaacttagcttttaaaaatctttttttgcatgtttattttcctttataaaactaataaaaaccgcatatgaagccgtatatagattatgatcagatataaaaataaattctgtttaaattctaaaaatatgtatatgaggttgcgaaatatcatttctctgtgcatttatttaaacccatcacaaaaattcatttttcccgtacgtcagaaaacatcatagtccacagggtttgctctaaagtctgatagtgaggggtataaactccaagctttcatacgtattttccatgaacaattaatgtgtctgatatatcttttgaaacgacgtgaacatgcaaaaaaataatgaacaaatgtgaaattgaatgcagtagtatgcacatgaaacttggggcaattcaatcgtaatagggcgagccgtgaagccaaaaatatattggtggtatcaaactaaatatcctgtgatttgatggtattaagtgaacgatttattcggttccaatgaactagctgacctgactagcaagcaacaatcatgtaacttttcaccttttcaggacctttttttttccaatacgatatcaaataagtagatctagactctagccatttcacaacactacaatatgtccacgtataaaactatccaatatataaacctgaagcgaacacatccttcggctattccaaaattctgtttcttcacaaaactctacaatatatgtcaccagtgcgagccagacaaaacgaaaagtgatttttagataaaagatcattgcaatccagctttaatttataacaaagcttgcaagaaaaacaaggtaatatcattgcaatccatctttaatttataacaaagcttgcaagctagaaaaacaaggtaatatcattcaatccagctttaatttataacaaagcttgcaagaaaaacaaggtaattaactaaaaatggtgcaaagtgatcgatcgagagtttgtcttcacgtccttttcttttgcttcaaatacgtttcagtaccaagcattcaacaagaaaattaacttagcaaaaatcaacgctcacatattcatggcatcagcttcagacaagctcgtcctctcggccatcgtgctcgccgtcctcgccgccgtggtggcagcggcgtcgggctacggcgacgtcggcgagtactgccgcgtggggaaggcggtgtcccggaacccggtcccgtcgtgccggaactacatcgcgcggtggtgcgccgccgccgggggccgcatggactcccgcaagcagccgccgcgggagttcctggagccgtgctgccgggagctcgccgccgtgccgatgcagtgccggtgcgacgcgctgagcgtgctggtgcgcggcgtggtcacggaggagggcgaccgcgtctccgggatgatctcccagcacgcggcaccggggtgcgacgccgcgacgatcgccgggatggcgagcgcgctgacggactacggccggtgcaacctgcagcacacggccggttcctttgcctgcctcatgtttggtggtggcatggattagattaattatttcattagtgattaattaattaattaggcctttgcttaattaattatcgatgtttgctagtactagctagcagtatcatgtttggatgctgcttctctatgtttgtgataatgataataaaaagaaataaaatgaggaacggatgttcctctttgttgttattcttggaaaatcgttttagttatgagccatgttttgatttatgttggtgcagccagaaatttttcgctggttgtgcttactttttgcaccaccagtttttataataactcaaatctaatatgttttgtataaaaaagtgtaaaagtatgatagaaaataagaacagtaatatcacataacattgtaatcttggtgatttggagaaaaggctgaagtatttaaaaaaggagttagagaagtgtaggagaggtaatatagggatagatcaagtgacgagggaggaggtgttgcggtacaaggtggaaagactggaggaacagattgatgtgtactggaggcaaagggctcatgtccggtggctgcagcaaggggatcgtaacacctctttcttccatgcggcttgttcggagaggcgcagaagtaatagaataggaaggctgagaaaggatgatgggggatgggtggaacaggaggaagaaaaaaaacagtttattactaactattttatgcagctcttctcatcaaatggagtacgtgatccccggcaaattctggaggctgttccccagcgaatcaatgctgagatgaatgaagagttaacaagggatttctctgaagaagaagtgaagaaggcactggataatatcggggatctgaaagcaccggggccagacggaatgccatcactgttctataagagattttgggacgtggtcggtgatcaagtagtgaaagagaccctggcagtactgaggggagctcctatgccgactgagtggaatgaaacaactatagtgctgatacccaaggtgaataagccagagaacatcaaggacctaaggccgatcagtttgtgcaatgtgttatacaagattgtgtcgaaggttttggcaaatagattgaaaggtattctgcccgatgcgatttctccatctcagagcgcttttgtcccgggaaggcttatatcggataatattttagtggcttatgagatgacacacttcatgaggaaaaagagaaaggggaagttgggatatgcagcaatcaaacttgacatgagtaaagcctacgatcgggtcgaatggcatttcttaagggagatgatgttgcggctgggttttgacgagggatggacaaatttgatcatgcaatgtgtcacttcggtgtcgtatagaatcaaggttaatggtgaattgacggatgttttccatccgggcaggggccttcgccaaggggaccccctttccccctatctgttcttactgtgtgcagagggtttctcagccttactgaagcaagcagagaatgaaggaagaatgaaaggtgatgcacagtgcctacaagagatcctatctctatatgaggagttatccgggcaaatgataaataaggacaagtcggtggtgatgttcagtccaaacacgtcgaacagtaagcgaaatgaagtcatgcaggccttacaaattaatcgccagacgatgaatgagagatatctgggtcttccggtatatgtcggtcgagacaaaatgaaggtgtttgcatatctgaaggacaggatctggaaacggattcagggctggaaggaaaagatgttatcacgggctggaaaggaaatcctgatcaaagccgttgcacaagccatcccaattttcgccatggcatgctttgacataacgaagaattttggcggaccagattagctccatgatcgccaggttttggtggaataatcaggataaggaaaataaaatacattggctcagttgggagaaattgacaaggccaaaaggagagggagggctggggttcagagacatatatacttttaatctctcaatgttggcaaagcagtgttggcagctgttgcaggaacctaactcgctgtgtgcgcaaattttgagagcaaagtatcacccaggggcatcaattttgcaggcatcaccgagaccgggaatgtcctacacttggcgaagtattttaaaaggggtacaaattttgaaggatggcatgatctggagagtgggcaacggtgaaaatatccggatatgggatgatccctggataccgagggattggacaaggaagccaatcacctgcaggggcacaaacctggttactcgagtaaatgagctgattgatccttacacgtgggagtgggatgagccactagtgagacaaaccttctgggaggaagatgttgaacacatcctgtcaataccggttcatacagatatgaaggatgttgttgggtggcactttgacagtaaggggcagttttcagtcagatcggcatataaggttcagaaggctatgcagcgaagaaacgacaccaggtctccggcaacctcatcgggcgatccctccggtgatcaagtatggaagaagctttggaagttcaactgcccaaataaaattaaacactttttgtggcggttgggacatgattctattgccctgcgcatgacactgaagagaagagggttggacctggataccaagtgtgttgcctgcaacaggcttgatgaagatggtggccacctatttttcaagtgcaaggaagtgaagaaaatttggagggagttaaatctggaagatttaacatgcgagttagccaatttgcattctgctagggcgattgtggaagcgctctctgcactgggggagaatgaaaaattaacggcctcattgctgctgtatacttggtggaatgagagaaataggagaagggagggggatggaagaagagaggcacatctgctggcggttgtcaagcaggctagaagaccaagccactgggagagaccgacgttggatactatgaaactaaatatagatggagcttttagaccacagggggcaataggaggatggggctatgttaccaggggagcggatgcacaagtggtcctagcgggagcgggcaaatcgactcgaatgcaagatgctctctgtcggtgatatgggaccgggggtatcgtgaccagaggcttgaggcagacacaatcgcccacgcggcctggcaccttcgaggacgtcgggcccgagggtgaggtgtctgccctcctcctgatttctcccgagggggggtcgggttactcctgccccggccccgagggccgaggcaccccgaccccttgaggaagtttgcgccacatatatgggataggtgaacacggcagtgctcacctaaccgcatttattgtagtctggtcaagcgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcacttgtctcaagccggagctagcgtgttatctcttagagatggcacgttagccctggttagatttataccaggcttcatcccaaccattacatgcaagatgttacatgaagaagggcaaacatgcacgttgctaagctgacgcatggtagacaaggatgactaatctgtgaccggtctgacactggtcgcgtcatccacagacagccataatcccacgttgcacctgtttccggcggaagcgggggtaggtatgggctgtcccgtcagaagggcactcggacagcaaccgtaccgatctccgtccatttatgaagagaagaacagtccagtttggaaagggagaggggcatgtggtatccccttgagatataaaaggaggaccttgcccacctagaatggggatctttttggctggttcatactttgtaacttgtccatacacagatccaccaaaacacaggagtagggtattacgcttcccagcggcccgaacctgtatacgtctcctgcgtctcgcgtttcttccgggttcgcgatctttccacatacagcgagagcttgggatttcaccctaagcccccggtcgaaccggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaatggtcgagcaagcaaaggcgcacgacctctctccgagtgtgagcggcgacgacggggagccaaacccacgccgtcgagctcgtactcccccacctcctccacaccaaaatcctaagcatggggaggcgctcgagagggttgataaatccgcagcatcaccggtcgtgggtgatgcaggagaacggcgagatggggagcgtcgcctcctcgtctacggcgacggcagcacgcctcagggcgcgcttcaggctgctggcgcgctcctacgtcacccgcccgtcgtccatgacccggagtctccagctcagcgatggctggacgacgtggccaacttggtcatgacggcccagcagcgcctgggtgctggtggacggtccgccaccaccaagacctccggcgccaccaccaccggttccgtgtcatcaaggcggagggcgcggcgagcggcggcggctgcacgtcattcggctgccactccctcatcgacaccttcgactcgggaggatcagcatggggagccggatgcccgcctcaacatcgagcgccggcgtaatagccggcgtactccccgtgaaacggagggtgcctcctcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagcgtcaaccccaccgagtttctccaggtctatacgaccgggattgaggccgctgggggtgacgacagggttatggctaatttctttcccatggccctgaagggacaggcgcggggttggctaatgaacctgccacccgcgtcggtccactcctgggaagatttgtgccaacagttcaccatgaactttcaaggcacatatccgcgcccaggcgaagaagcggacttgcacgccgtacagcgaggggatgatgagtcgcttcgctcgtacattcagcggttctgccaagtccgcaataccataccatgcatccctgcacacgcggtgatctacgcgttcagggggggtgtgcggcacaaccgcatgctcgaaaagatcgtttccaaagagccccagactaccgcagagctttttcagctcgcggaccgagtggctcgtaaggaggaagcttggacctggaacccctccggttccggtgtggcagcttcggccgcccccggatccgccgctcagacagggcggcatgacaggaggaggaagaagaggtcggtccattccggcgacgagggtcatgtcctcgccgtcgagggcgctccgcgggccacccgaaaggggaggcctgcaagcgacaaaaagaaagaggctggtactcccagcagggagcgcccagccggtaggtggtgctccgtccacaacacctccctccatgatctcgcggactgccgcgccgtcaaaaatttggcggagcgaacgaggaagtgggaggaggacaggaggcaggagcgccgggaaggtaagtccccggcggttccttccggcaaacggcgaagtgaggccaaacagaaggcccccgctgttgacatcgatgacggtgatgatgacctaggtttccaagaacctggggccaccattgccactgtcgatgggggagcgtgtgctcacatctctcgccggagcttcaaggctatgaagcgagagcttctggccgcggcccctactcatgaggcgacgcgtcgggcacggtggtcggaggttgtcctcacctttgaccagaccgaccacccaccgtgcgttgcccggggagggcagattgcgatggtggtttcccccaccatctgcaacgtgaagttggggcgtgtcctcatagatggaggagcggccctcaacatcctttcccccgcggcctatgatgccatcaaggccccggggatggtgctccagccgtcccaaccgattatcggtgtgacgctggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggttcactacgcctatcttcagatgaagatgccgggccccggcggccccatctctgtccatggcgacctcaaagttgcgctcgcttgcatggagcagcgcgcggaccacctcgctgctgcgtccaagcacgagggtggtgacgagaggcttggcacctccgcccccaccgccccgaggcggcggattgtcacatgcgacgaggtcccggtcaaggaggttgccctgggcgacggtccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccgggcgcgaggccggtccggcagaaagtgcggcggtaggccccggaacgtcaagccttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcttatgttgatgacttggttgtaaagacgcgcaaccaagagactttactctcagatctagcggaaacttttgaaaatctccgcgccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcagtgcgtcaccggttgcatggccgccctaagtcgtttcatatcgaggctgggagagaaggcgctacccttatttaagctcctcaagcgctcggggccgtttacttggacggaggaagctgaaaatgccctcgcccagttgaaggcgtatctcagctctcctccggttctagttgccccggagccaaatgagcccctgctactttacttagcggcgaccccccaagtagttagtgcagcgttggttgtggagcgcgatgaggacaatcctcattccgcgcacccccaccctgtgccgacttggcccgggagcaagcagggaggagaggcccccgagtcgaacggtggcctaaggcccctgacgaccggagtcggccctctgcccgcttgtcagacggtgctgggtgcccccgaccctcaggaaggccccgaggccactgagggaaggccgcacctatcgccctttggccccgaggctaaccctgtgctgactcgacccgggagagagcagggagaagaggcccccgagccgaacggaggcctgaggcccctgacgcccggagttggccctttgcccgcttgtccgacgacgccaggagcccccgacccccaggacggccccgaggccactgtgggaaggccgctcctgtcatcctccgaccccgaggtcatcggcacagaagacgagtgcgccccgaggggccacttggacgaagaacgccccgggggtacggcccctagcgaagaggatcggccccgccgaaaggtgcagcggcctgtctactttgttagtgaggccctccgggacgccaagaccagataccctcaggcccagaagatgctttacgctattctgatggcctcgaggaaactgcgccattatttccaggcgcatcgggtcactgtggttacgtcttaccccctcggtcaaatcttgcgtaatcgcgagggtaccggacgggtggtaaaatgggcaatcgagctttttgagttcgatctgcactttgaaccacgccacgctatcaagaaccaagccctcgccgattttgtggcaaagtggaccccggctccagagaccgtctcaattcccgaggccagcacggacccctcacagctgcctcacacctcccactgggtgatgcagttcgacggttctctgtctctccagggcgccggagcgggggtcacgttgacctctccgaaaggagacgtccttagatacttggtccgtctcgactttcgagcaaccaacaatatggcagagtacgagggactccttgccggactcagagtggcagttggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggataaagcttcggcatgtacccagacgggataacatggttgctgacgaactctcacggctcgcgtcctcgcgagcccagaccccaccgggcgcctttgaagaaaggcttacccagccgtcggcgcgacccgaccccttaggggagacggatgcgcctgatcggcccccgaggcccgtcggagtccaggcctcgggacccgaagggagcgctccaagctcccttagattgattgcatggatctctgagatccaagcatacctcacagataagactctacctgaggaccgcgaagggagtgaacgcgtccaacgcatttccaaacgctatgtgctggtagaagggaccctctatcggcgcgcggctaacggaatcctcctgaaatgcattcctcaggaacaaggcgttgagcttcttgccgatatccatgaaggcgagtgcggagcccattccgcctcgcgcaccttggttggcaaggcctttcgtcaaggattctattggccgacagctctcaatgatgcagttgatctggtccggcgatgcagagcgtgtcagtttcacgccaagcagatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaattcattaaaggcatcacggcccgttttggagtgcctaaccgtattattacggataatggcacccaattcactagtgaactcttcggcgattactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagccgatcaagatcagcttcgcagagatgacctcgactacttggaagagcgaaggaggcgcgcggccctccgagccgcgtgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtccccccgccgggctccatacggttggccacgggcgacggcactgagctgcctaacccgtggaacatcgaacaccttcgtcgcttctagccctgagggagggctcgggtgtcagcgttttgggctcgggcaaacccggaccccccccctcgggtgtgcagggttggccgggggctaccacgcatgcacattattatttctcttatttcagcgtttcaaaaaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaactgagccgtgccccggggcgtggtgaactccgggggggaatcggcaaaaacccacaatcgggtcacctataaccctcggtcaccacgttcccggcctggccagcctcaacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacgaagaattttttcatttttgattccagattaagttgatctatacaaaaaagaggcatgaaggccttagaagaaagaaaaagaaaaaattggagattggcgggggcctgggggctcattccgatgcgcccgggtcgccggcctcgtcgccatcgttgtctgcaccgctggcgtcgccctcctcgtcggagttgggggcgaacgcgagccgaggggccgagccctcgaagctgttgacgatgtggtcggcggcatcccggacccgcgcgcgcgcatcgtcctcggtcccgggagggaactcatccagcgccatccacggagagaagttggggtccctggcctggtaactcgctaatacgagttcgaccgctccttgggcgaggtccctcgaggatgacttaatggtcttctcgagctcctcggggagttgttggagagcccaggccatcttcgtgaggcgcggagcgaggccttccagattggtggagtgcggcattgtttggcctttccagaggcccgcttgccgaccggcgcgatctaggcgggagaccgcatcccaaagtgtgccaggccctatctcgcccgccaagcggagggcctcggcctccccggcggatgagtcaagggcgcgctgcatgtcggcgacggtgtgttcggcagctgcaaggcgggcgactaagtcgctttcgcccgcagccgccccaccgatgggcgctctcgcggccagctctttttcccgctcc

SEQ ID NO: 39763 - DNA, 3249 bp, Oryza sativa
gcctcaaggacctccttgcgccgccgggaagccgtttcagtttccgtcgcccgccgcttttgggcaacggcggtgtcaaggaccccttgggcggcgtcgagctttctctttagctccgcctcccagctcgcgtgttgaaggcggagggtgtcctgcgcctcgatcatcgcagtggtggcgatgagggtggccttccgctccttctccaccttttggggcgatttccgccagcgccgctttgcgggcttctagctccgagacgtgacggcggtgcgccttacggcccacctccaccatgacgtccaccgagcgccgtccctcctcgacacgcgcccatgcggcctcgagctccgctcgttccgctcgcagggcctccacttgggcgctgaacccatctagcaccgcagtgtttgcggcggccaaggcctgcagaaggggctcggcgctcagcggggcgacagaagacgaggagaagagccgccttggagagaacgcgacgcggctcggcccgccggaggaggcgctgggctcggggatgtcccccggacccgtttggtcctgggcgtcgcccggagaagtgggcctaggcgatgcgcccgcggcctcgtcgcgagccgccccggaggccgtcgcctgagcgtcgcccgagggagtgggcccaggcgatgcgcccgcggcctcgtcgcgagccgccccagaggccgtcgcctgagcgtcgcccgagggagtgggcccaagcgacgcgccagcagctttgtcgtgagctgcctcggaagacgccatcgcctcagcttggcgagcccgggcggcctcctcccgagcggcactctccgcttgacgaacccgggcggctcccgggcgggctcttcagcttcccggaggcgatctggggcctctcggccgtcagattctcgccttcggtcctctgccggcggccgatcttctggctccgactggccagacttggggtggccggaggaacgcgaccggacattgctgaagcagaagaaaaaaaccagaagacaaacaagatgggtaagagaaaacttgcttttgggataggagaaagacggtcgtaatgagagtgggacgaacctgcgagggggtcggttaaatgaccaccttggaggggaaatcaggtttccccgggatggttccgtctcccccatcttacggagccgcttcttcttgcgctccccctcgggttgcgatgacggcgcggccccctccgggcgccgactgctggcacgcaccgccccgccccctcggggaggagatgggggaggtgttcctcccagcttcctcttcccctgggcgtcggcagggcggctgctccccgagcccccgacgcggggccagaagcacgaccccctcctggggtagattgtcccccccggcggctctcgcccacgccgtcgtggcccttaggggtttcctcctctgaggccccgacccccatcataatggtcaaaatagaggcgcggtcgggatcgctgcagagggggaggattccttgaggaatgagagacgcctccacggagctgagattcagcaccctttggaccacgatcttgaagtcctcgggagcccaatcccatctgactccttggtgggtccgcatgtagtcttcggacccggagtactcccaggcgctccgggcgcgccgctggagcggcgcaatccggcgacggaggtagtcgccgtacaccatggcccctgtaagcccctgggatcgcaggcccgccaggcgatcaaggacggcgtcatagtcatcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcagcaccggcccccgcggctagaagtagcagccaccaaccaccgacggcggcgacaccgactgcacggtgaagaaccaccggaacagccgaagagatgggcgcaccccaatgaacatctcgcacaggtgcgcgaagatggccaatgtcatcaccgcattgggggtgaggtgcgccatctggagatcgtagaactccagaacgtccataaagaaggaagaaaatggcggaaccagccccgccattgcgaaggggaggaagaagacggaccgccccgggtagtctggtgccgggcgtccctcgcccagcatcactatctcccggccggtggcagattccggcatgaagcggcgcggcagcccggcctgcctctcgctcacgatgcgagaaggcagtagtacgctaccgtcgagcagagcggagccccgtgccatggcgccggaggaagggatgattgagaacgagcgcgtgtggcgaaggtggggcgcagcagagaaggagttagggcgcaagcggcgaaggcaaggggaataatggcgaaaggaagggagcaaatcttttcctcggtgtctttatacccttgccatcgccgtgcccggctcctcgtttctcgcgcccactatctcgctccctcgtttctcgctatctcgctccctcgtttctcgtgcccacgcttccactaatcccattcgcccgcttgcggcgcatgaagtggatgtgcggttgcggcagtcgagatagatcgtatcgtgcgcgcgttaattacgctcgccgaccgaagcgacgttaccatatctccaggcgaagcaaatcagctcacccagattcgtgcgctgctcaagtgatgtggcagtcttgaagagaccgcccattatggacagccaagttaccattaccgatgtgcatggtttgagaccgttgggtttctgcgcaaccatggaaaccggtcccacctgtcaccaagctttaggagtggcgttacgcccgaccgcttcccttgagaagggcgatcgccctggcataacgccgggggctactgtcggtgatatgggaccgggggtatcgtgaccagaggcttgaggcagacacaatcgcccacgcggcctggcaccttcggggacgtcgggcccgagggtgaggtgtctgccctcctcctgatttctcccgaggggggggtcgggttactcctgccccggccccgagggccgaggcaccccgaccccttgaggaagtttgcgccacatatatgggataggtgacacggcagtgctcacctaaccgcatttattgtagtctggtcaagcgtgtcacgctgcatgcagcgcag

SEQ ID NO: 39764 - DNA, 1933 bp, Oryza sativa
atttccccaactctcgagatctatctaatggcacgcttaaaggtcattaatagggctttatttttttgccgtttgttgagttgtcccgtttcgcgtgtagtttcggagcccgaagacccgtagtgcgaggatttcgaggatcaagctccagatctcgagcaaggcaagccacctttgaacatcttgagcctatatttggaatttaattatattgcttgcaaaatattatgcattgataggatcgcactaaatcttttgtcccatctgcaagacagattggcggacttacctaacttgttgcatttgatccttccattgttaattgccatactatgtccccttgtaaccacccagttgcacctcgatattcgtgcactctgtgcaagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaaagttgcttcctcccgccgtggcccacgctttatccgcactgcgcggaagcgtgttgttggttcttccaccgtgttccgtttccactacccagctcccccaccgccagcagcccgtgctgctgccggccctcgacaggttccgccggtcccttcgcaccagccgatcgacgtttcttcgacagaggagccgactacaggaggcagccaggccgacgaggagtagaggaggcagtcttcagcagccgtccgtgtgtcaggcccttttgttccgccgccaactcttttggagtcgtggcgaggtagtgcgtgtgtgtgtttgatgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccacagcaaccgttcgcaccgtactgtttcccgcaacgcagaggttgagcaaccccgccgcagcagccgctcgcatcgcacagtttcccgtgatgcagagatggagcagtctcaccgctctcaccgcactgccagtcacaattctggagaagaacgcctcccttccccacctcatgtggaaaacaacatgcaacacttaatggcagttcagacacaaatcttgcaaggactaaccacagtcatagccagttttcagcataatgcacatggaaatggccaccctcacatgggcaacaacagatccaagctgacagactttctgaggtctcgtccgccagagttctctcagaccgtcgagcccgtcgaggctgatgattggttgaaagatgttgatagaaaactcaacttagtgcagtgtactcctgttgagaagacgctctacgcctctcaccagctaagaggacctgccgcagattggtgggagaattactgcaatgcacaccctgaacccactaacattgcttgggatgagttcgctacggcttttcgtgcagctcatgtgcctgaaagcactattgacatgaagaaagaagaatttaacagacttaagcaaggcaacagcagtgtcaatgagttcctaagtcagttcaacaagttggctcggtacgcccctcaggaaggggccgcagg

SEQ ID NO: 39765 - DNA, 2766 bp, Oryza sativa
cacagtaatgtccttcggactcaccaatgctccagcattcttcatgaacttaatgaacaaaatctttatggaatacctggaccagtttgtcgtggtattcatcgatgacatcctgatatactccaaaaatgaggaagaacatgctgaacacctgaggctgataatggaaaagctcagagatcatcaactattcgctaaattcacgaaatgcgaattctggttagaccgagtagcatttcttggacacgtgatctcctccaacggtgtcgaagtagatcccagcaaggttgaagctgtacttgcttggaacccgcccaagaatgtgtcagagattcgcagcttccttggcttagctggatattatcgaagattcattgaaggattctctaagctagccagacctatgaccgaactgttaaagaaggaaaagaaatttcaatggtctacagcctgtgaagacagctttcaagaaatgaagaaaaagttgaccactgccccagttctcaccttgccagatatccgaaaagatttcgagatcttctgtgacgcatcaagacaaggcttaggatgtgtcctaatgcaagaacgaaaggttgtggcctatgcattcaggcagctcaagcctcatgaagtcaattatcccacccatgatctcgagtggcagccgtggttcatgctcttaagatctggaggcactatttaatcgggaacagatgtgaagtatacccgatcacaaaagttttaagtatatcttcactcagaccgagttaaatatgagacagagaagatggttggaactaatcaaggattacgatcttggaatccactatcatcctggtaaagccaacgtggtcgctgatgcactaagtcgcaaggcctattgcaatgtagctcaaatacggcctgaccaagatcacctgtgcagagaattggagaagttaaggctgaccgtggtacagtcaggagtccatgccagcttgacagtacagcctaccctagaatcgcaaatccgggaggcacagaaagacgacgaagggataaaagagttaataaaaagaatacaggagaagaaagacaccaatttctccatagacgatcaaggcacagtttggtgcggtccacgcatctgtgtaccggccaagaaggagttaagagatctcatcctaaaggaagctcatgagtccgcttactccattcatccaggaagtacgaagatgtaccaagatatcaaggcatacttctggtgggctggaataaagcgagatgtcgcagaatacgtagccttgtgtgacatttgccaaagagtcaaggcagagcatcagaggccagctggtctgctgcaacccctaccgattcccgagtggaaatgggaagagatcggaatggatttcatcaccggtttgccaagaacccccagcgggtacgactccatttgggtaatcgtggaccgactcacgaaatcagctcatttcgtgccagtaaaaaccacctatgatggaaagaaactagcagaactctacatgacccatatcgtatgtagatttggctgtcccaagaaaattgtgtcagaccgaggcactcagttcacctcaaggttctggaagcagttgcatgaagccctcggaactgatctgaattttagtacggcctaccatccacagaccgatggtcagacagaaagggtaaaccaaatcctagaagacatgctgcgtgcgtgtgccttggatttcgaaggcacttgggatcgttgtttgccgtatgctgagttctcatacaacaacagttatcaggccagcattcagatgtcgccgaatgaggcaatgttcggaagaaagtgccgcacccccttgtgctggaatgaggtgggcgaagccctggtattcggtcctgacatactcaagtcagcagaagaacaagttaagctgatccgagaacgtctgaagacagcgcagaaccgccaaaagaattacgctgacaatcggagacgtgaccttgagttcgaaaagggagatcatgtgtacctgcgggtatcaccactccgaggtatgagaaggtttgggatgtccggcaagttagcaccccgctacatcggcccctacctcataaccgccagacgtggcgaagtggcttatcagcttgagctacctgaaggtctcgcaaatgtgcacaacgtgttccacgtatcccagctaaagaaatgtcttcgagttccagaagagcaagtccccttgggtaacatcgagctgaaaaagaatctgacctacaaggaaagaccgatcaaggttcttgaagaggcagaacgtcagactcgaaggaagaccatcaagttctacaaagtccaatggagcaatcattccgaagatgaggcaacatgggaacgagaagatcttctccgcgccgagtttccggagctgctcccttaggtgctgaatctcggggtcgagattcttgttagggggggttggtctgtagcgcccgttccgtcgtggtgcctagcgggaaaataatctccgaaaaaccctaattgcgaaatttgtttctttgattgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatctctctctcccccggccctctctcccgggcgctctctctctctctctctctctccccccggcgcgctcctc

SEQ ID NO: 39766 - DNA, 1246 bp, Oryza sativa
cctgcagccccacgctgctcgcgcgtgcgagagtcgccccgagcgcctctctccccgcttcccctccgtcctgcccgcgcgccgcgcgcgcgtgcgcgggagtcgcccgcgctgagcgcccctcccctcgcgcgagctccccgctcgcaaagccgcttcccgcgcgccgtgttcgcgggcgcgcgcccgcgcggacgccgcccgttgtttcccgcgcgcgcgcgccgagtggccgaccgcccagtcgccgccgtcgtcagcgcctgccgcgcctgtcgcccgtgtcgtcgcgccgctccaaaccatctcaccgtcatcgccgtcgtcatcccccggccccgccactccgcgcgcaagccgccaagaggcggaggccgagctctcccttccctctgccgcgtcgccccgccccctcctccttttcccgaatcggcaaaggggcgagccccctttctctccctccttttcttctttttctcccctttttcccttctcgccggcgtcatcctcttgtcgccgttttggccgctagccggagcgccagctcgcgcccttgaccgcgcaagtcgattcccaaactgacattgccgccccctataaaccccagcctcccctttcccctcctctcccattcgcctccgcgccattgccgccgctcccgtgctctgcctcgcctccgccgtccatcgccaagcgccgggagagccggtgcgttcgtggacgcggaaggggactccgggcgcgccctcttcaccctctttgtcacgtcctgataaattcatcccaaaataaaaatcattttctaaaaggaataatagaattaattaaaatacgaaaagaaattggcaaacactaaaatacgtgcaagaaaaattcaaatgtggcccggagaatttttgttaaattctccttggtctaaatggagctctcaaattttacttgaattttcagagcaccggaaataattattaagcaacaaaaacaattaacaaagtttattaaaaagaaaatctaaaaataatcctccttttcttttgggccaattttggcccaaagtcctccctctctcccctcggcccgcggccgaagtctccctttcctccctctctttctctccctctccttctctccctctccttctctccctccttctcttgggctccccttcccctcggcccagctccctcctccctctctcccgggctgcctctttcccccccccctcccctcccggcctgcccggccc

SEQ ID NO: 39767 - DNA, 5492 bp, Oryza sativa
cacctcctcctcgcccgaagctcgctggagtggcctcctcgccggcgtccagtggcgtcgccaccacttctccgtctccggccggctgctgttcgtcgccggtacgccgaccgacgtcgccgtctcctccgttgacatcgcagcgtcgtcctcccctccggctgctcctcggtttcgccggaacgccgtcgccgcgccggcctctccatcctcttcgtcgccggcgtcctttcggccgccccttcctcctccccggctcgtcggcttgctgcaccactaccacctccggcatcgcagcggcaaggtcgtcctcggcatcgtttcccctccatccaaacccctccgcggtccatcatcgtcgtctccgatcgttctcgtcgtcgacgtcccgtcggttgcccggctcgtcgtctcgcggcgccgcctccgtcgtcggcatcgcagcggcgtgttccacgtcgtcctcgtctccgtgcagccaccgccggctgccctcgtcgcctcctcgccggctccggtcgtcgtcgtcgtcgtcctctcgtcgttcccggttccgatcgtcgtggcgttcgtccctccgtcaagccgttctcgttcgtcgtcctcgcttcgtcaagtgcagcagccccatcatcgtcttcgtcctcgcctccgcgtcgtcaagcctcgtgccggccgcgtctcgccttcgtcctaggatcgccgccgaagtcgtcccctcgccgttcgtctccgtggttcccggccgcctccgccgcgcccgttcgtcgttgtcgttcccacgcctcgtcgcgtggtggtaaggatccctctcccgctgccccgtcctcgtcctttcggtgtcgcccgtgctcgttgtgcggttgtcggccccggtacccgtgtaccggtgttggtagtcgttcgcttgtgcgtgtggtgaccgtgttagcgtgcccgctcggtagccgcgtggtttccacgtgtgcaggccgtgtggtgtctagtggagtccgtttgtcggccactcgcctcggttgacacacggggtccgcttccgtcgacccgtggaccgtctctgtgtacctggtctaccgcggtcctttaggttgacatgtggggtccgcatgtcaacggcgcagccttcctgtcttttccaggctagcgcttacacacgttttatagttgcaaagcttaattataataatccgcaaatctccatataacagcattaaacctcggatgatcatatcttggtcatacgaaccctgaatcgacccgttcaagtctcctaatgttggttataacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattactaccttgttcaccctagattaaacaaaacctcaactagtggacactctactcgtggtatccctagtttaaatttaggtagatgattcgctgattaattaggcaacattaggtggttttataactttagactttgggaattctcatatcatttggacactatggaattgttgggttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagtcataaacaaaagtacacggattggagatggatgaagtcgggggtcgatggacattctccaggacaaatgaaggctacacgagctgcggcccggtagtcgagatgtcgtggcagagggttggtgccctgctgcttggggctcagtcctgcctgcctgtcccgggggttccggccgtaggtgggattgggtcggtactcttgtttatggctaggatgggttgggaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctggggcccaagggtcgggttgccagttcggtctgaatcatcgtaggccttgggttaaggcaggttcgtgtgggttcacgaccttgattaataatattgtatagctctaggatcgtgtttacaaaatagctttgggcaactaagtgactgttaaatgctgtttactgcaaaacttaacccctatattattatccccttgtactcctttgcattaattgtgcatctccggtgtggcttgctgagtactgtggttgtactcattcttgctctatctttctccccccccccttcagtaagagaagctttggagaagatgtcttaggtggagtcctggcttataccccagttgagcgcctgtgaagatggagccgtaggcctgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacactcttcctcggcccgaggccggagagatcactcccgcgccgtcggcctctcgtcactgcgcccgtcccgcacggtagtgcctccctccgttctccctcctcgctccatctcctccccctagctttcggtagtagcttgagtagactccccgtagttagccggcgccgccccgaccgttgccatcgctcgctgtatgctcgccgccgtcgccgcccgagctccgtagcacccgctcgtcgccggcctcgctcggcgtagttccgtccaatccgacgcaagcgtcgagttcccgaagccgcgtagatgctctcgccgccgggaattagcccctcgggacctcatcgccgtttccccctttcctctccgccggttgccgccgccgcaatccgccgccgacggactccctccggcgaatccgagccgttggctcgtctcccctcgtcctgtgctgccacccggtgtgctcgctttcgccggtatcgccgtggctcgctccgccgctcgccgctgtcgcccgccgtccattcgcggccgggtcgtcgtctacctcccgccggcccgcgtggctgccacgtaggcgccacgtcggcgccacctcggccgcgaccggataagccgacccggccagccgctccctccgtttttcccccgtgcgcatggtccgcggtgagccgtgaggctgcgcgtgggcccgccgcatccgttcctccgcgaaccgcgcgcgtgcaccgcgtcccagccccgcccgcgtgcgtacgccgcaaactccctccgcacggtgagccgagccgctgacaagcgggtcccacccgggaccgcgcgtagtgagcccggtccaccggactctctctcctctctccaacgcgcgcgcgcgcttgggccgtcttgggccggccggcccgttaagatcggccggtccgctccatttcccttgggccgcgccctagccgcccgagagaagtctacttctcctccctcttccttttcttttccaaaaaggatttaattaaatccttttcctttagatcaaaaattcaataatcttagaaattcaatatcttcccaaccgtaaatccgtttgactccattcaacttccaaatttccccaaatctcgagatctatctaatggcacgcttagaggtcattaatagggctttatttttttgccgtttgttgagttgtcccgtttcgcgtgtagtttcggagccagaagacccgcagtgcgaggatttcgaggatcaagctccagatctcgagcaaggcaagccacctttgaacatcttgagcctatatttgaaatttaattatattgcttgcaaaatattatgcattgataggatcgcactaaatcttttgtcccatctgcaagacagattggcggacttacctaacttgttgcatttgatccttccattgttaattgccatactatgtccccttgtaaccacccagttgcacctcgatattcgtgcactctgtgcaagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgctgagagacatgtggattcgccggggtggtgtcggggaggacccctgggctttctggcacagtatggtctgggacctaacctgttgttggtctgggacccctctcgtcggcatatggtaaacctgtatcggctttcgaaatgccttgtcatgaaagcttggaggtctcccgacgtggctgatccccacggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaatgggttcgatgtttggaaaatcagcagctgacgggatcagctaggcccgggtggccgtttgaaaagttgttggcccgggtggccgtttgaaaagctgttggccgggtgccaaccttgtttcaagatctgaagactgatacattgcacatactccgaccggacgagacgcactgtctcattcgtgtcgtttgagaagcactcacctagttattttagaaaaagagttcaaataaaatcaattgcaaaaacaacagcctttccttgaagcctgcattaaacacttatttcccctggcttgctgagtactcccgtactcacccttgctctatataaataacccccccagttgctgaagaagatgaaccggatcctgc

SEQ ID NO: 39768 - DNA, 1821 bp, Oryza sativa
ggactaaagatagagtatctttagtcccggttggtaacaccaaccaggactaaaaatggatttttactcccggttttttcacccaggactaaagatagcgatctttagtcccggattctccaccagtgaaagttagatggacgtggtcactgacgtgtaggcccataaaggtgggccccacctgtctgcgacccacgtctctctgtctttacgtcagaggagctgtgtcctactaactggtttatccaactggcacatgcacgtgaacacaatagtacagcacaagatatgtgttagaacaccacgaaatgtcatagaacgcaccatgaaattgatgtgatcttagactgttgattgattcgatctactactatttgttacatgtttcatgttgtgaacaacttcaggaataagtattaggaacaggaggcaagctgaagccgacaagctggcggcggggtgactcatgatgatgaaagaaacaaagcatcaaactgaactgaagttaatcatcaggggataaggttgtgccctgtaatctttttttttctgttttattttgtcctataatctgatgctagttaagcatggataattagtattgatgatagattggagggcccctgattagtactgatgcaagagtagtactactgaaagtctgcaacgagttcatcctggacggcagccgtaaaagggtcaatttgtcaaattcaccactccaagcttccaagtattgggtactatagtataagctaccaatctagctaggtaggtagcgttgtgtggtgtggctgaataatcagagtgtttccttttgttttgaagttagcatgaatcattttacggcctattcctggaaacaaacaaaattacaaatacaccctacaaggaaacaagcaataataagataatatggccttttactagtctcctttcctaataaactactataaaataaaaataataaaaataataataataataataataataataataataataatattattattattattattattttgtaatggtttgtctatttggtaatttattggctaagtggttgcctctatattgggcagggttttgcgtaaaggttagactggtactactaagaaaacgatttttttcgtgcggtcgaaaagggttgttgcgtgcggatctcacccctgtctgcacctaagtgtctgcaaaaatccaatttttttgtgccacgcgaaaatgattttcgcgtgcggttgggttatgtcgcccacatggaaaaaaaacccaaaaaaaaaatccaaaccctaaccctagctaccgcccaccgccaccctcctcgccgtcgccgtcgttgtcgacgtgcgccaccatcgtcgtcgtcggtggcggcgtcgccgccttctgccgcgaccggccgccgcagctggctcacaagcccgtcacctctcccaagctcaccgccgctcccggccacgtcgccaccgccaaccgctggatccagccggcgggagaggggcgcgtcctccagatccgggcgggcgagggtcgccgccgctcctggctgccacctgtcagccaccaagcccacacgctgcccgtgagagacgatagacgagagagagaagaaagggaataatgaggataaggatcggtaggtggagaggataagatataaatttttgaagtggttgagagagaaaaattgcctgaggagggagggtattttcgcgtgctatgctcttaagatgcccgtacgtgaaaatacacttgtttttgcgtgcggccttttaagagcctagcccgcgaaattgccctccccccgcaggc

SEQ ID NO: 39769 - DNA, 2858 bp, Oryza sativa
ctcgttgctcgtggccgtgggtggggtgaggacgtcatcaccggtgaaggtagagaggcaaggagggaggtttggggtgggggaagaatatgacaagcgggcccgagggcatttttgaccttttacattgtttatctctcctattgaaccagaaattaatattttattggctgcggtgtcccttggcaaataaccatattttgatagtgtctttccccaaaagtgactttgtgcggtgtcctacagctaaaaccacgaagtcgggatgtcctgtagcaaaatttgccaatttattccgaatttactgcctgatcatttcttgtcagcaaagtttcttgtttgttgaattggacgcatatacaagccaagcaaataaatatcaacatattttttgtttgtttacaaatttgttaccttatatatctatgtaagtagaactacatatggcatcaaaagctacagagttgggattcgaaaatgttcaactacttgctagataaccacaaatccaaccaaacagctccagctggattttgccactggctgggctagatttccagctgcaaacattggtgtttcctggccgtgggaggggacatggaggccttggcgtgcgcttaccggcggtctacaactagttcatccccaacggcagcgatggagtccgctattacccgggttaccccaaagcattagccacttgtctatctgcctctcttgctgcatatagtgaggttgcgaaataatcagagtattcttttgtttggaagattaaatggtttgattcgtaattcaacctacatctggaaacaatgaaatataattaatatatacactaaggactcattgtttcgcttattcgcgaaataagccaaatgatatatttgcaaactgaaaataatttgtaaataaaatttttatatacgtgttctcttagcaatctaaaagctggaaaataaacttcgatgaaaaaaatcctcaaaatcaacttcaaatttaaagttaaaaatcaaattttcgatgataagtataagcataataagcgaataatctgcctcttgttctaatctcttttggtaacacaatactgctaataagaggccacccgattaaaattaggactcaaattatattgaaattctcaggatctcgcgctcacacgctatctagctaagtctgaacctttcaaaaaaaaaaaaacatcagagaaaagacaccaaagaacagaaccaaagagacagttggtgttacggattgtttccagctttccagagatttaatttcttccttttattcatctctgtataggaggttgttacatgcacgattttataggaacaaacaactactgactgtgtcctcccacgatccgattccgcttcaatcttccctagtgaaataaatgagagaaaaccgatgacggaaaccacatgttctgctattttgcagccactatgtgcatgatgggagtccaaagctactaccaaactgatgcaacaattagacatgacaatgcttacaagattacaagcatttgcaacattcttaacattggctcctcatcaaaaccttaagagcccaagttaattaattggcttgcccatatataattaactttatccctctttccatcggcctcatgttgtatctaatttaactgattttgcagtcatttaggaaataccatattttctttttctagtgtaaaacttagtatctcttggtacctctagtactataaggtacaaaatttgtactaataattttggtgtcactagttttatttccattgctccaaccagaaaacaaatcgatacaaaatcaccattccaactttgcacactgcgtgggaaaaaacaacatggttgttgacttcactctcaaataaaagctaaaacagggacttagagccaataaaggaaattactgaagctgttagtacggatgggcagggtggatagtcgaaggctcattccccatgcatcctaatcctatatcgtctacaagagatttcaactcgatgatgaaattgtcatggtatatccttgtacttgtatccatgcagacgatgctcacagctttttatgatcgtcctacactcttgagatgcttctaattcccagtgtatgtgtatatattagctgctccatgattgtagttgctagcagtcagtaaatataacgtacaatggtactgctaccgtccgtaaaacaactcaccagatttaaaacaaaactcaaaatttccactagtaaacaaaacattttcctgtacaaggagcttccattttcctagacggactgttttcgcatgcatctgcaaaaattaaacttctatttcgcatgcggacctttaaaagatccacacacaaaaatcgattttcgcaggcaggtctcttaacggtctgcacgcaaaaataagcatatgttcgcgtgcgggcctcttaagtggaccgcacgcgaaaatttatctccctcttttccctctcacccacttcaaatatttcatcttctctcttccttttcctttttattctctctcaatcactcctctttctctctttcctctatgtgcctttcctctgctctcctctagctcctcccctccccaccgagcacacggggcgtgggaggcgtccggctgccgccgccgctgccgacaaggcggcagccgggagcgggcggcacgacaactgttggcagagacggcgcggcggctacaagcaactcggggggtggcacggtgggcaagtggctggatccgcgctgtgccgacgatgaggaggaaaaggtgcccgggaacggcgacggcggcgggcagtaacggtggcggactcgggagcggtggcggcgcgatca

SEQ ID NO: 39770 - DNA, 15872 bp, Oryza sativa
gaaaaatgcattttgaccacacggaaaaatcttttgtgtactagtggtcatgtttcctgggggggggtgcaagtgtacacaacatccgacgtaaattttttataccaaccgtctatattctttgacactttattttagggtacgtacaatatcaataaataagctggcccataagtctaagctgatatggatgatagagataatgaagagagaagagtggactttccatcaaacatcaactcttagtatgagagaggataagaaaaaaaatagaatagatcagttatttgttagcatgaactatatgggaacacaaatttgttagcatgaactatatatgggaacacaaaccaggcttatatataacagttgagcatggccttatatatacacgagcagtccttcgtgaaaatacatatactttttttagataatggattttcattaatccgatctctatatccacgaaggatataaacagccaatggaattatacatatacttatctcacgcctatattaataagcaaaaggggtgacatctaaggctatatcttttgctttcataacttttgttgtctcataatgtattattttggtcagactttcattcagactaaaatggttgtaatatattcagacttcatcacccctctgtgcctgggtctctgcttctatgatacagtttatggccttcccctttgagtcttctgaccctggtcctactcgtaggatgttcacactgcaactggttgcttatgtctcaccacacatttatgaactgtttgacaatgaatatagatggacaattttgaactgaaacacaagcggagggaaacaggtacacgaattttcgaattaaactaaaaggggtccatattaccatctttattttgcactgcgtgggacacagtaacatgggtgttcacctcaccatctgggataaactcaaaccgaaagagatgtctgaagcaaattaacgaagccgtgagtccgaatggaaagtgcagatagtggaatgttcattcctgatgcatcctaatcctttcgtggaccggtcggtctacaggagattacagcatggtcatgaaagtgtcatcgtacccatgtatctctgttgtagacactcacagccttttatgctctttggtcccaacagtctttagccgattctactttcctcggcatatattaactgctctatgatacttgttgctatcagtcaatcaattatactgcattgcatttcaactggtcagaatcgtgtacaatggttaccaaattaaaaggatagctcgaaatttgacgttttacaatgggcgggggaaatgcacaaaagacgatcgacataacatttaacatcaatcattcaaactttttatgctttcttatctgggtatatacaaaagcaataaataaattatccggtaactctactgattgtggacgagggacagggaggaaagaaaagagtcgaatctcaactaaacatcgattcttggcccatgatacaagaggataaaaattttggagactggatgtttgatgataaaaatttttcgccactttttctgtttttcgaatctgacttttttgttttgtttttcaccatttttaggtgaatcggactatgcttttttttcgctattttttctatgattttttttgtttttcctttttaaggggaatcagacttctttttttttagtttttttcgctatttttttatttgtgacggacgaaggaaacaactttttttccctttttattaggggaatcggactacggttttttttgtcttttcgctactttttctctgattttttttttgtttttcctttttataaggggaatcggatttctttttttatttttttcgctattttttatttgtgacggacgaagaaaacatctcttattttttaagtagtagtagaagtagtagatagatatgcacttgttctcctggtgatgcttactgaataggacttggtataattcaaaccaagtcctattcggcccaaacagaaacaaagtcctaatcagcccaaacagaaacggatgggagtttgtttcattttttttggaatcggacagatacatttttttcccgatttttcttttaccgtgtcgatggaatcggattcgatttggtttgcactttttttttccccggttttttatcagacaaacctggtttttttccccaggtttttttttcgcccttttttttctggatcgaacttctttttttcgtctagttttttatcggacaaacctagttttttctgcttggttttttttcacccggttttttttacggacgatggaagcacctcttcttttttaagtagtagagagtacagaagagatagagatagagatagagaaagagaaacggaaaacattttttcgcaacttttttttttgaatcggacagaaataatgttcacgctttttttttggatggacgacgagattttttttaatcggacagaaatattttatttcactattattcaacttttttacggaagacggaaacccttttgtcgcaccctttttggatcggacagaacaaaattttactttcctatgcatatattaactgctctatgatacttgttgctatcagtcaatcaattatactgcattgcatttcaactggtcagaatcgtgtacaatggttgttgaaacaccgtctgtacaagttaccaaattaaaaggatagctcgaaatttgacgttttacaatgggcgggggaaatgcacaaaagacgatcgacataacatttaacatcaatcattcaaactttttatgctttcatatctgggtatatacaaaagcaataaataaattatccgctaactctactgattgtggacgagggacagggaggaaagaaaagagttaaatctcaactaaacatcgattcttagcccatgatacaagaggataaaaattttggggactgcaataaataaattttttgtttgatgatgtgactcatcctggtggcatcttgggatgttcttttcactaatgtagatataaccttctggatcgttcaattaatttcctgtatatctgatttcactgatttcctgctgatctattaatggtagtatgatactcatcttattagagtcattgatgaaaggtttattaattaattgcaagcttcagacagtgttgtgtactatcaatatatttgtatgtattttcaaattaagtacaataatattaagttgtgacgaacagcatttaactggaacattattcactccgaggatagattgattgcatatcatatcattcagaggaaatctgtaggggaaaagagctgtacacttcatgctcttttctttggaaattgaaatgcatcctgctatttatattgaaagtataataagatataatgcaaccactaaatatgttgacggtagtagtagtgtttccatcattcgtattgcagtgactgaattcaacaatgcttgtatctgctgaatcccagccctatcctcgaccctataggcagtagcttcaaccctcaaactttgtattccactggctgcttctgtatgtattgtttgcaaatgggttgtgctagggctaacatcatcttttgacataacatggaaggactagtttgctagacgaacaaatactaggacagaatcttcattcctgatgcatcctaaccctaacgcgcattggtttttgcatatgaacatagatcatcacagtggaaactgaatcactacaagaaaaccaaaatttcgtgagcgtggaaaacggccaaggaaagactaagtgtcagtgagccaccacgcaaaagcactcacgaatagagcaacaaggaaaacgaactatcttggcggttaaccgccaatgacaatttttttggtggcaaccactaccaaggaaataaggctatcgttaggttcgtgcaccgtcacagatttgaatgaaaccatcaggctaatttattatcaggttggtgttaaccccccaggtttaataatttgcatttttttcgtggtagtgcaaaggacccgacaagagaattctcatttttggcagttcctatttgcctcacataaaaattctagattgctgtagtaaattgactcaactttagaagaatgccacaattaacttgctagtaaatggtagcttttattttgattttagacatttaattgtggtattggaagtaggatactcggtataaatgatagctagcagatcaaaacagggcattatgatgcaattcagtgactagtgaaggcaaggcttatttgcaagcttatctttttaattaaaagttcaatacgggaaatacaatagactctaatgtgcacaaacttcttcaaaagaaacacctacggttcttcccaatgtatacaccgaagttccactaaagtttcagagcatttaattaattacaacaggcattctaatacttattttaagtcactagtactatgatatgaaacaactgtaatataatccaataagtagttagttttgttttcatgtcacatattcctctactgcttgcactcctatgcactcttgatctagtcgtcaatcaaatgaaatgagggctagctagaaccacaccttgatccacaatttccacacatagaaaaacgatccaacagattgcggcgtatatttagtcaacacactcagataattcccaccagacttgagaaatttgtcatgataaactggtagtcttaatcgtcatagcaaaatctttgccaattcaattttatactctagtacgatttaggcggacatttatacaaaataatcaacatgttttaccttggcaccgcccacccagacccaatcccacaaaagaatctaaactagctagctaggatataatagctatagaattcccttaacattctacgttaatgtttacgcaaatccaaaactgccatgttgtctctgacaatgaggtagttttgcaccttggagtattacgtcagtaataatgttcttgttgggtgaacctgatgcgttgcctaggtggggtttgcctcgcacaagtgtcataatgtgcctgacaataaggttgatgtgaactttcaagaaagagaaaagatgtcatgtctcacgttgaggttatgtataagcttagttcccggtacatcctaacccaactactcccccgtaccattttaagtgtgtcaaatatttgaccatccatcttatttaaaaaatttatgaaaaagtttagaaaaataagtcacgcataaagtactattcatattttatcatctaataacaataaaaatattaattataaaaaaaatcaaaaaagatggatggtcaaacattggacactaaaacccacaactatacttaaaatgggacggagggactagatatcacttaaaccaactgttctcctgttctagtattgttgctgtggtggagccaatggagccattgaggctaggttactaacaacatttctagtggttgaccaatttgttttgaagctatctacagggcagacaccatcgtcggagtctgtacggccacccaacaagcccccatttgctccaccactgtgttgctgtgagtatctgtatatacgtgtactgaaaagagcgatggttcccaaacactatggtgtccaccattatatatgaacatggataccataagatcattgaatacccttaatgtgcactccagtaaatgagaatttgcttgctcctttaggactagttactcccatgtgatggtttggtggcaactcttcatcatccgcacgctatctttttgcaccgtgtatattaaggatgtaatatatcatccatatcttcattgtactatagctagttttgtttatatgcatgagtgggaatgtgggttgtgatatatatatgagcatgatgcaatcaagtgtgcctaactttgtaaattcgatttatgctaaactaaatcaccaactttgatttagtctaaactaatcatgttcaagcttgataaggagtttgcaacattcacatgtaaatcgtcaataagaaatcagattcatgatgtggaagatgtatatattcattacaggcagcaaaaaggtgtgatacatatatttttgtaaaccgatcaaaactacgaggtttctctgttgggccaacaaaacaaaataagataaaagtttgactaattttgttttattcgagatgatgtgtaattttgaattacttctgttatattgcctgctatttcttgtctacttgtgtcttttgtctcctgctgttttcctacaacttgcttcttgttccttgtgaataaatagagattagatgtggatccatattttttgctcttggggtaaaaaaagctaaaggtgtgtgctccattttccattttttttatattataccatggagattggattgttgatttcgtcagaagtgtacagaaccaattatcaattaactggctacagttcgtcatataaaacaagagttgtcggttgaacggcggatggatcagaagaaaccaatggcaatctgtctttctcatcaaacttttcccaattcatcctaatcctattgtgtactggtctacaagatatttcagaatgatcatgctttttatgctctttagtcctgtgtaatctttagcgggttttaggtagttcattaaaaccagacctctacatccaacacacatgtacatggccaaaacttagcagcttctaatttactatggttgtgtgggagtagatagaacttacaacttgagatactaaaaaacaagaggagatgtgtgcacgcctctaacagaggtagggttccatttatatatatagtgcgctgactaggatcagcgccttcttcttagcctattaattaaggggaatagccatggttggaaggccagctgattaggggcctacctctactaggatgggacactcccatttcgccccggagagccacatggatgcattaggccacctggattcaggggcatgaatctgtaggtggtgacactaaatctagttggtatgaagtgcggccatttagactggccttgtccaccctcctctttaaatggttcatattgcccttcaaccgactaaggggcttcaatggttggcccttgtaggttcctccctccaagaaccacaacaacgaaggcggaggtttctcacttatcctactttgtttcctcccttcgggccctagacatgtccatgaggatccaattcacaccctccgtagctcagggtgtcccatcaaagccttattggtttggtcgaggttggggcatatatatattcactgctctataatgttagctcgctagcagtcattcagtttgttgcgttgcgtatcagcggttaagtcaagttcaatgttttgaaagcaaccatctctatagtccaaattgaataaagaactccaaatttcacatgtacaaggggctgaatgatatccacaaatgccagcataatgtttaatatcaatcatctagactttttaattatccctatatatattaggtatgtacaacaacaaaaatgaactggcccatagcttcgctaagtagggaagagagaaaagcattgactatccactaaacatcaactcttagcaaaagattcaacagaacagaaaatcagggaaagtattaatgatcatagtcattatgttgtatgacaaatttatagatcagttaaggaggtcaaactaggctcaacagttgaacttgaccttatgcccaagtcgttccttcgtgcaattccatatcatttctttctcatccatgtttgcacaaaatgacgaggaactagatcctgatcttttggtagttactgcataggtcgattatgaagacttgacgttgatgatccaaaaacaatcgaacccctcgcaatcatcacttctcttttggttatcaactaggccgaaacacgattgacctcacaggttggggctccacaaaactgaactaagcagcgaaactgcaattgcagattaatctaaataaaacccaaccctaactcgatgacggctaacgattatatggttactagggtcggcgacccccctggacgcatccctaatattctccaacacgatacatagtccaatgcgtcaaaagacggtgatgtagcacccaggctgattctggatgcccacttgtttcgatgattcctagacttagaaagaattttggcattacactagatgtgttggaaaggtcatcttgttagcttttaatttcaagcatatgtagaacgtcgaaaatgaaatccaattgagatctgagcgacgattttagtacggactccttctggattctgaggtgaacttgaacttgatatgaattgagcatccatctcctagcctctctgcaagtgcttgctacctctccctcatgtgtatccaaaggagtgatgagctcatcacaaaaggtgctatgagtaatgccttgttaaggttgtacctgccccgtccctgtagcaagcattacatcagaattgtgtcctgtaaatgtataaatctctatcgtattttcgaaactaaacctgtagcattaagtggcgagtggaaatctccagcctctttttacattataggcaattgattacttataattttttacaggaaagttcaaccttacatcatattgaagaagaaataactggatgaaatatgtatagagtggaatagtaagtatgaaattctgaagtcacacttctctgtaacgtgacagtaggacaagcaatccattatgccctttttttccagcaccctatcaaacgtacatacagagatcattctaatccacctttataccaaatctaatctcgatcagttttccaccttatgaaatatttgttctagacatctatcagttttcaaagtggtacaatttaatccaagcaccctctccatgcattccaaacaagatagaaagaaagagctcgaagaaatgcaaccccaaacacctagatttgcatggacagctagccaagattatggcctaaagcctaatgatggcacaaagatgcagcagatgcttttcattaagctacggccccagcttgctttcatcttttggcagaagttgcactagatgtggcggatcagaattggcaggttggatggcctagctctatggcctggttgataactggtgtctggacagtagctgctcgtccataatgcctacaaccttgtacacaagctccaggggttactgataccagaaccctcactactaccctttctcaatcttgagttttgaccatggtgtgctccgtcaaacatggatggaacctgggccagcatgagatcaagagaaacagaagtcaggtttaggactgaggatatgcataagcttggttcccagtacctcctatccctacaagctcactcaaatggactgatctcttgctgatctagttgttgcgagatatatttgtatgcgttctgaaaaaaagcatgagcaggcatggctttgaaacactatggcgtccatttatatggaaatggacttcttatggtccaagactgcttttaatgtgcatttcagtacatgagagtttgattgcacctttagggtcgtatcttcattgtattgaagaagaaataactggatgaaatatgtattgagtgtggaaaagaatctgaagtcacacttcttcgtaacatgacagtaggagaagtataccattaattatgccctttttttggagcgccatatcagacttacgtacagatcgagatcattctaatccacctttacgcctaatctaatcttgatcagttttccaccttatcaaatatttgatccagacatctatcagttttcaaagtggtatattaatataatttaaaccaagcacccttagctcagctccatgcacattctaaacaagacagaaggaaaaagctcaaagaaatgcaatgccaaacacctagatttgcatggacagcaagccaagattgtggcctaaagcttcatgatggcgcaaagatacattggagaattttcgtcaagctacggccccagcttgccttcatcttttagcagaaggtgcaatagacgttctggagcattttggcagaggttggaagacctagctctatgcctctttggcttggttcataactggtgtctggatgattaccacgttgtacccaagctccaggggttactggttgcagaacccttactactactgtatagcattgccagtttccaatcttgaatatggtttaggaaccttggccagcatgagatcaagagaaaaagaggtcaggttttggactgaggatatgaataaacttggttcccagaacctcctaaccccacaacctcactcaaaccgactgatctctggttcatcgcgttgttgcgagatatttgtatgcgtacgtacgttctgaaaaaatggatgaacatgcatggtttcgaaacactatggtgtccacgtatatggaattcatagacatctttaaaggtccaatatatactgcattttagtgcacctttaggagtagttcctcccatttgatggttgatggtttggtagaaaaacccttcatcaataccgttttgcactatacatattgtaatcgatcgtacgtatcttcattacttgcagtatagttagttttattttgtatgattcggaatgagggctgtggtatatatgtgtctaagataaaacgctgctgcggttcaagcttaatatatgtgattgtgagacattcacctagaaatcgtcagtacgatatcagattcatgatgtggaggatatatatttattatatgcaaggaaaggtacgttcagtacctcctaagcactgtaaaggcacttttctgacaaacagatagaaaattttaataatcgcgaacaatcagcatgcacgagctagctacgtaccattgtgagataattgtatatctaccatcgcaaatgaataaaatttgctgaaatatcacgagcgacaaaaaaatactagtcttaactaggacgtgtttcttggaataccatcttggaccattttaatcctgggcttcttaggctgtcttcaccgttaggtgttcccaaccggaatagtaaatacggaaaacggaacgatccattaatggattaatttgttttttaagcaacttttgtatacaaattttttttaaaaaaaacaccgtttagcggtttgaaaagcgtgcgtgtgaaaaacgagggagaggggttgggaaaaaggggtgccgaacaaacccttagtcatccctccgacaaatctgttattttgttatggtggatatgcaattttctcataccattgtcaagcaagggacctgacatggatataatcgatcaccatcatatgcaacatattaattaacaacatgggctacctgaaagtggccataatccgtatggagaaaacattggttaaaatagtttgatatatattactcaaatgtgaccagggagagcttgctataagggagagcttaaataatcaaatataaatggttcaggagatatcttgaaattatatatatctggtaatggccagcttgggtagggaccagacaacccagctggcccaccctgattttaccatattgggctgggctggacaatcatgaagatatttttctctaataataattttggaccaacccataccaagaaattttttatgcaataaattttgcctttgtttaaattataagttccagtaaaaaaattcaaggttattgcattacccagatatggtaaaagctcccgtgtgctaacaaatgttaccgtgcgtatgtgatcacactcagtaatgtcccaaatgataccgggtgtttgttctgacacccggtaacataggagcataccgtgcgctgcagttgcacacacggtaacatagaaatataacgggtgcattcgtacacggtataaaatagtgttcccgcgtgttgtgggacgcacggtatggtacataatattcccatgcgcttttgtctattcctcaccggaaatgtgctcggtaaagtgatgaagccgttgagtgtacgttgtgggtaggggtgaaaacgggacgggtatttcccgcccgactgcccgaccgtattaatttgggacaaattcgggtcagaaattcgggtacccgaaattttatatggatatagggttcgaatacgggttatttttggtggatatgggatcggattcgggagcgcagtatccgacggatacggattatccagtaaaaaatacggatactacccgaatatatatacggatagtacccgtattacgtagtctgtacaaccagccaaccagatttgaggcaagctagccaaaaagccaacaaccaggcccaaaactcaccggcccaatagtattgctaacccgaggaaataggagagagatgaggagaccgagtggagtgattgttcgtctgttcctattcctgggcggcggcggctcctggctcctgccgtcacgggctcttggcgacggcgtctcctcctggctcctgccgcggccgcgcccttgcgacggctgccagcggcgccacccgcgccggcggcgccggctcccacggtgctcgtcaccaccgctgctgcacggcctgcgtcggtcgccatctccgtcgtgccgtcctgccgtgtgcaggcctgccgtgacagccgtgtgcgccggtcgtcgtctcctactgatgatttgagtgtcttgtccttaaatatggtttacgtgaaatggtttatgtttcctagttggctcaagactcttgtgaaatggtgatgtttcctggttggcatctggcaagacatgtttctgagtattatggtattatgtactggagtactatgtggctgtgagcctgtgactgtaatgactataagtctccgttatgaagaattggtgatattttggcatgtggctgtgactgacgtactgtactacttttagcttgtggctgtgagcctgtcacgtactgtactacggtgtcttgtttcctaagccctaatgacctaatataatcgcattatggatatagatttgttgaatggttattgtctatatggtatttatgattgtttcttcgacttgatatccgaataagtatttataaccgagagtgtacgtatccatttgggtacgtattcggtccatatttttgcccgatattatccgaacttatatccgtattcgacgctatccgtgtctgacccgattccgattatacaatgtgggttaggatatgagaagtgtgagatccgacccaacccgacccgatttcacccctagttgtggggagagaataccttgtccattgaccacagtcacaaaaaaaaaaaaaaaaaaaaaactacatcaatttgaggatcctctttatactctatatattgttcacaactccttcaaaacaggtcacctatctcagaatattgcgagcagctgaaatgctagcgcacaccagtacaagctcagtcgtgtgtggcacagcgatcacaaagcatttagctacctgtgttcagcttctgatttcaagttctaggttgggcaatcaggataatgatgaccagggtacgtatcaaagcctcttcgctccgccatgaatgatgatcaagttctctctctcagggtgtgtttagttcacgctaaaattggatgtttggttgaaattggaacgatgtgacggaaaagttgaaaatttatgtgtgtaggaaggttttgatgtgatgaaaaagttgaaagtttgataagaaaagtttacaactaaacacggtgtcagttacaaacaggcgttgttcctccagaaatcaaaagtccagcttgtttgaatggaagcaagcagaaaacatgtatcttcagtcagcgcgctcaggataattcccaccgggtcctgagaaatttgacatggtaaagtggtacgcctagccgtagcaaaatgtttgatctgaacaatgaaggaagggaacagaggccacgtctcacgcagacatcaagcacaagcttggttcccagtacctcctaaccctacaagagctcacttaaaccgactgctctctggttctacctgtcgttgcagcggtggagccagtggtgccgttgaacccgagcgactaacaacgtttttcggtggtcggccaattttttgtttttagacatgttgacatttatctgtagtggagaaatcagaggcggagtccgggcagccacccaatcagcctaggagctggctccgccgctgtgttattgtgagtatctgcatatatgtgcgctaaaaagaggatgattcccgagcactgtggtgtccacgtgtatatatggatatggacaccttaagatcattgactgcccttaatgtcagttcagtctatgtgggttaattctaaaaaaaaaaaaaactctatgagggtttggctgcttctttacaagtagttcctcccatactatggtttggtggctacccttcattatctacgtgctattttttttactatgtattttaaggttgtatgtaacttatcaaatataactttttttactatagctagttttgtttatatgcacgattgggaaaggtgtgatacatatatttttgtaaacagatcgaaactacaaggtttctctattgggtcaagaaaacaaattaagagaaaactttgtctaattttattttattcgacaagaagtaacaatccttttccgatgatgcctaattttgagttatttctattatattccctgctatttattgtctacttgtgcattttatctcatgctgttttccaactgctagcttcttgttcctcatgaataaatagagattagatgtgaatctttattctttgctgttggggtcaaaaagcataaggtgcgtggtccattttccgtttgctattttaccttgaagattggattgttggtttcttctggagtggaaacaactgattctttcaattaattggctaccagttgctcaataaggcagtggaacaagagttgttggttgaacggcagatggaccagatgaaaccaatgacaatctttatctttgtcctcaaaggcagagaatagagacgcgtggtaacacacatgtctttatctttatcttagataatgaattaaaaccgggtctctacgacatctaacacacgtgttgactggtaactcagaacagtggctcactagagcgcttgcaatagcactctggaacactattgccaattcagcaagattcagaagagagcagagtaagcagagaaaactagtgatgctcagagaactcgagacacagtttgtgccgctcaaatactgccgcaacttttctggttttttcctttctcttactccctccatcctaaaatataagtatttttaggaatgaatctggatatattttgggacggaggtggtattatatatgcaaggactacaactaaaacaccccgatttctttgccacgatctgatctgtacgcatgcaccatcccacgtccacgcaaatgaatgcgatctaccaaagtttatgcaatgactgggcacgacgaggacatagtaagtctctgcccaaagcaatcctaagtgaaggcctaacaaccttaagatcgtgcacataaaggtttgactgaaaaacaaacatgtcatacagctaactgaaaaaaaaatgcagtttgcacaagctttactccaataacatatacacggcaaaaatatagctgcatctagtgtcctaatattttgttaggacaatataattgcccctaataactaagtatgtctgtgagggtaaacggaacgaacaacttgagataatagaaaacaagaggagatgtcccctcaaagcccatcagcgcctctaac

SEQ ID NO: 39771 - DNA, 787 bp, Oryza sativa
gtgcgccatccgcccgcggcccgtcacaggtatcccctcacctgtgacgggccgaaaggaaaacccgtcagaggtataccagtgacgagttttgcttccaacccgtcactggtatcccctcacctgtgacgggccgatacattagaagccgtcagaggtgatgggccgccacctgtgacggctttcatttctggcccgtcacaggtaagcggataccagtgacgggcagttggcagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaaggtacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatga

SEQ ID NO: 39772 - DNA, 979 bp, Oryza sativa
cgccctcgctacggtcaacccatgcaataccatcagtcggtcactcaggctaaccgccagccaggtacgcccttcgtcctcagataaaccgtccggcacctccgccacagcagcgtgcccctagtggcaatacagcgcctaacagtgttacctctttcaagtcaccgcagggaccatcagcagttcagtgtttccggtgcaaccagatgggtcactatgctagacagtgtcctcagaatcctaccaacaccaactcagggcatgctaatggcagcaccgccagaactcctactccagcggcagctcagtctcgtcctagctctcaggcaagtggacaaggttctcgtgcttccaaccactttggtcgaggacgtgtgaatcacattcaagctgaaaccgctcaggatgctccagacgttgtgatgggtatgttctctgtcaactccgtacccgcaatagtcctgtttgattcgggagcttcccattccttcatatcgcaagcttttgtgaaaagaaatggttggaaaacccaaaatttgcgtgtaccaatgatagtacattcctctggaaggaatataagggcaactcaaatatgcccggaagttaaccttagaattgaggaagttgacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacccctaacaaccctaccgcaagtcggtccatcctaacctgtttacaagtcacctccttggagtcggtgcccatagtctgtgaatatcccgacgtatttccggaagaattaacaagaatgccaccagaccgagagatcgagttcgccatagaactggcaccaggcacagctccaattgcaaaaagaccctaccgaatggcagctaa

SEQ ID NO: 39773 - DNA, 2441 bp, Oryza sativa
aaatggaatattgcagcaagattaaaatgttgaatttaagatggtgacaagaggataatcatttgtgaatcatgtacctcatgataatgcttctaagtgtccatgaatcatcgatgaaatgggctgtgatagccatgtagcctcttttttgattatcagaggtccacaagtcagtagtaatacccactctagacttagctccagccatatatgctaatgcccttttcttttcttcctcatatgtatccataatgtccttcctatattcaaacattaatcaataaactcactaactaatcaaatttcagaaatgcaaaaccagcaaataaataatagatgaactgaaattacctaatagtgttccgagtcaccatcttgaataatggctgaagtgcactaacaaatcttcgaaagccaatatggtcaacaatagataaaggatactcatgtaatattatcatggcagcaagctctctcctagccactgctggatcaaatgtgtatgtgtccacagaaactttccctccctctatggaattgaacctcaatgaagattgtgcaagtgtctttggccccatcttgatctttctcaatgtgcaaattttcaaatggtcatgtagatgtgaagtcccattgctgctcttccctccaagccgcttgtggcaatgaaggcattcagccttgacatcaccacagactttgactttcttgaaatccttccaaacaacagaagtaagcttcctctttgtgccaaaattctcagaatcatcttctggctcatcatcttcaacttgtattggctcagaatcattaacagactctgcttgtggtggaagtgactgcgattcttgctggctgctactcccacaaccagtaccagcagttgaattcgtggtaaatctgacaaatgacaaataaatatagatcaatatatctttcagcctatagaataatcttggcaaacttgaaatgaagaatctctacacataaatcatactgaaatctgctacagcctatagaataataaatttcttatgatctacactacacaaaatcggattcctttaatttcaaaaacttaagttcataacatatttataacttaacaacattcaatgtacaaccatacaatatacatgtaaagatatctaattttctacagatactctaaatacaacattcaatatctaagaaaatcaagcaagctgcaaattaataaattgcacatgctaaattgttaggaacttaggattacgaaagtgaagctacaatgtataaagggttagcgtgaaatcgaaccccatggatttgaataagcgcaggccgttggcggaagatgaagcttctggagttcttggagcagaaggagctcctgccttagtcgaagcataaggtgctcctgcaatcgcaagacggctttttgacctagtggtggtcctttttataggtggttgcggcggccgacagcaggcctttgcaccggagttggaggaaccagatctgcccacatgaacaatggcagatccagcaacaggcacgacagcgggtgtggctgcagctgcagcgcttatagcatgcgatggctggtccaactccgcattggcgtcccttattgtggaccgccgaacgtgagttagtgactcaacgagacaatgatgcagccatggaagaggaatttagtggagggggagggggatatggtactataggtaggcgtctagggaggggtactgagttgggagtaggacagctagatgtgctcaccttgcatcgtcgtcggagcttagcggtggtgaaggcgaagccatggcggactcgagcggctggtcgtcgtgtggactcgtcgttttcccctttcttgccaccgaagccttcacctgcatccaccatgagcaaaacaaataagcctacatgacggatcagatattgacggagggtggacgaggaggccgacgtccggtggccggtgccgagtccacggcgtcctcggacctgggaggctgggagtgaagggaacgggacggcgctggggcggacgccggcacggcgggcgcggcggcccggcactggcgcggacgccggcacggcgggcgcggcggccctgagcgcacggacgcctgcacgcgcgggcgcgggcgcgagatcgggagccggcgccgctcagtcgctgtggccgacggacggcggcgtggactggggaatggggacggaggggataagggctggcgggcgcggcggcccggcgcgggcgcgggacgccggcacggcgggcgcggcggccctgagcgcacggacgcctgcacgcgcgggcgcgggcgcgagatcgggagccggcgccgctcagtcgctgtggccgacggacggcggcgtggactggggaatggggacggaggggataagggccggcgggcgcggtggcccggcgcgggcgcgggtgcgga

SEQ ID NO: 39774 - DNA, 3501 bp, Oryza sativa
ccttgtcttcccaacaagatcaagatagtaggactccaggagcacagcatgacagctgacaaactagttatcctttcattcatcttcaaatgatcagttgacccaaacaaccgataaaatgcagatattgctaatgataaacctccaatagtgtatacaaggcgaggagctaaacttattccagtctctctagtagctttagtatgagagagcaaagtactttcagaagcccaatgaattgctataaatatataactcaagatgcttccagacataacagagtacttcaagaatctatgactgatcgcataggatatgcacttcaaaattatataggccactaaggtaagagatatgatggggaatatttccatgagatcactgcaaaaacttgaaccaaacaggccacaaataatgctgactgggtggtcatttgaaattattgacccagaaatttgttttgacatcccaaactcaatcccaaatcgtatgaaaatattaaggaggagaaaaacaaactcctgcgaataaatagagtaaaagtagatcagaagttgactatacataataatagaataaaactgaggtcaacacagggaaattgggagcattaattgtgataagaatattaacttctatgatgaattttccttttgtggctgagtgccacacactggcaatgcaactcgtggccaaaagaaagtttgcaactctaccttctgccactgcatcacaagaaatagatgcatgaataagcaggtgcaccaaataaatttataatatttgatgaggttggtatatctgacaaactcacatatatagctattggataggaaacttgctgcccgaattgcaaccaatgcaaaagcaaagaaatttttcggaatgaaacttgaacttgctctttccttttctgaaatttgatcaatattcaacttcacaagcatacatgcctgagtactaactgacagtatcataactgaaagaccaatgcccatcagccataaatcaaactcagtccatgcagagcgagcaagctttgcaaagctctccaagaagtcagagtatgcatcaatttgcaaccgcagagctgaacttgtgcattccttatttgcgcactcctttaattcatcctgactgcttgtttccactggacatgtagacctcaggacagaggaccaatttgcctgagcttttgaatacagatctgcaacatggttcaggtcttctgctcgaaatccaataacagaagtggcagaatatcgatcaatgtacctctttacctatgagggttaactgaaaatcagcgtagagcttcagcaatccacccaaccaaacaaatacaaatgaactttcatattacctgccaacaatttatacagagagcttcagcatatctccgcatccatgcttctagatcattctgctgtgtacaatcattggcaccgatctgtggattatcccatgttccaacactcagagcatacaattcttgggttaacaccttccaatgctagatttggcacattagaccacatttcgtaaagatactgaattaagtactacaactatggaaggatgtagggacaatagcaattgaaaaataaaatcaagtcgaatcagtatatataatgaaaaaaaaaagcaactagatagtgtctctagtcaaaccagatagtagcacacactgcaaacaacaaaaacaagcaagtaccaagtaaagcgtacacaccttccaaaaggaaaaggtataccaagtagcgctgctatagttactgcaaaatcaagctaagaacaaggagaaaaattaagcaatattgatcatataagccatcaacataaaagaatgcagttagcactgacctgctgcatagtgctgacgcacacctctttaccatgctagaaaagaaataaacgtgtgattagtaggcacattactacagtcacaaataaaagcaagcaaaatctggctaaacaaaatgtactacgattaacatgtatcttggccaaaaactgtattacatcaatcactgcttatttcaaatttacattcctaaaatctacaggccctcattcccactcttttcattaaaaaacgctgcatgcagtacttcatagccatgcataacacagtcagagtagagtttaaaatagtcaatcactttgccctacggttttagatgtcaaaccaaatatacaacagtaaggcattcaatatggaagcaagggattagaaaaatatcttctgtacgcaattctagtttaagtgttctagacaaaaaaaatgtaactcaggttataatatggccaatgaatattaattataattgtttgaaaacttagtcctgatcataacattatcgccatacatggcaagatagctcaaatcataattagttagcagaacatataggataagaaaatgtaccagatcagcgttgcataaatttttaccaagaacagacaagacagcatttggtggggtcttcggactccatgcaaagagcgatgtttcaacctataatagtaacagcattagttatgtagacatgattaccatttagtgttcctcttcagcatttagcaacaaaacataagatagatcacctcttcagcagttcctccaccatgatcaccatttagtgtttggccatgatcccccattacaagaagtaaagtattctcatggggaccacccgatgttgatagacttttcaatgtgtcaattacatcctgtatgagttaaatatagcagcatttgattatcatagttaatatggccatcatatgggaataaagaacataatgaggtcaaatttaaaagaatgataagcaggtaagcataaagccacattatatatttgtgcgtgaggtgactgacctctacgatccgattgtattgctccaacttctggatcattggggtagagtcaacaccgaatatatgccctgcatggtcctaaaggaagttgatctcacatgttctttattcaaaacggacaggataaaaggattaaatttttaagctaaggcataagagaatgcacaataacttaccacgccaaggaaatgtgcaataagaacgtcccaatcatttttgtgtaatgatggaagcaagtgctcaataacaccattgtctacctgatatatacgataaatacaattactggtaatttcatggaaaatttatgggaggaaaaaaactcgcactgcagaacaaggaaaagaatggtacaaaagatatgacatactgtgtcaagatctttaacgttaaaagaagggtaaggatatgacttgttgaaatgttcagggtataactggatccaagtatcgtctcccatcatgacgaccctctttccatttttggcaaactgattgagtacaaagaaacaataggcaacacatacttccacggttagttatccagaataaactgagtaagtttactgacaccatatttgtaatgttagatgcaagatgagattgtgacaagaacctgat

SEQ ID NO: 39775 - DNA, 3279 bp, Oryza sativa
aggtaggtctaaggtagtgctagtttggcagcattacacatcagcgatcgtcacttcgacctcgacaccaggctcgatggtgatggaggtgatctgcttcacaacatctggggagctgatgagatcgatcacccgcttgtggatgcggaactcgaaacgatcccatgtgtttgttcctggtcagaaaagaacgcaaaatagtcctgaattagcacaagaaaacccaaccaatgtgaagttaagccaacaagatgtcagcaaatttccctagcttaagcaactagcatccaaagtggtttcatctaacaaagagcgtccagtttaactgttgcaagcataaactgacctgaagatatattgatgaaagataagcatgaaagtaaaaaaactgtcaatcatcagaacaatatgctacaactacatgagcataggtaaacaggggtacaggatgattggcacacaaaaaggatatacattacaagttaaacatatcatgtactttgtccaattaacaaatcaatgaattcacataataataaatcccatgaaacaaactcacatgtccacttaaatgggcgtaaagtttgatcctttagtttagtgatgtctttttgcaaccaagtctcttgcgcaatgcaggcttcgagcctatggttgctataatagtgggaagagcactaatcttgtttatcaatggattccttctctaatactacctccatttataaatatatgacaccgttgacttttaaatctacgtttgaccactcgtcttactcaaaaaagttatacaggtatcattaattttgccatgacttgttttatcatcaaatataccttaagcctcacttatatttttatatttgctcgattttttgaataagacgaattgtcaacatatatctaaaagtcaacagcgtcatacatttaaaaacagagggagtacaatactacatccatcccaaggtgtaactatatctagctatgaatctagacaagttcatatccagattcaaagccaaagagagctacattttgggcaggaggttttactacactgcgacctttgtaggttaggagccaaaaagataaatagtaaccagaggagtaacaaactatgatactccctccgtcccaaaataaacaaacctagtacaggactaggaagtgccacatccccgtactagctttgtttattttgggacagagggagtacctagcaagctacgagactagccagtagtttcttgtgccactggtactcgatcccataacagttatcactagtccataacaaaccttaaatttaaaagtagcattgctattattaccaatcatactaaactatcaggatacaagagggccagcccacaaacccacttataggccatttaagtgcaccaacctatggtttacccacttgaatagcccataaatgggttcaaaagccagcccacttgcattccaatagaataccaacatatgtgccttccaaatccctgctaaacaaaatcttactaaaccttcttgacttcagaacttggcttggctatctttaaaattatgacatgtggagaataataacactaaaattgaagaaacgtctgtatattctgcccccttaatatgagactgtgggggtaacggcaagttttctgagcttgcctctagatcattcccttatctagaagtgaataacataggaatatcctagtttgttgtagcttgacagtgtccatcgcttgctatcccgctgcccatccatctccatgcatgaaatggttgggtgatgaaatggttgggtcgacaaagaacaggtaaaccaaacttattcaccacaaacctccaatagtaacccttctactcaacttgctataccatgtgctttcactcgaaaacttaaacattcatccttcattacattttggtggaacttgttgctggtagtctttattgcagattttagatagccgaaagtcactataagaacatggccatacaacaataacacttagtgaagtactctaactaaggcaaatttcaacaaagagattgcctgaaaaatcaaatagttttgactaaatgattccaatggtcacacaatccacactagtcaccaaccaagagcactaatttagaccaggatctagcttaaccaagcatctatacactggcatctatacagtggcatctgtctccaccaatccatttcctaaccacctaaaccaaagctatacccatgagtcgaaacataccacaaaaacaaatggattcaaacccaatcaagcattgcaattagaggtggctgcaactggtcaataccttcaccgcacggcgacttgcgggtggtgatgtggagcaccttggtggggatcctgacggggcccttgacgcgcagctgcttgtccttggcgcccttcaccagatcagcgcaaactgcaaccataaacacacgaatcagcttcgcgctctcagcaaaaaaaaatccgatctaatctaatcctctctgaacgacaacgaactgaaactatagaagaaaaagagaaagaatggattacccttctcgaggttcttgacgttcttggaggagagggtgatgcggatgcggttgagctgcagctcccgcgcctcctccatgccgagcttcccgcccttcatcgcgccgccggcgccgtacaccgcagccgccgccatgtttgcttcgcctcgcctcgcgttctccgctccgctcgctcggggggtggggttggtggtgctcggggatggcggcgcgggtggcgttagggtttcggagggggcggaggttcgctcggaagggccatttatataggagatgatatgggctcggcccaactctaactaacctctgaatgggctgtctctcagactctcactctctcttcttttggctgtctgaaattggaaaagtgtatggtttttttagggtaatatatgatatatatttttttgaggtgcaacataatcaaagattcaaagtggccatcttttatgcttttgtaggattttattagtttattgtcaggttattctctaggaatatttgtttataaaggatatagaacaagaatagattaataaaagggattttagattagtagtacgcaatgctagaaagtcttataacctgaaacaaaggtagtacttgtcgatgacatggggccgagggtatcatgactagaggtttgggtagccgcggtcacccttgggtcgggcctgagggtgacgagacctccccgccttttatctccccgaggggtc

SEQ ID NO: 39776 - DNA, 12741 bp, Oryza sativa
agagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccatgtctcgtgcattgcctctctcgcgaatattccacagaccgagggcttagaacctcacttagcgccccccgccgaaccggcaaaggggggcctgcgcggtctctcggtgaggagccccacgctccgtcatctggcgcgccatgtagggggcgcgtgtgtttttctaagctctcatcctctttcgtgtgcgccaagcttctcccgttcaacccaatggccgaacgagcaaaagcgcacaacctctctctgagtgctagcggtgacgacggggagcagaacccgcgccgtcgagctcgtactccaccgcccccctctcgccgaagtcttaggcgggaggaggcgctcgagggggtcgaaagatccgcaactttgccgcccacgagcgatggagaaggacggcgagacggagagcgtcgcctcctcgtctacggcgatggcagcacgccccagggcgtgctccaagctgcgggcgcgctcttgcgtcacccgcccgtcgtccccgatccagagactctagcccgacgttggttggatgacgtggccgacttggtcatgacggcgcagcagcgcctaggtgccggtgggcggtcttccgccaccaaggcctctggcgctgctaccgccggctccgtgtcgtcgaggtggagggcgcggcgagcggcggctgttacccgccgttcgtctgccattctctcgtcaacgcctccgacccaggaagatgtgcgtggggggccggatgcccgcctcggtttcgagcgtcggcgcaatggtcgtcgtgctgcccacgcaacggagggcgcctcctcgtccggagcgccacttcagtacgggcgcgggggccagccctccgtgcccccggttggtggtgttggctgtagagcctttgtggcgagccttcgaaacgtccgttggcccccaaggttccggcccaccatcgccgaaaaatatgacggaagcgtcaaccccgccgagtttctccaggtctacacgaccgggatcgaggacgccgggggtgacgacagggtcatggcgaatttctttcccatggccctgaagggacaggcgcggggttggctaatgaacttgccacccgcgtcggtccactcttgggaggatttgtgccagcagttcaccatgaacttccaaggcacatatcagcgcccaggtgaagaagcggacttgcacgcggtacagcgaagggatgatgagtcacttcgctcgtacattcagcggttctgtcaagtccgcaacaccataccatgcatccctgcacacgtggtgatctacgcgttcaggggggcgtgcggcacaaccgcatgctcgaaaagatcgcctccaaggagccccagactaccgcggagctttttcagctcgcggaccgagtggctcgcaaggaggaggcctggacctggaactcctccggttccggtgtggcagcttcggccgcccccgggtccgctgctcggtcagggcggcgggacaggaggaggaagaagaggtcggcccattccgacgacgagggtcatgtcctcgccgtcgagggtgcttcgcgggccacccgaaaggggaggcctgcgagcgacaaaaagaaggaggccggcgctcccagcagggagcgcccgactggcaagtggtgcaccgtgcacaacacctccctccacgacctcgcggactgccgcgcggtcaaaagtttggctgagcggacgaggaagtgggaagaggagaggaggcaggagcgccgtgagggcaaggccccggcggctccctccggcaaccggcgaagtgaggccaagcaaaagggacccaccgaggacatcgacgatggcgacctggggccaccatcgccaccgtcgatgggggagcgtgcactcacgcttctcgccggagcctcaaggccatgaagcgagagcttttggccgctgcccctacccatgaggcgacgcggcgggcacgatggtcggaggttaccctcaccttcgaccagaccgaccacccgccgtgcgttgcccggggagggcagatcgcgatggtggtttcccccaccatttgcaatgtgaagttggggcgagtcctcatagatgggggcgcagccctcaatatcctttcccccgcggccttcgacgccatcaaggtcccggggatggtgctccgaccgtcccagccgatcatcggtgtgacgccggggcacacttggccgctaggtcatatcgacctcccggtcactttcggtggttccgccaacttccgcacggagcgggtgagcttcgatgtggcggacctcagtctgccctacaacgcggtcctggggaggcccgcgttggtgaagttcatggtggcggtccactatgcctacctccagatgaagatgccgggccccggtggccccatcaccgtccatggcgacctcaaagtcgcgcttgcttgtatggagcagcgcgcggaccacctcgccgcggcgtccaagcccgcgggcagcgacgagaggcttagaccctccgtcccagccgccccgaggcagcggatgatcacgtacgacaaggtcccggtcaaggaggttgccctgggcgacggcccgtccaagaccactcgaatcggtgatcttctggacgacaaataggaagacgcgctcgtctccttcctgcgggcaaacgccgacgtcttcgcatggagaccggcggacatgcccggggtccccagggaggtgattgagcaccgtctcgccgtgcggccggacgcaaggccggttcggcagaaagtgcggcggcaggccccggaacgtcaagccttcatctgcgaggaggtggcgcgacttctggaggccggatttatccgagaggtcatccatccggagtggctggcgaacccggtcgtcgttcccaagtcgaacggcaagcttcggatgtgcatcgactacactgaccttaacaagacatgtcctaaggacccttacccccttccacgcatagatcagattgtcgactccactgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaagacgcacaaccaagagaccttactcttggatttagcggaaactttcgaaagtctccgctccgctcgcataaagctgaaccccgacaaatgcgtgttcggcgtgcctgcgggtaagcttctcgggttcttggtctctgcccgaggcatcgaggccaacctcgagaagatacgagctatagagcggatgcgccccccagccagcttagggatgtgcaatgcatcaccggctgcatggccgccctaagtcggttcatatcgaggctgggagagaaggcgctactcctatttaagctcctcaaacgctccaggccgtttacctggacagaggaggctgagcgggccttcactcagttgaaggattacctcagttctcccccgatcctggtcgccccggaaccagatgagccgctgctactctacctcgcggcaaccccgcaggtggtcagcgcagcgttggtcgtggagcgcgacgaggacaaccctcacttcgcgcgtccccaccctgtgtcgactcgacccgggagagagcagggaggagaggcccccgagtcgaacggcggcccgaggcccccgacggccggagctggccctccgcccgcttgtccgacggtgccaggcgcccccgacccccaggatggcctcggggccactgcgggaaggccgcgcctgtcgccctctgaccccgaggtcatcggcgcagaagccaagtgcgccccgtgcggcctctcggacgaagagcgccctggagatgcggcccttagcgaagaggatcggccccgccgaaaggtgcagcggcccgtctacttcgttagcgaggccctccgggacgccaagacccgataccctcaggcccagaagatgctttacgctattctaatgacttcgaggaagttgcgccattattttcaggcgcatcgggtctcggtggttacgtcttaccccctcggccaaatcttgcataaccgagagggtactggacgggtggtgaaatgggcaatcgaactctctgaatttgatttgcactttgaaccatgccacgcgatcaagagccaggccctcaccgactttgtggcagagtggaccccagctctcgagcccgtctccgccctcgaggccagcttgggcccctcacagctgcctcacaccgcctgctgggtgatgtagttcgacggctccctgtctcttcagggcgccggtgcgggggtcacgttgacctcgccgagtggagacgtcctcagatacctggttcgcctcgactttagggcaaccaacaatatggcggactacgagggactccttgcaggactcagggtggcagctggactggggatccgccgcctccttgtgttaggcgactcccagctggtcgtaaaccaggtctgtaaggagtaccggtgctctgacccggagatggacgcttacgtacgccaggtgcggcgtatggagcgccatttcgacgggatagagcttcggcacgtgcccagacgggataacgcggtcgccgacgaactctcaaggcttgcttcctcgcgagcccagaccccaccgggcagctttgaagaaaggcttgcccagccgtcggcgcgacccgaccccctaggggagacggacgcgcctgaacggcccccgaggcccgtcggagtccaagcctcgggacccgaggggagcgctcccagctcccttagattgattgcttggaatcgctcagatccaggcgtacctcgcagataagactctacccgaggaccgcgaagggagtgaacgcgtccagcgcatctccaagcgctacgtgctggtggaagagaccctctatcggcgcgcggctaacggagtcctcctgaagtgcattcctcgggaataaggcgtcgagcttcttgccgatatccatgaaggcgagtgcggagcccactccgcctcacgcaccttggttggcaaggcctttcgccagggtttctattggccgacggctctcaacgatgcggtcgacctggtccggcagtgcaaggcgtgccaattccacgccaagcagactcatcagctggcccaggccctgcagaccatacctctttcatggccatttgctgtctgggggctcgatatcctaggtccgttcaggcgggccccgggcgggttcgagtatctgtatgtcgctgtcgacaagttcactaagtggcccgaggcttatccggtcgtcaagatcgataagcactccgcgcttaaattcatcaagggcatcactgctcggtttggggtgcctaaccgtatcattacggataacagcacccagttcactagtgaactcttcggtgactattgtgaagacatgggcatcaagctctgcttcgcctcccccgcccaccccagaaacaatagccaagtggagcgcgccaacgcggaaatcctcaagggccttaaaaccaagaccttcaacatcctcaagaagcacggcgactcgtggatcgaggagttgccagcggtgctctgggcgaaccgaaccacgccaagccgagcaaccggggaaacgcctttcttccttgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggccctccgagccgcgcgctaccagcagagcctgcagcgctaccatcagcgccacgtccgggcccgatcactctgcgtcgacgacctcgtcctacgccgcgtccaaacgcgtgctggattgagcaagctctcaccaatgtgggagggtccgtatcgagtgattggcgtcccccggccgggctccgttcggctggccacaggcgacggcacggagctgcctaacccgtggaacatcgaacaccttcgtcgcttctacccctaatgggagttggatgtcaggtctcgggctcgggccaaccccgcacccccctcgggcgtgcagggttggccgggggctaccacacatgcatattcttatcttttttcttccgtatttcaataaaagcattttcgatttcccaaggactcgcgtctgtgcctttgtttccttttgaaaaatcttggcttgaattagcacgctcgtgctcgatcctgcccttggtggcccgggccggctaaaatcgccaaaaggggcccagaaccgagccgtgccccggggcgtggtgaactcccggggggggaatcggcaaaggcccacaatcgggtcatccataaccctcggtcaccacgttcccggcctggccagtctcgacacgtgaatctccccaggcactagccccgacccgcgccatttgaggctgggacctgggcacgagcccttgttcaagctaagacacagaaggaccgtggcacagaccatcctcgtctcatacacacaacaaaagaaattgacacagaaatttcctctttatttaattgcagattaagttagtctatacaagaagggggcccgaaggcctcggaaaaagaaggaaaaaactatttaaagattggcggaggcctgggggctcactccgacgcacccgggtcgccggcctcgtcaccgccgtcaccgccctcctcgtcggagtcgagggcgaacgcgagccgaggggccgtaccctcgaagttgtggacgatgtggtcggcggcgtcccggacctgcgcgcgcgcaccgtcctcggtcccgggagggaactcgtccagcgctgcccatggggagaagtcagggtccctggcctggtagctcgccagtacgagctccaccgctcctcgggcgaggtccctcgaggatgacttaattgtctcctcgagctcctcggggagccgctggagggtcccggccatctcggagaggcgctgggcgaggcccccctggttggcggcgtacttcacagtccgcccgccccagagacccacctaccgcccggcgcggtctagacgggagacgccgtcgcgaagcatgctgggccctatctcgcctgccaagcggagggcctcgacctcccccgtggacgagttcagcgcgccctgcagatccgcgatggtgtgttcagcagctgcgaggcgggctgctaagtccccgtcgcccgcggccgccccgccgctgcgtgccctcgcatccagctcccttgcccgcgcctcgagctcagcggtccgctgatccagtgcggccctctcggcgcgggcaccttccagattgcggcgcgcttgttcctcccgcgccgcctcgcggagggacaggctgtccgccagcctttgcgccgcggcctcggcctcctcgagagctctctcccgctcggtgagcgcatcctcgcggaggcggagtgtggactcctcttcggcacagccggcctcgtgcgccgccagtgttgtctcccggatggcgacggcggcctcgcggtccgccaggtccctctccttcgcgcgggcgcgctcttccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcggtgtgccttgcggcccgcctccaccatggcctccaccgagcattgcccctcttcgacacgcgctcacgccgcgtcgagctccgcccgctctgcctgcaggacctccatctgggcatttaacccatccaacaccgtggtgttcgcagtggccaaggcttgcagaaggggctccgcgctcagtggggcagcggaaggcatgggagagagccgcctcggtgagaatgccgcacggctcggcccgccgatcgacgtgccggactcggggacgtcccccgaacctggctcgtcctgagcgtcgcccgaggagtcgggcccgagcggtgcgcctgcggcctagtcgtgggtggcctcggaagtcatcgtcgcctcgggcggagtcgggtcgggggcttggcaggccgcctggcgtgcgcgtgccacctccgcctcccgggcggactcctcggcccggcggagcctggcctcctcccgagcggcttcctcagcctggcgagcccggacggcctcctgggcagcctcctcggcttcccgaaggcggtccgcggcttctcgccggtcagcttcccgcctccgggcctccgcggtcgccgtatcctcggcctcagaccggccggacttggaatggcgggaggggcgcgacgggatctcgctgaagcagaagaaaaaccagaagacaaaaagaaacaggtaagtgaaaactcgctttgaaagaatgaattcggccgtagtaggcgcggggacgaacctgcgaggaggtcggttaaacgaccaccttgggggggagatgaggtttccccggcttggctcggtcccccccatcttgcggagccgtttctttttccgctccccctcgggctgcggcgttggcgcggcaccttccgagcgcctgctgctagcacgcaccgccccgccccctcggggaggagatggggaaggggtaccctcctgcttcctcttcccccgggcgtcggcagggcggctgccccccgggcccccgtcgcggggcccagaagcacgaccccctcctggggtagattgttcccccctgcggctcccgcccgcgccatcgtggcctcgaggagcccgctcctccgacgccccgaccgccatcatgatggtcaagatgttggcgcgatctggatcgctgcagagggggaggactccttgggggatgagggacgcctccacggagctgagattcagcacccgttggaccaccatcttgaaatcctcaggggcccagtcccatctgcccccctggtgggtcctcatgtagtccttcgacccggtgtactcccaggcgccccgggcgcgccgctggagcggcgcgatccggcgacgaaggtagtcgtcgtacaccatggcccccgtgagcccctaggatcgcaggcccgccaggcggtcaaggacggtgtcgtagccgtctcccagatctaccggcacgcgccagctggaggcctgcgccgggggctggctcggaagtcggaggcgcgcttcgtcggcgaggggggtgtagaaccagtcgctcttccagtcgtcccacttcttgcgcaggacgcagggaatgtagcggctcagcaccggcccccgcggctggaagtagcagccaccgaccaccgacggcggcgacactggctgtacggtgaagaaccaccggaacagccgaagagatgggcgcaccccgataaacatctcgcacaggtgtgcgaagatggccaacgtcattaccgcgttgggggtgaggtgcgccatctggagatcataatgctccagaacatccatgaagaaagaagagaatggcgggactagccctgccattgcaaaagagaggaagaagacggaccgccccgggtaacgtggcgccgggcgtccctcgcccagcgcgaccatctcccggccggtggcagattccggcatgaagcggcgcggtagcccagcctgcctctcgctcacgatgcgggaaggcggcagcacgctaccatcgagcggtgcggagccccgtgccatgacgccggcagaggaggaacttgagaacgagcgagtgcggcgagggtagggcacaggaaacgaagagttagagcgcaagcggcgaaggcaaggggaataatggcgagaggaaggaaacgaatctcttcctcggcgtctttatacccttgccaacgctctgcccggctcctcgcttcccgcgcccactatctcgccccctcgtttcttgcgcccacgcctctgctaatcccactcgcccgtttgcggcgcacgaggccgtggcagtcgagatgggacatatcgtgcgcgcgttaacttcgctcgccgaccgaagcgccatcatcacgtctccaggcgaaacgaactgactcgtcccgattcgcgcgctgctcgagtgatgtggcagtctcgaagaggccgctcattattatcgatcagttttccctgccaatgcgtgcgacttgcgaccgctgagttcctacccgcctgtagagaccggccccacctgtcaccagatctaaagaatggcgtcacgcccgagcgcttccctcgaggggggcgatcgccctggcgtgacgccgggggctactgtcgatgacatggggccgagggtatcatgactagaggttagggtagccgcagtcacccacgtggcccgggtcgggcccgagggtgacgagacctccccgccttttgtctccccgaggggtcgggccgctcccgtttcggccccgagggcaggggcgccccgaccccctgtggttttgacgccacgtgtatggtttaggtgagcacagcagggctcacctaaccgcatttattgcggtttggacgagcgcgccacgccgcatttaatgcagcgcagcgctcatccggtccgtgaccggtcgcagtgtgtgaccggtcacagaccggtcagatcgcgggttaggtggcaacaggcggcctgacacacgcctcgccccgtcccgtcggattgatgagagcctccaggcactcgtccctagccggagccggcgtgctacctcctggagttggcacgtcagtcccgcccagatatattccaggcttcatcgcaaccattgcaaggaagtcgttgtatgaagaagggcagacatgcagcttgctaaactgacacgtggtggacaacaatgaccggtctgtgactggtctgacgctggtcatgtcataggcagacaaccgcgcacccattttgcacctccttccagcggagtggaggtaggtatgacccatcccatcggagggtcattcggatagcagccattgcaaatctccgcccattaatgaaggaatgacagggtgatcccctatgtcagacgagtgaggacgctgggccacactcaaagacaagctatattttagcttccaagagaaggcgaacggggttttggtcaagagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccgtgtctcgtgcattgcctctctcgcgaatattccacagaccgagggcttagaacctcacttagcgcccccggccgaaccggcaaaggggggcctgcgcggtctcccggtgaggagccccacgctccgtcagtactaataataatttgattgatataatagacaaaagaatccaacttcttcgcaatgtacactccctgcttcctttagtgtttagggaaaaaaagcatgcagaaaacatcaatttttctaagctttttaccattttaacgtaagttccttttcccctaagaactcatgtaaaaaatattttttgtctatactagaaaaagacgttttccagcggtacaacgactattaggagctataatgacattataattttacactaatttataatctacattggtcaaaaaataaatcacctaatagaaacatctaataaaaaatataaaatattttagagttggaccagggtttcacttatcgtgtgataatcgcatcacttatcacgcttatcgcgggggtacggtaggggaaaccggcgatatgatttggatgaattttgaccaaattcaaaattccggaaaaaatcgaaaaaactgaaaaaattcatggatgtagcgcgataacatgccacctcatcgtccactagtaataattacaaggaaaaattggaacc

SEQ ID NO: 39777 - DNA, 3322 bp, Oryza sativa
  unsure (1)..(3322): unsure at all n locations
caggaccattcatcagtagcaaatgctacagaaaaggaaatgtttgttgctcagctatcagcatacatctttggtcgatcaagggatgtaaataaaaaaaaatctgacaattaagcttgaacacttacaaagtatggatgttttccatgagcacattgtcaaaatatctctgaatatgaagttgcatgatcatacatgtattttacagaagacaacgcatacaaagacctccagcatgctttcagcttacatttttcttgaccagtagcaagaccttttttctcccatacgttgccattgatgcaagtttacaaggtggcccaaaggagttaatctgtgacatctcaaaagggaaggaaaagaaacaaacaaaaaataagtctttagtcaacaatgtgcatcattggcgatgtacaacaaaccagttttttttttcttcagagaagaaaataacaaggccctgcattagtgtccatttccatgcgtctcatgttctgcttcctctgcatcctcaaaacgttggtcattgatctgaagctgcataaggacattatgaggtttttgttcgagttagctcatgagattggcaggggaaggaacaaaagagttttatcttagtatacagatcaaactgttcagaaagtaactgtttgatgtttataataattttgaaaggataatcaactgccaccctgaatcacaggtatatctgtatatgaattaactataccttaacatattatgtgacananacagtaagaaatatacatatggtcgtagtttctaaataaaatgacgtgagaggatgccattaccaattcctataccatatgtggtagtaaatacagattattttcacaggaccccgaaaaaaagaaaaaacctttacaaccaagcttataacacaagagttttatttcacttgcaatcgtttcacagaatcatataaagcataaaacataatggtagaacaaaccaacagcatacctcaactacagcatgagtaatatcatgttcatcagtttgacctatcgggttgacatctgaaaactcacattcagcatcacttcctgaatgcaagataatacataaaagattatgcataacgtttggatgaacacaaaagagaaatgaacagggcgaattcttaccaccagtcatatcttcatcaccttcatctctatgagcccagccattctcttcatcactctctggtaattaaaaaggcatacatcaaacaaagaacattcttttattgtttattaactattaaaacttagcaccattaggatcggggttcaattcagcacaatgtgagaatgcttcaaagagtccatccactgaaacttctgtcaaggatccaagatataatgtgaatatataatagaagatacaaatgcttcaagaaatagtattagtcaattcttcaaataaatagcatttcaaactgctggaaataaaaaatatatctgccatgatgatctgcagtatgatactaattatgcaaggtagtttattcttgattagctattaatcccaacagagaaccatttgtaactgaataacataagacaagcaaatttttacttgtgaaggaacagaatgcacacattacattcttaaagtagtaccctctagagtgaagacctactcttcaagaataaacaaatctaatcatgactattagttgctacagtcatgagaataaattaaaaataaagagctaatgaaaaatgaacatagagcattagaaatgatagttatttcatgtaaacctgcactcatatcaaaatttagtatgcaagcatcagaggtagatttatacaaggaaaaccaataaatgctcctacatcagacaatttactgtaaaaaggatacactgacaaggatcagatggtatgatacgcatctcagtgactttcgatagctctgtttccacatttacttcggagtctgattcatcggactcctcatcagaaccatcttctgtctcaatctttgaaaattccaacaaagggaatagcaaacattagaatcagataataaaagataacaccgaaaatagacaaagaatcaattgtgatatgccaaattcactaaatacatcaacatcacatttcagaattcaaaatttagcagctacaagagctctaaacaaaaaccacgaagaactccgcacccacccagcatacaggacaaatgatatatccagactaggatcactcttgagttgaaaattatgtaccagctctatgaagattacaaaaaggctgcacgtgataaattacatccatacatttatctttcaactatttgctactatgctagtagcaaaaatcaccttcactggtgtttgctgcgtacaaactgaaatctactaatgctataagatcaaaaggataaaaccaaagagaataaacaatagcagtgtccatccgttagtacccggtgaaccaaaggagaaaatttctgccaatcctctcaaagaaaaggaaaataaactccaccttagtcaaatgggtcatagcctgtagtttgtcacggcggcaacatctgtagcagggagttcaaagcagaagccagcggcccagcctgtgaatcggcccagaagggagaagcagcccaactcccgtttccctgcgagtgtgtggacccagtagtgattggctgggccactgtcagtgagtgagagaggctgtgtagtgcgatgctatataagccggcaggattgagaggaaggggatcgaatcatgtaatcaaacatactcaaattcaattccatctctctcctgttcaattctgttctgttcttcttcttcttcttcctcaagccaactctctcaatctcttcccttctctactcgaccgaatctctcctacgagttcgagaccgtgacaatttggtatcagagcaatttcgatcctggagaagccacgatatacttcccgtttgcaacttcaagtcgaagcgatggagaagcagaacattgatttcggcaaggtgttgatggagatctaggagtccttggtgaggctgaatcgtgctcaaggcgaaactcaagcagcggtcgtcaagctagatcgcgaagtgagcagttggagacctcaagtagaagcagcagttcaggagttgcgtgaggaagtcggcgaccttcgtcagcaactggatctcgtcggcaaaatgaagcaggcttctccggcgacgtcttcccctccagcaccatggcgcgggcctcaagggcttcttcgcgccgccgggacgccgcctcggtcttcgccggccgccggtcccgggcaacggccggggtcaaggaccccccgg

SEQ ID NO: 39778 - DNA, 2028 bp, Oryza sativa
aagaatgggcttttgctagtgaggtagttgataggctcaagttgtttaatgacatcactgcagtattttctggcacaaattatgtgacttccaatattcaactacttaaaatctgtgaggctaaagagcaaattaggaagtgggctgtttgtggtgattctactatagaggaaatgtcagttgaaatgattcaaaagtttgataagtactggaaagatattcaagggccaatggggttggccaccattcttgatcctaggtttaagattgactacctccttgggttcattgaaaccatcactggtcagtcaagtgaagagtgtgcaacgaaagttgctgaggtgaaagacactctatatgatttgatgaaggagtatgaagtggaagatgatgaggataacacggaatcttcagctcctccacttgtcaattctgatttattgtcttcaatcacagcacgtgttactagtaggagaccagcagcaatacgtgttaaatcagagctagacaggtacttagaggatgagttggtttcaattaatacagaaaactttaagattcttgattggtggaaagtggctgggacaagctttcctacattgaggaaggtagcacgagatatatttgctattcctgttagcactgttgcatctgaatctgcatttagcacaagtggaagggttcttagtgagcatcgtagccggcttactccagaactcttggaggccttaatgtgctcacaagattggctgcgaaacaagtatcgaggtacatatgatgttttattcatacatcatgcttagcatagatttacaatgcaatggatgcaaaataattgttataattgttatcttgtagctgataatgaagaagcagcaagcttttggagttgccttcaagatatccaagatcggattgaggttttctttcaacaacttgaaattagcaatcaaactcctattgccattatttgttatatccttataaaatacttgactaattgaatatcttttgctacttctttaatttagggacttgctcttgtttgaagacatgaatgtatggacatgcactgttcttgcaatgattttggatgtttgtaacccctgttatgtgtcatgataaacttgtaaaccatggcaatgcttttggatatttggcacaaaagacctactccgaactatggttttacgtatgcctggacaacatgtgttgttgctgcaatgtggtgataactaatgagtgatgactgatgaatgatgaatgatcatgtattattgtgttgatgcttaatctgggaatatgatggatattgtattcttgggcacacttttgttgcactgcttgttgctgcactgctgttgtaagtgatgaattgatgatgtgcatttgtgaactgatgatgtgcatttgcgaatttgtgatctgaatctgtgaacttgtgttcttgtagttgttgttcatgtgctgaaattgatggctggaattgctattttgagtgttaatcttttattgtttgatatgagaaatgcatacatgttgactgttgagtaagttgatagcggggatggaggctccacggggataaattacccgcacggaggcggtgatggggaaagatgttgccccgttgcatttcacggtgatggtgatggggaaaattccccaccgcggaggcgggtatggtggagtaacctccgacggggaattccccgttgccatctctaaaccggcccatataaagacttatccatgctgatttttaacttaagcttcctaagggacgcggaatgggcgggaactgcctcctaaggtttaccattgatttttttatatattcttgtccagcacaaataaattttagagtaaatttcacaaaaagatagttttgtcaaattatcacaaaactatagatttaaggagatgtatcataaaacttatagtcaattcaatcaaaaaacttagatgattataactcaaatcactggtggagaaactatctttggtcggtcgaccagatttcacaat

SEQ ID NO: 39779 - DNA, 1831 bp, Oryza sativa
tgacaagttgagggaccttgggtgtacttttccccgatatgaatggcttgagcagttcttgggctcgaatgaatgcttgagccacgccgtaacgtggtctttgattgtgagccagaaaactagcttgtccaaataggactcttgctagttgccaaaaatgcaaaggcgacactacaatagtgaatgatgaagaccatattatatctcatttgtattattaaaatgaaatttctcttcgtcaacatattgatagtcaggttttaaaatcttggttcgaaattttggaaatttcgaatcccctgacaagcaaacatctcatccgaaattttcgaatactctcatttttttaatgaagttggtgaaaatttattcaaattcagtcaaaatttgttaaacatttaaataatttcgtggaaaaaaaaccaattgaaactctcgaaatttcggtgtttactgaagtgcaaaccttgctgatagtttgctatgattggcttcaatctacaccattctatagagatagcgtaacaaacttactgtacgacacctcactggcgatccatatatatatagctgagtgcaccaataccatgctcccatccgttacaaaagtttgcaggctggacagagccattgtcgccatggcttgtccctacccagccactattatccctaccgcagcaccgttgtgactttgatggtcgccgcatgataggaatgacagcgcatcccaagaaggacccagtcactggagagttattcgcgttccgttatagcttgttctagccatttctcacgtatatttggtttgacaaggctggcaacaaggctgatgatgtgcccatcttctccttgcagcaaccatcaatgctacatgactgttcaatcacggagcattatgccatcttccctgagtcgcaacttgtcatgtgtccgatgaacatggctctacgtggtggctcgctgataggattggatagtgcaatggtacaacggattggtgtgctaccaaggtatgccgaggacgagtcagagatgaggtggttcaaggtcccaggattcaatatgctacatacagctaatgcctgggaggaagctaatggagaggagattatattggtgtcaaccaacaacttatctgtcacacatgcttggcaacatggaactcatgcaagttcaggttgacatgatacatatcaatctccgcactggtaccgttttgcgcactgcactctcactggagagccttgagtttggtgtaattcatcagggctacgtcggtcgatacaaccgctatggatactttggtgtaagcgcaccgttacccaggttctctggaatcagaaagctcgactttgccatggttggtgctgacgactgcacggttgcacgccgtgactttggccccgggtgctttgttggggagccatttttcgtgccaagcaatgataatggggatggtaatgaggacaatggatatgtggtgtgctatacacacaaagaggataccggagagagccagttcgtggtgatggatgccatgtctccagaactggaaattgttgcagcggtgcagctgcttgcccgtgttccctatggctttcatggtcgttttatcacgcaggccgaacttttgtcgcagcagaaaataatcacatatatcctagtttcggggtaatttattttataaccatcagttgtgaatcatacaaccatgggtccacttgtgcagaatagttattgtctaaatatggatatatcacacaaaaaaaaaagcagaaacgttccaatggttggtagccatttcttttgtcctcgtggatgaccattaatg

SEQ ID NO: 39780 - DNA, 1467 bp, Oryza sativa
  unsure (1)..(1467): unsure at all n locations
tctcaaatcatatgctttgtttagttcctaactttacttttccatcacatgcacacataagcatttcaaaacttaaaagccaacattaaaaaaaaattatgttaaaagcatttcaaaatcaaattttggtttattctttagctgtttaggccaaacgatagggctaataaacttccaacttttttcttcaaacttccaatttttagtcaagcttccaattttagcatgaaactaaacacagccatagactagagagcagggttcaggctgctctccaaagccaactcttgagttaaatttggaagttaaaccctgcaaaacaggccctaagtagaacaacaaacaagctaccacaggaagcaagaaccagccgaagaactgcagacatgcaaaacaatgttaagcttctaaagaaaaagtaaggcctgtccaggctgagcatcagcgtctccagggaaattcctacactgaaaccatcaagcaagcaataacgcagagatcaacacaccaatgctaacagataaagcagcaatcaatagatgttaccacagagccaacaaagcaattactcaacggtaggtaaacattagcagcaaatacggctccataacaagttcacataactgaaccgacatgtcttggtgcaaaactcttggtaaaactagggatataagatgataacagcacaggtaaataagccattcaacagtcgaatggtggcaccacgccaagcagcttgacatatcaacgagcttggcagccgaagacatggatcactgcgacacgccatcaccatgatcgcccatctccttcgcctacttagatctctgcctcatctttcggcgcttcctcttcagcctcctcatgcgcttcttcttccactgaatacaatacaaacagaagtatcagatcacagaaagttaactgatgaaaattagccgataagcatggtagcatagctaagaaactgcaaaagatcacaacacagtagccttcttcgnagaacacaagggtgaacagaaactggaacgcagaagcaagaagcaacatagcatcacagcaaatttagttgatttaaattcattcgttgggtgattcaagaatgccagcatagacattgttgaacaaaccaactgaagtaggggcatcatggatggcaaaatggcaatacagattgacaaaatacagaatgacaatttcatattacaaagtctatcanatcatgaatgaatgattaagatgtacttccctggataagctttgcaccacaaaaataactactatgaaatggtaacttaggtaatcaccgataatgcagttatgtaactgaatttcatgttcacagggaattgaaagcattcataatttcctactgaaactacagcaggaatagcatatagacagtgagcatcacataattactgatcaacttaacagctactattagtatataatagttataatttc

SEQ ID NO: 39781 - DNA, 1926 bp, Oryza sativa
  unsure (1)..(1926): unsure at all n locations
cggggaggttggttaccttggccctcatggtcgcctcctcgtcggcttcttcttctttttcggcggcggcggcggcggtgggaaagggaggaagtgggagagaggcggcgcgtggtggtatatataggtgcttcgggggaagcaaaccctaggatggtggagaggcttcgggaacgtgggcttgggccgcttcggcccgtcttggcccagtgagaacagcccgtgttgttgggcctaggctgcgataacttgggccaaaaccccgagaagtataaactcttccctttttttcctgtcaaaatttggagtgattctggtttgcatggaaattcaagttagttagattataagaaagttgtaataaaatttggtcaaaattttattaccataagcactttgtatagagttattagtcatgttttttttaatatgtgccagttgtattagacattaccacagcaattttaggctctgttgtggaatttggatcagtaaacctggaaataaaattagaacaattaaccaagggataacataaaatttaaatctaaatatgacctgctatccaagcctccaatgtgaaatgttgaattcactgctgaaactctctatgcatatggagagagtacagcttaggctaagttcttcccccaggttaccaactcttctctctcgttttccgcgcgcacgtttttcaaactgctaaacggtgcgttttttttaaaaaaaaatattctatatgaaaattgctttaaaaaatcaaattaatctatttttgaaaaaaatactaatacttaattaatcacatgctaattgaccgctccgttttccgtgcatggggcatcggttcccaaccagaactagcgaacagaggcttactataggctgtataaattttagcaaaaagccaaattagttgtgggaaaagaaggatctttctgtgatgaaaagaaagctgtgggtaaattcatcatgcaaattgttagcacaatattatattataactaatgatagttatttttttagataaatggaagcattgccgttttaagataatggaagagatttacactgagatttacagcctgaatcatgcatgtatcatagtactccgtatttgtctcgcatactactaaaattccagacaaataataataatagtgacgtactactaaaagttatgatagtctgtactttttggagtaccatactttggttagtactctggatactattcacataaatgttgtcagctaaccgatgaccaacaaagcttaatttgctcccggttcatcctaccagaagcacactctcatttcatccttatcatgtgacaattttagccgtctatgtggtagtaccataaacattcaccatctacatgataactatatctatttctttttataatagaaatcagtccagcctctgcatcgagatgtataatagcattggtgagaaatacccgggggtcttccggctagctccataaggtggtgggctagatgacctgggttcgaaacctcgccccttctaattatttgatattagatcctttcctaacatntgcgtctttataatagcattggttaagatgcgactgataagcttatagaaatatgaacgaaaagctaaacataatttattaataaaacttttatatctatattattcccaatttaaaaaccaatactaaaaaatagactataataaaaaaggtaaaatcaacactaaaattgtggatgctgctgataaaccgagaaattatatttattcaaaattcaccatgccgaacaaaatgggaggaatttcttttgtgtaaaccaatgggggagacttggcgtggcaactaaaaaaagagacatgttgtgggcacttgcatacaccaatatgatccaaatccatcactctctctccaaaagaaat

SEQ ID NO: 39782 - DNA, 2020 bp, Oryza sativa
acaaatgcagcatttaattaaaatctgattctgtcctagcatgagcgaactgcatttaatcaaagtaaataaagaaagctcatattgtcaaacctcttccagtgccaacattgtaaatgccaactttacttggctctgccttgttgagtgctttcacatgagcatcaacaagatctgtgacatcaatgtagtctcttatgcaggttccatcagttgtaggataatctgttcctttaacctgcaattgattcatgaagtatcagcttcaaatctaaattatcttctgtagtttcagtctctggatacaggtataatacttcaaaaaacaagtatcttctagatgggtatatcatattgctattatcaacatccaaagctgatatatggtagtaatacactaaattatgctttacaccaggggtactgtacagtcaaagtataagagaaaataccttcagccctggaatgattcctaacgcagcatcaaagcatgccccggatatccttccatgctctcgtagttcaggtctaggagcttcacctagtcttccctctgggtctgatccaataacattgaaatatctaatgcaaaaggtgacatgttagtacataccaattttgtgttcagaaattgcaagcctatatccatggaaaaacaacataccttaaaatcatcacagccatgtcctttctccccttcgtgaaatctagtatgatgtcctccgccattttcttagcttttccatagggattaattggtaactgtaacagagtaaattattaaccaattaggtacataatatttacacatcagccttgagtttgcctttccagcaacaagatgaaatagcacagcacaatccaaacactgcagttttgaggccatcataaattaattacctgacgtgtggtttctacaataggcatcttctctggttctccataggtggcacatgtactagagtaaataagggtcttgactccatgagacgcatagcctccaaaatcaataaggtgttcgatgtaatattgtgatagtacctgttaaatacttaagattatcagagatatactagacatgtttcagatatattatacagttcatcatatctgtgatagcagataatataaatatctgagaactaaaaatcagaaagcacttgattatggagttaacattgtagcataccaagtaccatggattaatagtgaaaactgttttttatcataaggaccttttcccctagcactacaattaggccattagacaagggtgtgtacaatggtaacgtctgtaggggttagtagaataagaggtcccccaagctcatggaactgacaaactgtcaataaggtaatgacttacctaaggggttccaatgtactctcacccacataggcaacagcagcaaagtgcataacagcatcaaacgcattttcggcaaagatcttgttgacctgggagccagttaagtgaaaaactggcatttgaacattttaaaaattacgaggaggtaatttagaagtacaaaatgaggatacagttttttgatctccaagatcagcatagataaactgaagtcttcctggctgggggaacaactcttggagaacctttactgctcccatgtttcctctagaaagattgtcctaaaaatcacaattaaccatcaagggtggcatttgaagaacaaaccagttcagaaattcagtacaaaggaaaacttaattaccacaatggtaactcgataattgtcctttaacaggcgtaatgaagcatgtgacccaatatagccagctcctcctgttactaagacatgagtaacaccaggttcatggcgagaaaactgcaagatacataaccccacaatcagttatacagttgaattaaaaataggggaaatataagaatggcataataataattgcagcataagaaacataacaggcggatttgcatgaagagttgaaagattaagcaacagaagtcaaaacagatggaacatatccaagtttagcc

SEQ ID NO: 39783 - DNA, 2122 bp, Oryza sativa
tgcacccctgcaataacaaaggcaattggatggagagatgtcactttcctcacctgcttgttagcactgagagcagaaatgaagatatgtgtattgaaacaactacaatagcagtcatcattttgttttatgctagttatacaaggacatattctataatacaggtgatactcaaaattaaaattgctttttgtgtaacaagaaaaacataagagaaagtaagttgagaaaagtccaaaagttaaacctataggtagcagaaagtgacttacaaatcaaaacatgaaacgtgaggaaaggctgatcttaaaagcagatttaaaggaataaggatgaaagaagaagaagagaaaaaaagaaatatagacatcttaccacactactgccaccaaaaccaggagattgcttcaaaataaatatacatagtgttgtgaggaccagagctgcaataactttcccaacattatgaggcttccgcctagcatcgaagtactccatccctatcaacatgatgaacttacaacataaagggaatgaccaaacatttaaccattacaacagttgaataaattaaagcatacccatggtcaaacaaaagagcaacctaattaatgtcagatatatggatcccctgttccgcacaaacaaatgaaccagtcctcattgataatgaaactacacagcaagcaaactctggctttgacttgaaatgcgatatcagcaaagtggcaactgcttgcttaaagatttatctaccaaaaacaagatcgatatggttgcatgtcttagttgacttcagttgaaatattgcacctaatagctttagttcaacttgcctatctgtgtagtgactgaaatcttaatgtgcacataacaagcattacttaaggcagaagaaatgggctgggatcatctactgaaaaggaatttttgctaagaaattcttcactgctggcaatagtgcataccatcaaaagacacactactgcttgccatatgaaatatctagcccatacatatgcatgtgaaatgacctctgaaaggtgttcatgtgcttgtacaccaagtgaatcccatggcaaagaaaaaaggacagctttttcaggtggagcaattcttaaaaaaaaaacagtttccttcatggggcacatagattagatggacaaactaaacattaaaaaaaatgccactattggttggtacacatgctcaagggccaaaggggatcaaaaaggcaacaacattatttagacgcatatacatatatctaaagcaacagtaaataaccaaagagaaagaaagggcatcgagatctaccacccctagtctgactcgccctcctgtttagcggaatcatgtacgaattctcttcttcacttggggatgcagccgagccgccaatggtaaaaaaataaatccctagtcaacaccaccaccaccaccgtccgtgaattgaattcgtccagccagaagatgaactgcagcagaatcaatgaaccatcatgcatcaatcaatcacaatgattagaatcatcattcaatgcaaagaacaggcaattcaaacaagccaagaatggcatattttacactaatcacagttccaatcaagaatcacagaaagaatcatatagtcagccagggacgacggatctaacatgccaagcgccttttgggggtggaacaaggctgtcacaaattaagagaaaaagggctcccatccaaggtctagaagagaaattaacgcgagcaaaactggaggaaaatcgtgtcaggtggacgctgctcaccgggatgcgataccgatgcggcaccagctcgctcggtcgcgggtggggatctgcgaggcgcagaggcggcggccgaaggcgagctcacgaggtggaggaggagtcgccgccgaggggaaaatatatctcggcgagggggagaggaggggggaggggaggagggtcgttgggggtatgtggtctcttggaccgagtccagtcgaggagtagttgttgtatagagagagaagtacaggagagagttgcaaatgcaaaactctctctctctctgggccagtttggtataactccaactcctaaatataactccaggagttaagtttggagtggagttg

SEQ ID NO: 39784 - DNA, 2299 bp, Oryza sativa
ctcgctttctctttctatcactctcctcttcttcttggcagtgatggtcctggtggagccagcacggtgtttcacggtgatcgatcaagttttatactatatattaataatatttattagtaaaaagggtagcggtggcagcggcggagcctggatggtcgccctacccctacctgctcggtggcggcctccgtcagtgctttctgatcacatcgtttggcagtagttatactctgcggtttgttgtggtataccatgaatcgatggatttgattctagaactcgtacatacgaattctatcaatgtatatgtgggagcatataaatgtaaaatctacttaaccgcatgatcaatattaacgcatatcttactgctgtgaagtacaactaatatgaattcaacttagaataattccatttggaagaaatttagagaccaagcaaacatgagacggtttttatcaagcatcaaaatgatgatttagcatgtaagtatgttgagttttataatataataaattatggttataattgctatatttatacattaaactttagatatttggtgggttggcgtggtattcttgcatgttaagttttaagatactaataattactatatttgtatgttgagttttagatgtttagaagctgtaactatatatagaagatatagatatattggttatgttagtaaaacttttataaatatgtccttagcttttaaagacaataagtaaaataaagtataataacaataccctaaaataaatgtcaaatttagttttaaaatttaaatttatctccttccgttgaaaggacggccatatttggtgaactctggctgctgcagtttttttaaaaaaatcttcaactatagatttctacatttaaaaataaattaataagtagaaaatccagttttttttaggtcctcaccctctacctactcacttgagcttctcccacacgggccgatgttttctgaattgattatcggagtttgttgggaatctgtcgtcaccggaaaacctgttttttttcttgctgctgtccgcagcatcttgcattgcatctctcatctttctttttcttgcatttatgagcttgtataatgcacaagcatcgattttagctgtgtttagattcaaagtttggatccaaacttcagtccttttccatcacatcaacatgtcatacacacacaattttttagtcacaccatctccaatttcaaccaaaatctaaactttggatccaactaaacacaggccctatttggatccggagggttattaaatagccctctggaatctcgttatttaagagtattaaacgtagattactgacaaaacctattccataaccactaggctattttgcgagacgaatctaacgagatatattaatccatgatttgctacagtaatcagctgctaatcatgaattaatatacataattagattcgtctcacaaaatagccaagggattatggaatcagttttatcgataatctacgtttaataatcttaaatagcaagatttcgaagggctatttaataacccgaagaatctaaacaaggccacagcctttgtttacatgtggtcatgtcgacaatctcgaaaagcagcagcggaaggcaggtcggcgtcgaatccaatctgcattttctgacgaggagacaccctcctgacagatgtaattgatgatcccaatcaaatggtgattaacagttgtttatgagtagatgtcctttttaacttaaccaaagagttagggcaaatcttatagaaggggtggctgccatatctattttatctatttaaaataagagatgatatatactctcttcgtcccataatataagagattgtagggaatctggacaaactgtctctctataatcattgtactataatgtgtcacatccatccaaaatcccttatattatgggacagagggagtacaatacatcacatctacaactacctctagcatactaacccaaataattttattttatttgtttgtctaatctactcttcctttcatctccttttccttcgggtttgtgtggaggttgcccctcgcatgaggggtggctcaccttctctttgatcacttatttcttccacctcatcattcaatcttatgtggcatgtttaggggcaatacatctagcattatagcacttgcccttactctactattcttccttaaatacggagtagtataagggctcctggaatcgtaggaatgaaaaaaaacaaagaaataagaaaaacatatggttctaa

SEQ ID NO: 39785 - DNA, 4282 bp, Oryza sativa
  unsure (1)..(4282): unsure at all n locations
nnnnnnnnnnnnnnnnnnnnnnnnnnnnnnnnnnnnnnnnnnnnatttccacccgacgttcgtactccatccaagcatgaatgaactgtatggtcgattcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacattcatgctcatccttccgccttaggtagtccgatcttgtttcactacgtgggtaagcacgggttccgtcattttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacaatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagctaaaagaaacggtcacataaggaatgaagaggtagaacactactgacgaggcctcttacccctatccctcctaccctgcgccctaatgtgcccctgggagtacgtgagtcggtccgggggtacggcacggccaacccgtcctgcctgtacaggtgtgatctctggctgctcctgagtgtgctcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaaacgccggtcgtgcctgcgaacgcgctcgaaggcagacgaggtcctgcgatgaggaaacgtgccgttaaaacatggtgacatattcgtgcaaaagctgaaacaaaaatgaactaatctctgggctgaactgtactgtgcgaaaccggtgctgtaggtcgcactgctccgaagccaggggtgctcgaaggcaaacgaggtcctgcgaggatggaacatcaagttatgacggggtgatgttttcgtacaaaaacagaaacaaaacttaagaaacctctgggctgagcagtaccgtgcgaaacaggtaccgtaggtcgaggtcctgctccgacggtaggtgtgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaaattcagtagttgtcctatattatgcaagataaatgaaataattgtaagaactaatacaaatccgacgtacccccacgaagtagtctcggtcacggtgcgtgggatacgcgtccgtcacagcggcaacgtgcggctctagggcgtctggagtgaaggtcacacgcgcacgagtgcgagaaaggtccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggtaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtctgggtaacctcgtctcacctggacgtgagcgtaacgacgctgcaataaacatgatcggaattagacatgttatgtgaaataaaaaaagaagacgactgataaacttataacgcagcgaagttgcactaaccccacgtcgacaccagtaagtccccatcgtgggaccgtcctctggtcactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcataaccccagctccactgcggcacgtcctgtggctgagcatccgcgatggaccgtgcgtagtggaccagccggaagtccacagcgtacccgtgggtgctagtgaacatcacccacccgaacaaccacaacaggtacgcctcaagggagcgtcggaccgagttatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaacaaaagtgtcaccatacggaatatttctaattacaacaataactg

SEQ ID NO: 39786 - DNA, 2903 bp, Oryza sativa
  unsure (1)..(2903): unsure at all n locations
cccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattataccataccgagatccatcggtgtcgaacaatagagaccacttctccttaggctcattctcaatccactgagtgaaatttctgatggacgaccctgacctccttctcattgtcggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtacaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcaacacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgttgtacatctcacttgccacgaaagctgaagtgatgtttcggtgatacttctccaccccttgtaagtagcacttgtgctcggtcacaatggtaactttccaataatcattccatttacccttatatgcatggacacgccacggacaatcttccttcatgcacctcacttcatacacataatttgttgacttgaccaccctaaactctctctacaaggaaactgcccaatgcttcagcanggccttcatctcatccttatgaagcataccttgcaccgtcaattacctcgttctccttatactcccagggtacatgatcaccctctgatgtaacaagtccagaaaagtcctcatttgcccaatcagtggccattacatcaccttcctcatcggatgatgcgtcgtcgtccgcttcctcattatccgaatcttccctctccatttatcaacaattataccgactctctccccctcatccgccatgcccatggcctgctcctcccttggttgattttcctcattttgcatcgatggtccaacaacatcccctgccttgataggaccctctacatcttcggtttgcattgaaacatttatatctttctcttgtaccgacacaaatataacgaggggccatgaccgttcaaaagccatttccacataccgtcaccaagcagcagtgctgtccatcggcattagttcccaaaaataaccttctgttgcatgactcactacaactgatactgacattgtgtagacttcttggtctattctaaatcctctcaacaaccaactataaattgactgaaatgttctctccgcaggcctatcgatgcccttagatgttattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatagaactaaaactaaaacgcaacatatatactcaaacataacatattagtacaaatgcaaaagatgtatgagagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggcccctgcaaaattccatgccccctcgccgcccatttgcaggcgg

SEQ ID NO: 39787 - DNA, 890 bp, Oryza sativa
cggcgtcaaacatttcgaaacggagggagtatcatctatagcaattgaccgtggggtggcagaaacctagaaggatctggttaggtgccccacacttgtagagtggctcttgtgtctattccagtccctaaacttctagctttttacatatgaattttttgctggaaaaatattgtccaaactgaaaagtattgatgacgagcatgttcattatataggtattgcacaaccggtcttcctagtgatataaccgtcacagttggggagcaatcttttcatcttcacaaggtaagattttcatcactagttcattcaagagttcctttcttttgcaatatgtttcttttagcatttatgcaactggcttacgctttgctttcagcctgggaaacctttgtaccaaaacatactactccctctgtcccaaaatataagcatttttagtatagtgagaagtcaaacatttttaactttgactattaatagcaaaaaaacaaaaaagatcaatcatgtaaaattgatattcatattactagatttatcattaaacaaaccatcataatatgcaactatttttatttaaaacatcttacttttatagatattgttggtcaaagtagcatctcgaagacagtgtcagagcctaaaaatgcttatatttgggacggggggagtagataatttgtattagggagggaaaaatagatacaatcttgtgaagataattactttgtaaaaagcaagttctttttctattttgcagtttcctctattatcaaagagtggccttttggagcgttgtatccgagagaagattgagaatggagacaacagttgtgtcattgacctatcggatattcctgggggagcaaaggcttttgaactaactg

SEQ ID NO: 39788 - DNA, 1947 bp, Oryza sativa
cgtcgagaaaacaaaatgatatatgggttggatgaatggagaagaatgtggttcagttcagtgtgatcatcttcttgttgtggctctgaatcgaatgagctgtgaatttggtgaatttgcaggcatatgcaggaccagctgatctgcagcggctgcaggcgcgtcgtccagtacaggagaggggtcgccggcgtctgctgcccgggctgcaacacgctcaccgccgtcaacccgtcagcggtggccgacatgtcggagctcatctgcagcggctgccccacgctgctgttctacaaccgcggcgcctccaacatccgctgccccagctgcaacaggctcaactccaccagatcaggtgaatgatcatatttttgcacatactatatctttctctgaaaagatcatatttgcagctgattcagagctgcaaattgggatgaaattaatctactgaaatctgagctgatcatggatggttttatttggtggttcagccaaccagattgcacacctgacatgcgggcagtgccggacgactctgatgcacccacctggagcctcaactgtgcagtgtgcaacctgcagatatgttaaccatgtcagggtatgttctcatctctgaatgtttctaccctctatatttctcgcatcgcgcattcgctctccggtttcgctctctggtagtaatcatcgtcggctcatcggctcggtgataaccagggttggaaattccgaaacgaaatttccgaaatttcggacattttagacctctctgatatgatattatttcggccaaatttttttatttttttaattttttcgtgaactttggtaatatttgttcaaattcaactaaattttattcaaaatttcggaaatttcagaccgaaatttcaaaaaatttggcatttccatgaggaccgatcaaatcggctaaaccgaaaggtttaaccctggtgataaatagttagtgtgttcttgaatgatctttccacaactgaacagcaacctgagttgatcaactggaaagatggaataaccttttaactttgcctagaatatcagtagtcggcacaggtttttctgaagctgaaaatatggaattttcaattagattttctcatttctgtgaacaaaatttcatgggaccattgactgaacaaaccagcacttgcttttatctttaattttgcatcaactaggggatgcatatggttctcctcttcttaaaaaagatgacaactttggtaggttcagcttgctccatggtttttcatggaatcagttctcaaagtaggcatgtacctatgattagccagcagaactcgatgcctcggccaagatttttatcttccaaattcgttatcaggacaatgaaactaatgaatgatggtccattgggacaaatgaaacaatctgaatcttatgtgatgtcaaatgttccatgatgacgatgctagctttgttctctgaatttccttttcttttctcctacttgcaggatgctcggcctcaaactgtccttgtagagaatcctaagacactggatgataagggcaagctggtaagcctcatctctaggctatatatctctactatctacgcctttaaaagacgcagtcctcccatcccaccctaccgcacgcagcacgagaaaatcttgtaataacccgaacgggcccacccaccgcaccctccttcccgcaccgcgtgagagaaaaaaaaagtgcacgtccgacttccatgtcgtcttctcgctagaaaaaccgagtttcagtatcagacaaaaatatgatagttgtttttatgggtccattgcaacgcctagacatttaactagtagtaccctaaaaccaaaatttccttttgaatttttttcttggaatagcagaaagtttcacttctgaaatgatagctgaagagtacatgtatttcagctctgaaatg

SEQ ID NO: 39789 - DNA, 785 bp, Oryza sativa
agatgtcaatggcacggtaaagtccgtcatctattgggcgggcataatctggtatagcagcagccaaagaccgaaactttggcagctttaggttgacatctggtgcaacttcagctaggtagccatcaatcaacttagcgaccattgttataggcataagtgatggtgaagctaacatttgtgcatcttcaccaaggccaggggaagccccaccagtttcttgatccattgccaagaaatggtcaagaatcttgtggacacaatccacatcatagagcgtttcaacagactcagagatgtttggaatcagaagatcttccagggtagccttatcaagctgcatacctatccgtctctccaagtttgacacgcaagaagggctggcttttaggatgattgctgtccgcagaagaccaaataacagcttgcaagatgtgacccccctttggaaaggtaacagtctatcaatttcctcaagtaggtacttttgttcctcttcagaagggattgatgttaaagatgatattgaaaggcaactgctgacatcactgatgcttttacgccgattcaggccaggtaaacgccttttggcatagtggttcaaggatccaacaataatatcctgattgattcctcggtattccatagctgagattacttttttgtataatggaaggcttaagcatgaaacatcatcataccaccaatcagggctgctatgtcttggccttgctccggtgctaatgccattccacaagacgcttcctcctggactctgcatgggg

SEQ ID NO: 39790 - DNA, 6102 bp, Oryza sativa
aaacggagggagtaacagtataactgtatacgtgtgggctccttgaaaagctaatattaaggtggaaatggattagatttgcagcacacaactgacagatatatcaatcaatggtgatattctcttgaatgaaatcaatggacatttcttgaatctatctggaatcaaatttgaatatatagtatacaattcacacagttttcagtctctgcattgtccttcagtccagccactcgtttggcgtcagctttatttgtacctgttcctgtatgtggatgctttttattactcgatacaaacgcgtacaaacacttcgcatgttcccgaattcatttttttttgttgaatcgatgtaacattgacactgggtgctcaagatgtcgaagtttcgatttattccaataacaaaacctggaacaaccagatttaaacaacatgaaatatgattcattgacttcattaaaaaaaaattgatacattgaagattcatagagctggtacatggaagattcaaagctattgatcaaaatgggtcttcaaatccccaaccactcgagagcagctgcatgctggctagacttggtcataatttggggaaaaaaatctctagaattcactcctatatgatcactcagacgacaacatataaatcaaacttcattaaaaaaaacatataaatcaaactggttagaattctgagccctgcttcaaattttcgattagtcaagccttgcatggttataaacaggcatatctacatgaggtaactttatgaaggagaaaattccggataagcatggagtgaatatgctattttcaaatcaaagtggcctgaaaacatatatttgaaatcaatggttaactgatatcgtgcaatccttttgaacatttatgcacaagagtgttaatgatgctcatttagatgatttttcagaacctaaatgctttccattgttatcccaaaatccatttcaaagagggaaattaagctaatatgagatttacatagaacatctcgcaggatatggtagtagctagtatcatgttgtttcaaaatgtcacaaagatatgtacattactagtatcttatacattactagtaacaatggagagaaccatcagtttatataatcattgtgggcaattgtgaaaggaggatttgatagaaatctgcatgaaaatcttccaagggaaaacttatttccattcatattagagaagaaagggggaaatggtaactagttattatgacaattaatacctggaggagtacgtataatatatctataaaaaatggagaaaaacaatgcatttcatttaccacgcattagctgcaggatatacaaatactgtacgcaatgaatgcattgcatttatactgttttgcaaatcacattgaataatactgatcaagatcaagatccagtcgtccgtggaatagctgcctgcaggcaattatcccaaaagaatagtccaaatccatatatttctccacaacagaataaaaaggtatacatatataagagataatgagatgacatcaaggacagatatttatcaacaaacataatattagcttgcaaaaagaatttaaaatcgacatatatatggctttacgaacctccctcaaacttcaacaaatgcacaaacgtttgtcctacttgatatacatatatttatcgaattatcgtgtaatttaccatgtagaagtcgaaggaccatgcataaacataaaatcaaaaacatgcgtggataatatatgtaagaaaacaataagcaaccaagccaattcggagaaaggaaaggattaattaggagaaggttggaaaataggagggaatatgcttggctccgtgcacgccatccatcataggcaacctctcgcagaagtttgttgctctagatgagtggcatacagggagccaggcacattcccaatatcatcacctttgctttagatcaattatccatgcattgatctccatcatctccttctcttgtcacctagatctctcatctttgctacacatatatctccatgcatgtcaatgccattgcttatgcatggatttgctaccacaatacatgttgcaatatgaacaatcaccatctcctgaactactactacacaatttctccatggattgttgacgaggacgacaagatctagagagagagagagatagctaggaagaactagagagagagagagaaatgatgtggtgatgtgcaaggtgaatgggagaggatactctatatataggggggtgatgatgtgtgagagaggaagaatattccgtgcacacatacaagctatgaaaagaagacaactcacaaagtaaaaaatagctccatgaaaaccgagctggctctgcagtaatttactcgtggtaaagaaaaaaaacggtgatctccaaccaattaaatcactgttctcaccactgccagcataaaacagtgttaataagcaggaacaattcttagcctgcattgattattttatcaccattttcgtacaaaaacatataatttcgactgtagccagattgctgtttttattaattgccacactactgtacattctgctcatgatgttgcactagtagctggagtacctaaaagttaacaactatttacttgctttttgatttttgcagaagtgcagagcatgaatgattactactacatgagtagtgcaattccatcttgacaagctgggccgaatgcattgctaggccaaatttctgtctcacccaactcccaaagctaggttgggctgggctaaatttaaatgaatttatgcaccctataatatatcaacaagttttctctctttcaaatctgaacctagaaaaaaataatgataaaaaaaaatctgaagctagaaagactctgagcatgctctgtgaaaccatgataatattttttttatactctccgagtgctagattgtacttgtcagcaagcccctcgaaattcctggtcgaagagggaagtcgccggcgagggcgccactgcgccgacgaaggaggagaagctagcggcgacggagtagcagtggcggcggcggcggcgggagaaagacatgaggtcgaggtcgctgcacgggtccggcgatgcatcgcgctgggacccaccgccggtgacggcctcgggaggcgccgacggctgccaccgccgtcccgccccattaattttgggcgagtttgtttgaaaactttttattgagtaaatttcactgccaatatttaactattaatgcaaatttcaatttattttgaccttacttgcaacatggctaacgctaccttcatattttcacttgcaacatgtgttcttctacttgttggttttccacgcgcatactttccccactactaaatggtatatttttttttcaaaaaattctataagaaagtgatttaaaaaattatattaatatatatttttaaaattttttaatgaatacttgattaatctgctaataaaatgacatgttttacatggttatggattagttcgcaatacacaacgtcatatatatttgagcttttgtacttgtgactgggtctatggtttgggccatcacgttagcttcggcccacgctgcgcatgcaggagacagtgggccgtgttctatcaccgtggggcattgaagtctaagcgagatggcgcgagagtggctacttgactagagtggcaaatagttaaattcaccactttttgagcgccggagtttgttcgaaaattttggttttcttgacaattgaaagatttgccatagagggtgtgttcgatatatatttgttgcggttgtacagtgcagctgctatgttttcttttgcgtgggggcattttagctgtgatgtgactgcagcaatatgaaccgaacatagccatatgcttcatccgtctcataaaaaatcaaatcatggttacaaatctggacgtatgtacttgttaggaattaaagaataaaaaattgtgggtagaaatattaaaagtagtaacatatttcattaagaataattgctaaatatacttaccgtcgatattaaaaaaaactttcacatggacactaacaaattcttcagataaaacattctgttaaaaactttatgttacaaaaagcttatatagacaaatagacaaatgtcaatctgtattttaaatatattcaaaaatcacttttgaaaaatataaaataccattaacataacattagcctgtaaaggcctcttgcaagccccactctgtcaaaaaaaacataacatgtatgcatcattcatttatttttacatgtctctatggcaagaacattctgtatatatccaagtatccaactatatttaggaggataagatttgactaatgtatgattcttcacccagtgcatataagccatatacctgaattcggctggtacaatatatatgtttgcatgtagcttactagtcggacgcccagagttttttctcctgaattcagccgggtctaagaacttaatgtgatactccctttcgtttataaatatatatcgtttaaatatgtatatatggtgtcaaacatcaaaatattaactcactaatatctgcaactgcaaagttgtgaaaatttgatatgtaataatgatattcatagagttgccataaaaaaataatttcatatagttttatttttatataattttcataaacatatagtcgtaaaagataaatgcctagatgataagttaaaaataaaggaatggacggataagtttgtgtcacgatctatatgacaataaaaaaaaatggaaggattgagtccctgctttctgggaatcatatcatatatgcccaaaaatttacgatgcacattctgtgtacaccaacaaatttcacaaaatttttagagaaaattacacacatacttctaataatttatgcaaagtatcatctttagattcattatatttttagtcgtgaaaaaaaataaaattataacagattttcttttttatggtgagaatataataaatttaaagttaatattttatagatatgtgcaatactattagaagcacatgtttttttaaaaaaaatagatggtggcatttgttaattgatgtacacagactgtgatacctttcctgttttcaaacttgtagagttacatgtgtgaattagtaaaaaaaaaataaccccttacaagccaaattccaacgaacagtgtagtacagtaaccacaaactaaataatttttgtcctttcttttctacaagattatctggaagaatatttgatttgaatgtaaagttatccttgccacgtaaccaggctcatgcctttctctttcttgccatttgtttacaagtgttctctcttcttttctgcacttggctcgatcgatcatcaccaaagtttaattacccttccgacagtagtttacattccaatttgatcgaatattggtggaaaagtgcaaaggtgagtcgacgattctccacttcacatctttaaattaatttggatttcaataaatttattagaccaatactgatcgatcttataccattgcttgcttcattaattaatccttcggagtcctttgtgtcgaattttggtaagttgataccggataagcaaaagctgcattgctttcttggcatggattaattagttgagagcttgtttttacacatcaaactaatgcaaagcacagtcagctatttgattccctaaaaggtataatttgtaactataaataaagttagtatatatacacgaatcgaattgtggcttcttggaagttcatagaggtagccatgctcagataatgtgattcgaccggttaaaagcaatatatgatgtaactatatatataggtgtcctaaaatctgttctaatccatttgcttgtagttatatgtaatgaaaaacacgccctattatggaatgcaccattttttccatcaatcataatagacatccacgaaagattaatgatatatatagaatattcgatgggcagctgattacgagcgctcacccctaaaccaccatatataattatatcatatcagggtatcaacaacctcgactagctaaatgaccggccaatt

SEQ ID NO: 39791 - DNA, 6687 bp, Oryza sativa
ctcttctttagagctacaacacccgttggtatgtgtgtcttcttgaaagcggccatgaattcctgccacgtaataggctctccttcagccctgccttggcgaaaatgatcccaccattcagcagcaggtctatgcagttgatgcgaagcaaaagaaactttctcctgctcagtacactggatcaaatccaaattcttctccaccgcatgcagccaatctcctgcttctactggattggtggtgcttgaaaaggtagggggtctcacacgtaagaaatctgccagcttgttttggggaggtggggtggattctgattctgattgtttgcctgctgattctgtgcctgctgcactaacagattgatcagttgtgtttgttgggccagaatctgagctagcgtgggatctcctccattgttagtagctccacttccacttccggtgcgcgtgttcaccatctgacgataagcagagacaacaggaaagaacgacagagagacacccttagaacggagttatttaattaatttaaattctatattgctattaactgtgtatgattacatttaagttgcattaacactatctcaccaactatcttacactctgacaagcaaaagaactagactcatgctgttacatcccacccatgatgtaagcaacaactaaaacccacacactcacaagcaaacttaaacaagcaatctaacacagcgaactacggcaacgttctaactaagcgactaatcccgccttgcgtcggaacgaagcgatgaatcttcttcctctggagtagctggctctctttcttcaggatcttcctcctcttcctcatcacttatgatgtcgatgacaggttcagcacgatcgggcacagcttcacccatcacatgaatcttcgaagctaactggagacgaggtggcggacagattctctttcttggagtgaggcgaagcttgggtgttggcggcggcgtttctcctttaagttcagctaattccttctgtagacggtacaccttgctctccaacttgcaaatcttgcctcgattccagttttccctgtcatgagctgctttgtctcgttccacacttactgcatccatagcactaagcatatgcaccgcatgcatcagagggcactctcttcaccatcaggacaggtatagattccatagtcttgaccatgaggcttgtgaggatgatactggaaagctgatgaatccaactcttcttcaaagtgttcacgcaactctccaatggccaccaacgctgcttcttgacaagcatggcagtatgatcttcctccagcttcaacttaaaagacggaaggtcttcactatcactagccaacgtcacacgaacacgacacttctcctcgtcggggtcatgggaaatttggcgatactcgggagcaacttcatagcctacctcaaaagccatcaacctcagctccctgacgaatcctaacaccttgatcaaatttctcagtgaatggggcggcatctaaagaaacatagaagagaagaattaatgcatatttttctaagttagctgcaccaactagacttaactgatttttgaccaaaaaggaagaaaagaaaagacacatacaaagctattttataaatatttttagaatttaacttttttggacagagacaaaaaaatttttttttttgacaaataacaaaaataaactaaaatacttatgatctattataagcacggtacagtgtcaccataggaaagatgagtagtactagtgctatcatgattgtatcgataccataatggatgtacagtgccgacaaatcaataagacttggtaaagagagaaagaaacattttgagaaggacgaatttttgcttttaaaagaaaagaaattgaattaaataaatttttgtgcataaccttgcatgtgctgccaacttaattaatttataagagactagagaagagcagttctatttttttcaaaatattttgaaggctacttaaggtttaccatttggcttatcctaaggtaaggtggctctgataccaacttgtcatgccgggaatttctatccaaaattccaagcgcttacatgtgtgttaaaccctcgtccaggaatcaaccgaggcacacaatgacaatttgataatagagtacaaataaataactatcgaataatcgcaaataataaattattacagaggtggatagttcctctcaaagaaaaacattctacgcatcggaaaaaaaaaactataacaaactacggaacagctatggcgactccactccacaggcatcttaaccgagaacaagcctaatccaccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaataaatatttaagagaatagtaaaacggttgtataattaatcaatattaaataaacaccacacaacacacccatgttgcataggcccaaccacatttgaacaaccaaccccagttgaacaaattaaacctcctaaccaggaattatccattccaaactaggaattaaattaattaccacattattaccattaatgagtagtgtgagactaatcacgaaaaacattgctcaactcacccataaccgcgggtacggctattcgaatagtttaaactctgaccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggtatggactccccagcgacccccatggacttctcgccacttctcagtctggcgcactataatgaatcacgctatacaaaagataaagccgttgcccacgctggcttgtggttggcacgataaatgtatcacaacagtagctcgcgaaccggtccttaattgtcatgagcacaaccatcaaaaccatatgctcacaacccaccttagccaggttttaattatcaattaattaacatcacacgatttaccatcgtgagctaccattgaatataaccctaattaataataaaataatttagatttaacccctttagttagctaatgtttctaagcatggctaagcaaacatacatatatagcatttagctgaaccaatccaatatataaggttcatgctaatcatattataacccataggaaaataaagtcatcttcggccattaattaactgggaaaggttcaccacccgatgacattcgaaaacaatgcatagttgaaataaaataatagctttaaacgggttcaacatgctcaaagggttgtttaggatctgtgtgacttgccttgggcttccgcaaacgcttcggaaccttcctcaacggaaacgctctcctccggaacgtcggaaactaaagcaaataaacaaaatcaacaaaacagtacaaaaacaagcataaacagtacatgtggatatttttaacatgtagatcttgattttagaagaatttagcaacttgaaccacctaaaacggatctacggttatttagttatgattttccgaagttttaatctattagaaaattggaaaaaagaaaagaaaaaggagatgatgacgtcatgctgacgtcagcaatggcggccggttagggtttgcgagctcgccggagctagggcggtcgaccgggggattggaggacacctacgcgtagaggacatcgagacgaacccgatggtactcaccacgacgacaaacgatgcacgacgacggccggcgacgagagggcaacggcggcggctcggcttgcgcggcgacggcgggctacggcggtcggcggcaaagaaggatgggcggccgagcttctcctcaccacggcgctcctatcagcggcggcggcaagcggcggcgacggcggaggcggcgcagcgacgacgccgaagacggccggcggcggcggcgagcttggcgcgcgtggcggcggcgctatggggcacgggagaggacgggaaagggggcaaacgggagaggacgacgaggggatgctttataaagcattagattgaagagattggactccaaacgagaggaatcgactcgggaaaaaattcaaactcggttttagggataaaatcaaaacgaactcgattcggatcaaatcctcaacgattcgctccgattcttgggggaaaagaaagaggagaacgagaggaacaaaacccctcaaaaacccggaggaatcgggtcggattgaggcggatttggaggtagaaggcggcggcaaaacggcggcttgggccggttcgccggaagttgaagacgaggccgacatgttgggccccacatgtcggtgactcaaaaaaaagaaggccggccgccggctggcccggcgtggcccgcgcggaaaaaaaaaggatgttgggccgaattcggcccaacggcttagggaggggtttctttgaactttttcaaataaaacaatttgtgaaatgttgtttcaattaataaaaatacttcccttgctcaaataattcccagaaaaatctagaaaatagaggagcaagtatagtatttaataaaattttatctagctcatttttatattgaaaattttcctagaaaattagggtttagcttgtaggcttttaaaataatttctaaaaatgatttaaaatatgcatttttaatttagttgatttttagggcgtgacaatccccttacaaaaacagtttgaaaattttcagaaaaatttctctgaggccgatctgaccgaaggtgtacagccggtctgaccaagggtcggtctgaccactgctgtaccgttggtctgactggtgctcagtctgaccgaagcacagccgccggattgactggtcgccggtctgaccgcgggacccattgcggtctgaccggtttcctcgagaaaacaccagatttttgccactttgattttgcaaaagcaatttctctctgctttttctatctatgagctaatctaaaacaaaaaccaacaagatgtccatctttaccacaaaaagaacaagcatcctttttctttagaagaagatggttttgaaatatttgtttttgtttattttagtgttgtagaaagagagggcataactccagcagacttgaaaactgttttcttagcactaggtttggtcaaaatttagccatgttcagtcacactcaaaacattgggttgattttttattgaaaaagtcatgaacatcaaaacgaacacccctattgtagctagtcactttagattgatccaaaataatgttaagttgtttcttaccatcagaaaatctttgcaaagaacttttcaaataagaaacctatttttccaaattagcacaattttcacaatctaccatgacacttttgctttttcgacatttggggcaagaaagcacttcattggttttcacaacatcttccatgtactcaacacgacctaaagcatgttttagtttcatcttgtttagtgtgcatattgagcaatcaaaaacactttgttgttgttgttttaactttttagcacaaaccatgttaaacatcaaactagcatgaaaagatatttgatatttttttcaacaactttttagttaaaaacaactcatccaaagtacgtgtgtgcaagacaaaaccaagagcaagacaagatctatttttcaaatgatgtgcaacgttgacatctctaatttttgaaatttcatgcattaaaacctcacaatttttgcaaccatcatcattaggaataagagattttaatctataaattttagaattaagggattcaataataaattcctgttttctatacatcttctcacacttcttattttttgtacttaaaataagaatagcttcctcaaaagaactcacatcattgtcttcacactctgaatctgattcaccatgtgccatgaagcaaacaccggagatgttctttcccttatcttcatcttcactttctccatctacatcgcttagtggctcaaaagcggcatagactttctcaaacatcttcttgagattctccttggtcttcttccccttgaatgtgctcttagactttgttctccttagtcttctctccaccattgtcttcctttttgcctctcctaagcttaggacaatgcgaacgattgagatcaagagcaccacattcaaagcaacgatcgatttggaccacttcttttcctgtacctaacattattcatagctcgagaaaacttattaatgaccaaaaccatgtcctcctcctcgaactattcgagttgctcattcgacatggcattaattaaagcaagaatagtagtaattcgatgaagaagcaccaacatccaaagaagtcaaggaagaaaccaaatcactagacttagagtcaactttacaagaaataatattcatctcatgtgttttgagttttgtgtaaagcgaatccaaagtcaaagtaaacatatcaacagactcctgaattgatgtaactttcatctcccaaatagacatgtcaagaccattcaaaaagtgacgagaaa

SEQ ID NO: 39792 - DNA, 1699 bp, Oryza sativa
gcccaacggcttagggaggggtttctttgaactttttcaaataaaacaatttgtgaaatgttgtttcaattaataaaaatacttcccttgctcaaataattcccagaaaaatctagaaaatagaggagcaagtatagtatttaataaaattttatgaggctcatttttatattgaaaattttcctagaaaattagggtttagcttgtaggcttttaaaataatttctaaaaatgatttaaaatatgcatttttaatttagttgatttttagggcgtgacaaacctaccccccttaaacggaatctcgtccttgagattcagaagaactggcgaacagatgaggatgagctgacttcaattcatcttctcgttcccaagtggcttcttcttctgaatgattactccactgaaccttgcagaaccgtataacgcgattcctggtattcctctcgcttacttccaaaattctgactggcttctcaacataagttaaatcttcttgaagctctatacgatctggatctgcttcctccgtaggtacacataaacatttcttcaactgtgacacgtggaacacgtcgtgtattcccgccattgacggagacaactctaactgataagctacttcacctcttcgactcacaatcttaaaaggtcccacaaaacgcggtgccaatttccctcacaatcttaaaaggtcccacaaaacgcggtgccaatttccctttggtttggaaacgatgaacacctcgtaacggcgtaacccgaaggtatacataatctccttcttcaaaagccaaatctctacgacgattgtcggcatagctcttctgtcgtgactgagcaacgtgcaacctttattggataatcttcactttttcttctgcctgtcgcaatatgtctgtcccgaagacttgacgttcaccggtttgatcccaaaggagcggcgtacggcactttcgaccatataatgcttcatacggagccatttgcaaactagcttgataactattgttatatgagaattccgcgtacggcaaattcttatcccaacttccaccaaaatctagaacacaggctctcaacatatcttctaaaatttggtttactctttccgtctgaccatctgtttgagggtgataagcagtactgaaattcaaacgggtacccaattctaattgtaatttctgccagaacttcgaagtaaactggctacctctatctgacactatcttcttaggaacaccatgcaaacataccactctggccatgtataactctgcaagcttattccccgtataggttgttttgaccggtatgaagtgagcgacttttgtcaaccgatcaaccactacccaaatagaatcatgtcctgccgacgttctaggtagaccggttataaaatccattcctatttcttcccacttccactctggaatcttcaacggttgtaacagaccagctggtttctgatgttctgccttgacccgctgacatacatcacatagtgccacatattctgctatctcacgtcgcatactggcccaccagaattgttgctttaagtcttggtacatcttagtgcttctagggtgaatggaatacaaagtttcatgagcttccttcatgatagtatccttcaactccttcttttctgggacgcaaattctttctcctaaccacacagttgggctgcagg

SEQ ID NO: 39793 - DNA, 2402 bp, Oryza sativa
caacagtgttagttgttgccaaggaatgagccatcatacaacaatcttcaatgtacttaacaccctagttaaatgcagtttttactacttaaactatttcttagatgtacttaacaccctaaattattatttttctcaatttacccctcagatactaatatgactctcactccaaatgatatttctatttgagtgagtcaaaacggttctaaaaaataataaataatatgtgatgtgagagatattattgtttaaatattagaattataaaagtttacctgtactaagcttgctactatgtatctatgtatatttgtatagacaaagaaaaacacttttagcacttgtgttaacttgtgaccatgcatagtatcttttaacaaagatactatgtatggacaaagataccatatatacaaagatacatagtagcaaacttaatacaagtaaacttttaggattctaatatttaaacaataatatctctcacatcatatattgttttttagaaccgttttcaccataatactttaaaacgacgttacagcgagacaatagtcctgttactatatgatgatcgagacaaaaattcttttataatgttattactgtggaaagtagtcgtgttaccgcacattgattgtcccattactacgccgttctagatagacgagaacttaaaaaaaagtagatctcaatctttagagggcaatatctctcacattatatagtatttttctaatctgtctgtaccatgatgtttgtaaaaaagtgcttaacaaaactagatatatcatgactaattttcgatgttgttactgcgagaaagttatcctgttactgcacgatgaccgtcatgttactgcggaattcctgcgagacgtgaacatcaaagtggttggcggggagggagtgaatgtgcgtgtttgacgtgggtttgaccggcgggatggggtcacacgcgccaccaatttcctggcgcgcctccgcccgtcctgtccttgttttccgttttttttgccagcgaattttctagcgcttctaaccgccccctgccaccgttccccatcccctgcctgcatgtagattgaggtggtgtttagatccagggacttaaatttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctgagtaaaaaatttactcgtgaaataaatccacatatggaatatttcttgttaaaatttcacttgtagtgtagtttcaagttatcgtacactcttaggttagagttaaaaaataacccatagacatcggtgcagtaagtttgaacatagagtgttttgtgatgagtaaaattttaatttaaaggttatttgatgatattttaatcgtggccggccctgattttccggttttttgggtccacctgcagctttccacttctctcccctgtggtgcaccgctcctatagagagttaaaaaattactcatctctgtcatctattctcagttctaattgagttgtcctcctgaacacagagtaaaagaattattgtgccttcttaggaaagaaatcgacgtctctgcctcagtgaaaaaattacgttgtttaaccagtatatatataaatggtagttttatcaaggtatacatggcgagacaggcgatgcgcgccagctaaaccgtggcgccactcagcgagagcccgcatccccagcacagacccgccaccccatccccatcctgcaggtgcaaacagagtaaaaaaattaccgtggggcaaatcagttacagtggttggtttatgagagaaacacgtgattatcgaccaccctgcccccccccgcaacagacaactgagtaaaaaaattactcattatgagatttgacttggagcgggcgtaattgaagttaaaaaattactcataggggttgattgccgtggtacgtttaaatgaaatatacacgtgacaggcgatccttccagtgaaaaaatcttcttgccgttggtgaaatctttactaatgggtatttttgttcggtatatgatagtaaatttttaactaatcaatatttcttctgtaaacgtaatatccagagcaatttattaactcacaaggattcttttgctgcacagtttgcgagtaaaattttaactcata

SEQ ID NO: 39794 - DNA, 2351 bp, Oryza sativa
aagactggcgaacaccgttcgtgaagtacctcaagaatggttggctcctagaggatgaagtagaagcgaagcgcctacagctcagagccacaagatacaaactcagggcagttgtatcgctctggggtgctccaacgcttgcttcgctgcatatcctttgctaaaggcgaggaaatagcgaaagaaatacactaggggctgtgcagtgcgcatcaagccgcaagaacggttgcctccaaagttttttgccagagtgtatattggcccactgtgctaaaagtttgtgtgtgtcacgaccgaaaataacccaacgggtgttccttacgtgagtgcattattccttgtcccaggaggcaaggtacaccaaaagttgatacagttcagagttcaacaagcggaagcgtaaatagttaatttattacatgggcggcgaaggcccagcacacacaaagacaaacgggaaacagcagaagactagggcgacgaccacaggcgcttgacggtaggcacgagctagacaccaaagccttcatcttccagggactcctcttctgggtttgggaaaaattgagcaagactgagtacaaccaccgtactcaacaatacacacccataagtgcagaataaatgaaagggagtacaagggggttataatataaagggttagggtttgcagtaaacagcattaaaagacacttagttgctcgaagctattttgtaaacacgattctagagctatacaatattattaatcaaggccgtggacccacacgaacctgccttaacccaaggcctacgatgattcagaccgaactggcaacccgaccctgggtcccagctcgtcccaagccaacccaggccaattattccacattttagttgttaagcaggttttaagaattaaaacactaacttgggtacattgctcggcttgcccataaccgagggcgcggcaattcgaatagattgtactctgatcagaggtgtacatctttacccacaagacacatcttcctcacgtgtaaccacgtgccgcagaccaccacggtatacggacggaagacgtgacatagtttccaacccatcctagccatagacaagaataccgacccaaccccacctacggctggaacccctgggacaggtaggcaggactgagccccgagcagcaggacaccggccctgtgccatgacatctcgactaccgggccacagctcatgtagccttcatttgtcctagagatgtccatcgatccccgacttcgtccatctccatctgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcgtaaaaccattttggggattttgaatagagggggaggtgtgaatccaattccacaataatccaacaattccatagtgtccaggtgataagagtattcccaaggtctagagttgtaaaaccacctaatgttgcctaattaaccagtgaagcatctacctaaaatcatactagtggtaccatgagtagagtgtccactagttggggttttgtttaatctagggtgaacaaggtaataataacaataacaataataataaggtcataataaaggtaaataggcatggctaaataaaacagtgataacgcgggaatttaaataaagcggtaatgcaataatttaaatcaaaataattttataaactgggattcaatatgttcaaggacgatgtgacttgccttgctcgctttcccaaacgtcggcttcaacctccacgaagagcggatctttcgaagctgcagcgtctacacgaccaacagaaaagaaaaggactttactctaataaactccatataacaagcagaaacaaagcacaaaaatgggttcttgacttcttaaggaaaaattagagacttgaacggtccaattccgagttcaaatggccaagttatagtcatttgaagtttatatgctctttaaatgaatatttgcgaatttcttcatttaaattttaatttaaaaagggtttattgcgtcagccgaggggagggggcacgcggaccgggtccacgggagtggggcccacgcggctgacggccgggccccacgcggcagccactcggcgcgcccgagggcggccaagcctgtgcagccggcgggaggcggcgcgcccgcgccccgatggtcgccccgggtgaccaccggcgcggcggagcggcggccgagagaggggaagggaagggggaaaagaagcggcagtccacg

SEQ ID NO: 39795 - DNA, 12946 bp, Oryza sativa
attccccccttttgattgcacgcggggaggacgggggcggccggattcccggcgccggcgttagggcgcgggcgagacggcgggagcggcgggaggaaggggatgacgggtgggccccacccgtcagcgagggtggcgggcgggcccgcccgtcagtggcgcgcgcgcggggagaggccggatgggccgcggggagaggagagggagggggaaggggatgggccgagccggcccaagagggagagggagggaaaggggacttttcagagtttttctttttataaaatcattttaactttgtttatttcttaataattattatttgtgctctgaaaattccactaaaatttatttacgcattttaggcttttaggaaatatacaaaaatcctctaagccttatttgacttttaactttgcacattttaattgttggaggctttcacacggattttaattattctaggcaccatttagaggatatattttagggtcgttttgggacgtgacagtgtggagcaagccaagaaatgcaaaagctgccagcggcatggccgaagccagacagcaccccagtacgagctgtagcctatcgcagtagtctggccttacgccagatgggggttggacatcattggccctttcccggtggcacgaaatgggtacaagtttgcaattgtagcaattgaatacttctctcgttggatcgaagccgaatcgcttggtgcgatcacttcggcagctgtataaaaatttgtgtggaagaacatcgtttgccatttcggagtgccgaaagaattcatcactgacaatggcaagcagtttgattctgaaagtttagagagatgtgcgaaggcccagacctgcaaatcaagttcgcttctgtcgcacacccacaatcgaacggggcagtcgaatgagcaaatggcaagatccttgaggcgctcaagaagaggcttgaaggggcggtgaagggcaaatggccggacgaaatgttatctgttctttgggcccttcggacgacccccacaaggccaaccaagtttagcctgttcatgctcctttatggtgacgaagcaatgaccccaacagagttagaggctaactcaccaagggtaatgttttctgaaggagaagatgggcgcgaggtgttgctcgaactcctcgaaagggtgagagtcgaagcactagaacacatgcgcaaatatgccaagagcactttggcaccttacaacaaaaaggttcaaccgatagagctgctgcctggctaaggaagaaggcgaacccaatggcggttggaaagcttgaatcgaagtgggaagggccatacctcatcaagaacaggtccaggacgggctcttttcgcttggcgacgctggaaggcgaagagttcgaccactcctggaacgctgcttctcttaagcgtttctatgtctagaaggggtggcaccccattcgccaacttgtaaaaatgtacatactattatgtaggcccttcggcacaaaaatacaaaaaaagaggaaaataaaaaaaggaaaaaaactggatgtagggctattatccatcctggaggcccgaaccagtatataatccatgtgtctttcacctttttacttgtgtaaatgataattcgtggaaaaaccctaaggcaaacacctgataagcgaaagcgccaggggggcgaaatgaatcgaccgaagcatcgctcgctgaacattgaaaccgcaacatcttgtttcgggaaataaataaccgaacacagtcatattcgatctatgtgaaaaacacgagcatttctttagcgcggaatactacagatcgaaaacggaagtaggaagctgaaaagtcagcagacatatttcgctaatatacgcaagggggccgacatatttcgacctaacaaaatcatgaaaggtgactatgcgtacaatagcgaaaaggaaataaaacacatcttcattaacttcgaaaaaaaatataggccatacaacatggtacaggcgaaagaaggtaacgggctttacagcctaacttacaaaaaaattacatctccacccccaaaacaccctccacgccctaaggtatgatctggcgaacttggttcgtcatcactactaatattatacactaccctaagaggagaagggggcgagacataaactagaccgtaacggcgttgggcgatcgcttcctgacgatcagtcctccgatgatttcaccaaaagcgagccatgtcctcccgatgctccacatggacacggtcgtagtcgtccatggttcgcccggggtgtgcccgcatccagctggaaactttcaaaaccttgtaactattgccatttattatcatctcgcaacatgaatacttaaatttcagcaagccttcaactgtgatgaatttctcattctttttacgccaatctctgaaaggaagccgaacacacaatttctagtgaagaccctgctaaaacaacataaaaaggggcaaatgggaaagcacaaggttaaaagagggcgaagctcataaagcgggcaaaaagtgtagcccctattcgtgtacaaaatgatgcaaccatacatatcaaagccctaaaaacgggataattggcgaaacttggttcatctattccatataaaaaaggccattttcggctacagtacaaaagggggaaacatcggccaaatttacatcgttcgccttccgtggccaacgcaaaaaatctaaaaatctaaagagcgggcggagggcctcacacctctgggtgattatggccgatgtctaccccagcgcccgcatctgccccacctccttcgcccgctgcctcctcgccttgatccgccgcctctgcctttgccaagtgctcgagcaggcgcgccttggcagtagatcagccgtccatttgccagaattgtttgcgccaagcacgaagtgcggccgaaagatcctgacaactgacttcccaatcccccttcaccaacttggggaactcggcgatatgctcgcacccattttgttgtagcaggcccatggtaaaggccgctaacacacgcgcgtagcaatcgccgtatgcagtggtgcaatcagagaccacaccactggcctattgagtccactccgagaagtcaaaggcagaagcatcttcgtcggggactcctcgcaccttcgcccacatgtcggtaagggcaaggcaaagcgtgcggcacacggtctttgcggacttagtggtcttcaccatctcccgcgcgaaccgttgtgcgtctctcttagcggctgcttctaccttgctgacctctgacgaagagcctccatcttcggctcggtaaggttatagtaatcagtcaaggcggtggactaatctcgttcttttttaagctcagccttgaggcgctcgatctcggccttcgctcgctccccttctccagctcaacttggagctgcttattctcagtcttcgtctccttaagggtgttggctaggttttccatttctagccccttgcggcccagttcttcatccttagcccgaagacgacttttaaagctgtcaaggcgagccctcacggttcgctcggtcgaacaatgagctgcgggtatctaaaaaaaagggggggctaaaatgaagaaaattagcataagttgtggaaaagcaacatttaaagcgggcgaacgacatacccagacggctaagcttttgacagcggtacagccctcgttgaactcgttcaactcagtgaacaggctcggacttccagccggagaaacgagatgacttaccccctcgatgaagggggtaagatccacccgggtctcgaaatcccaagggacgaagcagggcgccgtgagcgaatactctgaagccgacgtctcaacggccgccttcttcccgttttggatggccagcggtgaagtaggtggactgtgcggagggctcccgaagagcctggcagcagccttcacaacccggtcagcagaacctgaagtaccagctgcagcgctccctcccgcttcgcccgtgtcggtcgcagcatcgggagcggtcgaaagatcttggctccacccagcggccgaagtagaggtctcatccgaagactcgtcatcactgaaaacacaggcgacatcgacgaaccccttttttttggaggttttcttaactggccctcccttcaccaccttgcccgccgcaatcgaaaccaatgcctttgccctatgcaaatccttccggcgaaggggggagctgttcgactccaccccagttacgacgtggtctgggcttggggttggggtgtagccgtgcgtctcggtgcggttgtcggcgggctcattcgcggccggttcgaccgcaactttcgcctcctcctcatcctccccctcctcttcatcgtactggtcatcgacagtgtcctcatcgtcggcatcagagtcagtggaggcaggggcctttcgcttctgaggggccgattttgcttgctcgcgtttgcgcttcttcgaggtcccttcatcaccatcggccttggagggcttctcccgagaggggagatcgccatcatgcacacgattcgctcggccagccgccttccgtgtaagcagctggctgtattctgtgatcgacacatcgccgaccatcttccgagcttcggtttcagcctgaacaagagttagcactgcaaaaatgaaacgtctcatcatactggccgcaaagcagggaaaaaagagcgaaatgcaactgcatgtgggaaagcaaaagcctacctttcgccccctttggcatgacgagcttcggtaggccatcgacctcctcgtcctggttcacctcgacttgccatgactaggagagaggaaagatccgaagcatgcaaaactcttccaccaggtcacggcagctaaggtggaggcagaccttgcgaagcagggcgaaatgggcttccatagctccatcagtggcaaccctgggtttcctgtttggcacgatcgccctgcaccgccatcggagagctttcgccgcgtcggacctggcctcgaaggggatggagtggtataatcacttcgacatccagtggcaatcccacttggacatagaagcgctgtaatgccctgatattcgtttgggattaaaaatcgtttaataatgcattttctagaaattaaataaaagttcaagcaaatttaatcaagtgaattattgggagaattaaaattttccctcaaaaatcattggccgagaatattttacaatattctttgcgccctaaaataccctccggattttttcgtgaatttttggagctcaagaaataattttaaagtcatgaagttcattaaaataatttaaataaaaagaaaacaaattaaaaacctcctctctccctttgggccgctcccggcccaatccccctttccctcccgcggcccgtgcccctctctcccttcctcggccggcctcccctctcctctcttgggccgttggcccgtttccccttctcctcgcgcaaagtctaaataaccccctgaatcccctccccctttcgccgacaggtgggcccgaagaccccacttgtcaggtccatccccttccttcggccggccacaaccgccgccatggccatccgttgccgcccacgtcgccctcgatttcggcctctcccgctcgcaccctcgcgccataaccgagtgaaatcggtccccctccacgtcctccaccatctccacgactttcccccaaaaaaagggcgcctgtttgacctccccacgaactccacgtcaccgcccactccatcgcttcccgccggcgagcgctgcttcgcccggccacgtctctgctccatttcccccttccaccacgaaaaccccctcctcaccgtgccaccctagcgccgtcgtcgccctctaactccggcggtcgtgcgtcgacgttccgggcctccttaggcctcgggcccctcctcctcagctccgcaatctcaagggaaggcctggcatcccctcatcaaagctcttcgtcgccagcatccattccccgctgtgagaggtgagcttctcccctcgttgccggcttccggctgagttttcacgtcgcctcgcgcctcctcccttttccctaacccttccaccgcgctccccaggtcgccatcctccacctcgcgtccgcggtacgccgtcggaccgccaccgccgcccgttgccctcgccaccttggcgcatggtgagtgctccctcctcctacccttttccccctccgctgcctcccgtgtccggtgccgcgtcgcgccaccatcgtcagcggccgtctggctggcgagccagccagcctcccccctcccttgccgattgggggtgccgcccgtggaccgcccgtggtcctggtccacggcgcacccgaggccgcgtggacgcggtccaccgtgtgcctgccccttgacccgctgacgtgtggggcccgcctgtcggcgccggcctcttagatgacgtcagcgcttaatcttttcctttgagaaaataattaattattgcgcaataattcgataataattctagaaattcatttaaatggctcaaaacttctaaaattcatatctaattcatccgaactccgaattcggccattcaacttgcaattttcatctaaaattgagatctacatgtttgtttactttttatgtactgtttccatagtttttattagagtttttcctcgttttgcgtgccagcgtgtagaatccgtcgtttcggaagtccacagtcacaaggaaaagagtttggaagattgtttgaagaagcaaggcaagtaacacattccccttgagcatgttgatcccaatttataaatgttttgccgtttgcaaataaatatgcatgttttgctaattacatgggatcagggtttacctatctgcctgcttgtgccatgtttacttgatatctgttctttgtcaaccgtgggtgataattcgactagcttgtgttacttatgttaacctagctataactatattcttagccatgcttaattgtcactagctcagttgatgggataattatagttttagacctgttagtatcaagacgagctgcttgctcgagacatctggccatgtttcatggtcataattatccaactaaaatgcgactgaatggtgggctgtgggtgcatggttttgctagtcgcacccatggcaattaaggaccggttcacgggaaaccctggaagacttatagtgcttaccacaagcgagagtgggtaactgcttgatctaaagtataactcgaccctttcctaggcaccagtggcgagggtgggcatgatggagttgggtcggctggggtatccggttgtccagctgccggattcaccgcggcgcacgaggggactgcctacctccgggatagggggtgggggtgaaaccttagcgtggtgtggatggttaggggagggttatgcggagggtcttatcacaatcactcgacatggtgacgtatctgcgcggacgcggtgacatgccggtagattgtgtcttgtgggtacagttgtgcacctctggccagagtaaaactattcgaatagccgtgcccgcggttatgggcgattgaccagattcaccgtgattagtcttacacttaataaatcaacccaatgcactgtagttcatgtgggttggttgggcctgttcaacgtggtgtagtgttgatcagtggagatttaatattaccttaattattcaacagttttactgttttgctcaacaaaatgttttacaactgcctttatgcaaatagccacaaatcatccttgcgttccccttgcacgtctgcatcattggtgtggcttgctgagtacggtggttgtactcagccttgctattattcccccttttaagaagtgtatagcttctgagccgaagacgaagttagaagaccaaggctcagacaccagttgagttttgcctgtggagtggagctgaagccccgctagtatcgctttttccgctgctactgctttcttttcggtgtgaggactaagtgcctcttctataagtattttacgctttatttacatttggaactgtaaattacttgtcgttttgtgtaccctggctggtcctgtacagggatttaatacacaaaatagtctggaaatttgtgctaaatatctaggcgtgacaagcgttaaccggccagagatcggagcgctcgggacgaacattgaagtttgttaacagtgaaatttgttaatcgacaaagacgtcattggcttagaatcattatcggctgcagcatctgctcgggacgaacattgaagttctgttaatagtgaaatttggtaatcggcaaagacatcatcggctgcagcatctcggaatcagtcgatgagagttatcaagtcgccaatagtcgcattcctgctatattcggttaaggaaatcaatctactaaaggaagcttatctctaagtgaccgagtttaaagaggatgcggcatggcagtttatctattaattaggaatagtttgttagtttccttttatctttaggaaggtgtgtttagtgtccgataaggactttatgttttccttttacctttaggttagtttctttcttgtccgacaaggacttgtatcaacccatgggtataaatatgtacacccgggctctatgtaatctatcgtcacgatcaatacaattcggcgcatcgccaccttttatcttttctactttattttatcgtccggcgggacttgacacctgatgcggggctgcatcggtgttcgatctccggcgaaggggtaagtccaatgttccgtcgccccaggcaattgtatcgtttacgtcggcgtcgttcaaggctgcatcagtacattcgacctcttggattgctctagtttggatgatatatttgcctacctatttattatgtctctgttaatctagtcttagcatatcaatttagctctatcggctgtctctcgctttagggtttctgccggtatcggctaaatcgcgttgctagattagattagcctaggcatctaccaccctgaaaatcagtcaacggcttgattgtctagatattgtgtttcttttcatacctagtgctgcatcagttaagtttgatctactaagtcgtgcttagaaccataatctctagcctgctttttgattgccaataagggtttcatcggggtttcagctggtgagttatttgaacgttgcatcggctcataaggattgcatatacatataagttggatttagccgatgacaataaaggtttcactgtttaatctaatcttgtggatttcatgacatcggaccaccagccgatgtgtgctttaactttcggatcaatacttgttctactatatcatattgttagccgatggtttctactggattatattgctatattacatcatcatcagccgattgcctttatatcattatctaaattggacatatagccgattgcttaaaccctatcgctatctgctggtatcagcatcgtctattatcggctatcggctagaactactctatcggcttgtcagccgatcggctgttttgatctactatttgcatatcttgtcagttgcaggatcaaactgactggcacgcccgcatctcatcatatttggacctgcactggagctaagcagatctcccaggccgatgtgttcgattttctcatcaacaagatcacgctcccgaaccctgttttcttcgtccctgctggggtgaccacagtctttgagtttacagtggcgtagaaaatggtgccgaaaagctcgacgctcgattcaaacccagtagttcggcacgcccagtcaatcatgctaccagcaacgattcaagccaaatacgtcaagtgtacttaggtgaagcctccatgacgaaggctacggaacgaagacgacgaaggccaaaaagccgcgtgggtacctcgtaggaccagccatgtgaggcgaagggtgtagacttcaccttgacaagctcgataccgaggaggtccaataggtcatccggtgcacggcgaagggtatgggccgaaggaaggagttttcgcctcgacgagttcggcatcaagcaagcccaatgggccatcctggcatcttaggcctattcaccaataagctaacattcgccagtcggctcatggaaggcccatgtatccaaattacactgtgtacccacataaatgtccctttcataagggcaaccgtgtaaattcccctgtaaaacctaaaccctaatgcgggaacctgtaataggattataaatagccccctagggccatgtaaagggggatcccaagaaaaattttaatcaattagtatatttactatttccaatactgttgagtaaccacgtccttcgacgtacgcggttgtcacttcgacaacattatttgtgtgccgagaagaaaatcaagccacaagaattaaattgtgggtagattaaaagaaaggatttgaatatttggatcaagaatcaaaggataggttaacaaataattccaataacatcggaattgcaagggtttggtttgaaggattttccttggaccacaatttataaaataaaaagggtttacaaactaaatttgaataaaatgaattttgccaaaagaaggttttaaattaaaaccaaatcaggaaatatcccaagataaattttaaaggagaaccacaaaagaaatacaagagattttatgcaagtcagtttttaggaggtctctctaattatattttcatatgtttagaaggttaataagaacgtaagaaccggcatgatgcataattagaaaatagctaatttttagtacgttacacccagccaacttggccgactcagtttccatccaaccgagccgctgcatgctgcgtgttgcacagaacgcactcatttttcaatttctcactccattatccttcgtgaacaccggcatttacacgcacacttcgtgaagcccgttgtgaagatttttttcaaacaatgtctaccccccgtgtgccatttcgtatccaatttcgtcacccggaacctttgccatttggaccttcaattttccctgagtctagtttcgaacccccccggtgaccgaagttgacctcccagaatcctgactttagtcaccttgtcacatggtatcccgaccgcactagaccttttttcctccctgagcatattcccggtcctcaccattgactaatgctgatctcaagtcacctgcacacaatcagacaaaacaactgttcctgggcacatatatcacaacctgacccacattaatcacacacactcacatcaacatccacacatcttttcattgattaaattattttacaaagccaattgttcatcacaaatattaattatgacaatgatttcacatttgggagatcaaccaatgaatagtataacaagatgatgaatagtgaaagaggaaaagggtgagcaagggtgatggatagagaatggataaataaggaatatttagaccaatggattttttttggggattttatacccttctggcttctggttgaaatacctagagtattcatagaaaaaacaaaatagagtcctaagaatccaataaatattccacactttgagtgatcgagagaatcaattgaggagcaaagcaaagttataattttgtgttacttaaaaaaaaccccaagttgttcttcatgaaaagttagggtgacttgagtcaagattgttccatttctcaattgctcaggatcgcatggtagacactacaaagacccacaagtacatgtatggctttgaataatttgtttgcataattattagtaaggaagtcataaccctattgtagagtccatagccttcactcgggacgagcaaaggttaagtgtgggggtgttgttgatggtccttaaatcataatatttgatcgtcaatacttacataaaataaaattaaattatggtatccaacttagtggtagggattattactaatcatttccactagtattggtgaaatatgtgtatgcaagtattttgagaagaaaaaacatccgtcaaatgacaaactgcacctccgcgcattcaggacacatttacacatattggaggccctataagtcaattaaacaactctaaatgggcccaaccatcatgccaatgggctgagggcctcaaaattagtgtccacgaggaaaaatgggctgaacagagccgtcccgggttcggccgaacccttttggtggccgttgatctccaaattttacatggacggccttgatcacattctaatggcggttccggggtagtttgctcatttcgcatacgctgtaaccgtcatacctgcctataaaagaaggagctcactttcatttccaacacacaactttgagctgaattataagaggctctattgtatcttttgtacattagaatagggtagagagtgaggggaaactctggagaagtgcccgaaagtttggtgctcatccgacttctacctcgacgagtgtagcttcctaggaggaattctagaagagtaccggagctatcggtacactctgttccgggtctggagaacttcttctataaagtaagcatttgtgttcctttcttatgttatttaattactttgcttaagtaagatagatttccatctttgtgggttcattgtttagtatttatactaagtgctctagtactaggactctggataaagaagcaagttcatgcgtaattattagagtagtaattaataacttaggcgtggtgtctaggttagagattacctttgtttgttgtgtatcccacggattcgtcagaggtagacggcaggtggtgacaatcctagtaatcctctgttgacggtcattatcgatcagtttcgactgtcaatattactaaaataggagagaactagtgatgcttgcaatgcataagtatgttagaatagggctgcaggaa

SEQ ID NO: 39796 - DNA, 1049 bp, Oryza sativa
cagaagattgtagacactccgctcagtcctgaattaagaatgcaaatgaaaatatcagtattcccatttaagtttaccactatttctgttaaatgtatgtaatctgtatacttatagtaaatttagtcgtacttttctgatattgtaaccattttcttcagtgcaatgtcacatggaaggcgaggatcatctttatagtttgaaacttcagattccaattttttcaggtcttggtagccaaaagctgcctctcgtagagtatctgccttcctttctggccaatcaaaatgcttcagcactgctctctcatccaccttcaagtaatgcaattacatgagtgaaaaaacaaagtaaattgctcagagtatagtgctactgaacattcataccaggaaaccaagctcatcatcaagccatttcacaaatgcaaccacatcttctatatctttgtaagctgcattggtcacctccttgatcaatgatttcacaaattcacctgagtctcaacatcagccttgatctgaaaatgaacaaagagtaaagtaaatagccatacatcagtgcgagaaccagctagcttttcattggtatctacaattctacatatgtccaataatctgagcagaatattctacttacagcctgcaaatgcgaagaacggttctcaatttcaccaatcatgctactccgcacatttgctgagttagcagtttcacagattccactcccagaagtatccttttttgagtcccttctcataagtgaatggtaaagctctgcaacttgtggtgccctcttcatgacccagcgtttcttgtggagaactttggaggcggtggcggtggcggaggctttggtggattcgcagctgatccatttgatggaccagaatgtggcacagaaactgaaggtctaggaggagggtttggaatacgcaaggcacgcttttcaacatccatactttgagacttgcatacttctgacttgccaagaagaaatcttgagctttcagatcgaccaaaatcatacttatccacaagaagttcacg

SEQ ID NO: 39797 - DNA, 7069 bp, Oryza sativa
  unsure (1)..(7069): unsure at all n locations
gcggtaagatttttttttttttgttttggggatttgtagtgatggttttctaagagaaatcgatgcgctgtatcggcatgtcgctcctggatattttttttaattcattctgtgtaatgtaatgcttggcctttcaggtgcccgttccagtgttgtaagagctgctgctacaaggctcagaatccttgccacattcatggtatgtatgtgtaatgctagtaccatttgagtatatatctgctcctgtgcaacgaattgtgcttgtaattagttgtattaagccgctgactgaatacctgtacatccacttattcgatcatttgatccaaccaatttttttgacaggcgtgatttggtcttgcagttttacctttctgtggactattactcattgtttggcagttggagatttacctgttttattgtttacaatttattctgggaatgcttatcacgtttagctacttagcatcaaagctaggacaattgcttgtaagtggggtagtgggatacttcaattatggaggaattttaaggtacggtcactttcttatggaccgttgatcaaacttataatgataagatttgaacatgctcatttcaacatctaaaagggaaactacaggtatagaaatgcattattataacgttttgttccattttggatttttatttttctcagtactgacaatgttgtcgcgtgcaattgaacaacattaacaaccaattaatgcttctccatcaggctgctcaaatagtgggatgatgttggtcaacagaatgtttgatcttcatattttgtagggtttagggaaggaaatgagggaaagggtgtagagaagaatttcagtatgtttgtcaggttggatcaaacagcggcagttttcttcaggactgtagtttaggatgtgggatgtgaccctgaacctgaaccaatgaatctaggtcgatgaacaagctacttggtctgtcaaaataaattatatggtataaaataaattactactactttatggtatgtcatacacaaacacccaaggaagataatcagttttacactacaaggaagggaacacgaaatgagacaaataaatatttgggttgtagagacatcagacatgtgacccatccagccacacaattctgttgctctatctcctcagttctaacataatctcatatcctcgccatcgatgcagtttcaggctttcagcagacacccttgccaccatcttttataagcaaatgccctagtcttctccaaacctcctcccctcttctgctgacttgtcttgcatcggcgacagagaaccttgagggccacgagatcacagggtgtagcaacttggtccccatcttctactgctggattatcccctgcagtgtgccaccacacaccttcacacatgccagcaccacctgaatggcgaggaacctggccactgttgccccaatcaaaatcaggtaggtttctgtacctgatttggatgcctctaataaccaaacacggcctggaggtgacctgcatcaactgtgaccagcaaactgggacaggttcaggaacgacagtattgtatcatgatctagtgactgtggtaatgactcacttgagtgccatgagcccatgacaaccttggtttctaaaattaaattgacccttgccatagcattattattgccttggtctctaaaatcaaatggaccttcagaaatgtgttttggagggataatggcctcatgggtgtaccttgaagggctcttatttgttgtattgtacctcttaaatctgctttcgaattatattcatctctctctatactcttcattatatggcactgaatgttgctgtcaaaatttattctctctggtgtataagggattagcaacatttggttacatacaagaaattttgatttatggctatgatgttatgcctgtctacatattttctgtgatttgtctggactctgtatttttctaatatttttgaaaaagccactaaccacctcttatcaccaatcatgacagttctgaaacagaacaacacattgccagataagccacctctgtcaacagctcctctgtcagagcaaccatcagctaatataccttcaaccgggtaaccttctgaaccaggagttttatcttatggtaaaatctgtcattatttctgatgcttgcttgaaatttgctgctgcagttcatcaaggttggcttctctgcaaaggcttccccatcatttcctgaattccctccgaacaaagaagtcccttgccaaaaaggttctagctgttccattgtttgcgattgttcattgtttagtttcgtttcttttcttccatgatgagaccatgattaaggagttaagcatttatattacaggatgttatgggcataaacaagtggaggtttgagaagctaaaagaacatatccaaggagacatcgatgctgaaaatgaagcgtatgaaaggtatacacagaatgttgggttactggaggaaacgttcggtcttacagaagatgctgctgatgaacctgaacctgaagcaacttcttcagaagagaggatggaaacattggtttccgaggcaaaggtgaggctgaaatcggactctgcaaatgcagatggctccgggacaggattgctactattttggaccagaagataaaggaattgctagaaagcaaaagcacctacgaggatgacaaccctcctgaccaaaatccagatgaccatccaaagcctgtcaagttatccatcaagcagcaaatggagagaggtgcaaagatgactgagctccttgctaagatgataagagcacagagtgaggttgatctgaagatctgctctggtattgcggcgcagctgtttggaaagaagaatgaattgagcaaccaagaatctgttgcatctgttacgattccttattcttttccaaagctctggactagggtggagattgatgatgccatgatgtgtaagatcaacggcgaattttcgtcttcgacagaggtaatgcagctataaacctggaattaatctgttcagacccaatgcttgtctacactagaagaacatggttgaaccacagcttcttttctgcttaacctactgttcgtttaatgtaagcaattgtaattgttttcatcagagacaaaaaccatgagagcaacacagtagtttgaccagtttgtattaaaccatgacatgagagcaatacagtagtatagttgtttttctttattgtctatgagacatcgcttgtctccgccggcggcggcggcggcggcggcggcggctgtggcatcttgttcgtctttgagacgcgtggctcgccgaagatcgtgactatacactcgatcgagaggaagtcgccggcgaggaacgccggcgtctcgacgaactgcacgccggagcagctgaactggccgttcctggtgtcgaacgccgccgtcttgtcctcgcggaggacgaggcgctcgccggtgacctggtcgacggccttgagctcgtagaccacggacgccgcggcgtcggcggtcatgagctcgaggaccaccgacggctggcggcacgccgcctcggcggcgctgtcgccgttggggtagtacctgacggcccagtcgtagccgccgacggcgaaggttcccgaccggacgaactcgccggcggcggtggtcctcttgacgaggccgtgctggtagacggtgaacgcgtgcgcgccctgcgctatcggcgtcgtgcacgtcgacgccgtccatgtcatcgtcggcgtcggcggagagcagccgtggcgcggcgacggcggcggccgcgaagctgaggcgcaggcgcccattgcgcaatagcagatgagaacttggggagacgaagaagaccagcacgagcacgtacgccatgaaattggatcatacgataatatagtgttttagataggccctctcgaaggcctggattcgggttagacctgggccctgagaacattactaatccgtttcatgaaacacaaacagaaatataaacagattgtttttttagataatgattacacataaactcaaaacaaaacaagaaagaaacaaaagacagacagaaagattgcaagtcgaattcactcaaacatcggttgtggatttatggcagtgatcaatcaaaattttgatgagatatacgtgtctgttcacggccactcacgtatatatacattcgtctggtgtgcatgcagtgtacatcctgttgtttacagagcgtagaacagaaatgtgtcaaccaaaacaagaagaagcctccatatcttgaaatgtcgtacgagatgtgagcagatgagttacaacattgcggctgaccaactccggaacacaaatcatatgaacggctatgtatcttcaagttgctcagctagcctagttgtcaatactgaatacttccttcggttataaatacttgttgtttatgtcatgaatcggataaaactttataattctaatcaatattttttaaatggttaattagcttaaaaacaaaaaaaatggtatacatatatttgcatcaaaaagcaatatcattatatcataaacttattaaatttgataaactgataaacttgatggtcgaaattttaaatttttgatcaaatcttatccttaacttcaaacatttcagatttttgccaagatgttgaggatcgcgggaagtagcaagactgtgatcattatctccaaactagaatcagtcaatggtttatggttacatgctggcattttgatgcgaatttgcaaggaaattcaagaaaattagtccttgtctcttgcatagatattgggaataacagaataagaggtcatcttcctgcctattatctcccacaaatccaccatgaaagaagggcaagatagcttcatcttctcgtacccttggctttccatgacgccttccatcttcttggaggtggccaagaactcgatgcacgcctccttgagcttctggcaatggtgctgatccgccattgccagcgtcgccgcgacggtgtccacggcgatgctcttgcagagcatgagctcgcagatcagcttcagcctctcgacgtcgtaccggtcggcggcctcgagaaggtgcatgatcatctgcgccttgtcgtcgtcgtcgtcgtcgaggtcgtccatggcggcggtcgtgtcggtgtagatgaagtggaggagagcccggaacaccgccggctcgacgctgtcgatggcgacgcggccggcgttcgcgtccgtggactccttcattggcccgtagagcgccgccttgaacaccggcgaacgcatggcgagcaccgcccggtgcgcggcgaactcctcgccccgcacgacgagcgtcacgtcggcggtgcccttgtcgccgaggagcccggcgaggtggccgaggatgttcgacggcggatggtcgagctccggcgcgtcgccggcggtgacgacggggtccaggacgacgttgacgacgcactcgatggtgaggcggtcgtcgcggacgaaccccatctcctccagctcgcgccgccgcatgaacctcaggtgcccccacgccgggaacgcctgggagaacacgcgcgacgtcgagccgtccatgggccagcgcacggaccgcggctcgccggtggccgggtggatcagcctgaggtcgtagaacgcgcgcgccaccgcgccgcctccgccgccgccagcggcggcggcggcgttcttgagctcgaggtagaccgagacgaagtccatgtcggcggccgtgacgccctccgggtagaacacgacggcccagtcgaacccgccgacggtgaaggtccccgacgccacgcggtggccgggcgcggcgcccttggtggcgccgtacccggcgacgcggaacctgtgccgcccctccaccgtcgccgtcgtgctcgtcgacgtcgtgcactccgtcgccatcgtgtgaactcttgttacgcgcacnnnnnntaatccgaatccaccgctaattttgtataaatttcgtgcaaatttacaaatcaagtccgaaacaaaatccatctctgttccctttccttgaacgtgtcggaccgaaactatgaagttgggccgcctaagtgggccgagatgtcagtcgggagaggaagagtttgatgggccgatgccgcggggaatatctcggtaaatattccaaaataaagaggcaattaatgaaaagattttttttcgaggtagtaatttaatgcaaagattttttttgggccgttaaatagcccacccggggcggcttctcctcccattcgcttccactcccacaccgatctagggtttctagggttttgggttgcggcggcggcggcggcgagagggcgagggcgaggtcgagatggcgtcggaagagggtaaggggacggtgaagnnnnnnnnnnnnnnnnnnnnnnnnnnnnnnnnnnnnnnnnnnnnnnnnggcgaggatctcttcgtccaccaatcctcgctcaagtccgacggctaccgcagcctcaacgacggcgacgtcgtcgagttctccgtcggatccggcaacgacggccgcaccaaggccgtggacgtcaccgcgccggggggcggggcgctcaccggcggatcccgtcccagcggcggcggggaccgcggctacggcgggggcggaggcggcggccgctacggcggtgaccgcggctacggcggcggtggcggcggctacggcgggggcgaccgcggctacggaggcggcggcgggtacggcggcggcggcggcggaggcagccgcgcgtgctacaagtgcggcgaggagggccacatggccagggactgctcccagggaggaggcggcggtggtggctacggtggtggtggcggcggctaccgcggcggtggtggtggcggcggcggcggcgggtgctacaactgcggcgagaccggccacatcgctcgcgagtgccccagcaagacctactaggcgctgctcgcggcgtcagatccagctccctcccatgatgcgttttgctccccctccctcactgaatcaccgagcagcgggtgatcagttctatcttattagta

SEQ ID NO: 39798 - DNA, 22429 bp, Oryza sativa
  unsure (1)..(22429): unsure at all n locations
cttgtagagtggtattcctgtatggtttatgaagttttatgcttgtgtttcagatggctaatcaagtatgcagttttatgcttgtgttgctgaagttttatgcttgtgtttcagatggctaatcaagtatgcagttttatgcttgttgctgaagttttcaagtatgcagttttattcttgtgttgcagatggctaatcaagtaatcagttactacttggtgtactgattacacaaaccaggggcgatatactgtatttcatcatgtggtagtggtacctgattgttttttgttgatcagacttgaagggttgtgtctaattgttctcttgttcagagtactcttgtctgttctgttgttcattcagacaatctgattgttgttttgtgcagagcctgctgttgtgttgtttctcttgttcattcagagaatctgattgttgttttgttcacaacttgtttgttgtgttgttcatccagaatttctgagtctgtttgttctgcttgttgtgcagaatctgcttgttctgctgttcattcagaaattttagtctgtttgttatgatgttcattcagaactttagtgcatgtttgtctgttgtttcattcagaattatcagaggggacaagtgcctgttgttcatccagaattttcagagcaaatcttgttctgtttcactagtaaaattacagagtgaatagttggacctgaactgcattagctttatttcttttcctgcaggaaaaaatatctacaaactcactcgtatctgaacatcaactaaactacaactgagctaggagtacctacaagtcagtaaaccttcacaaactatgaataattaagtggtgagtaaacaaacaaaaactgattacgaagattaagcgttcattgatagtaccagaagtaaaaataataagcacgctgttaatttgtttcactggtaaaaccacatagaaactcttgtatgaaaaatcgtccttttcttgtaggataaattatttacaaactcaggcatatcagaacatgaactaaactggttagtaaaaaaccacaaactaattcagaatatataaatgtccattggcagcatcagaagttagaaaaatcaagctcactgactaattaatatactcaacaagctactggggagacaaactactcgtgaggagtagtttttagaggattttgataaaggtatatcagaacatcaacaaaactgcaaaaaagctacctggtcagtaaacaaccacaaactactaattaagaagattagccacaaactgtagtaattaagaagattaagcgtctattgactctatcagaagttggaacaatcaaacactcttgagtctaactagtaacacagtttagtggacaaactaattaagaaaagattaagagtctatcgacagtagtagaagttgaaataacacaatcactctgaatctttcactaattaaacacagtttagtggattttgagtaagctgccgatctggtagaagaagtatttgaagagcgagatacagctgagctggtcaggatgccggcttatcaccacctcatcgttcatacccatggcgatgacgaactcgacgcaggcttccctgagcccgcggcagccatggcggtcggccaatgccaatgtgctcgccaccgtctgcgccgtcaggctcctcgcgagcatgtccgcgcagatgagcttcagcctgcccatgtcgtaccggtcggcggcgacgagcaggtggcgggcgagctctcgcctgtcgtcctcgtcggcgtcgaggtcgtccatggcggcgagcgtgtcggtgtagatgaagccgagaaggaccttgaacacggcgggctgcatgtcgccgaccttgatggcgccgccggcgttgttgcgcatcgggccgaacagctcggcggcgaagacggcggagcgcatggcgagcaccacccggtgcgcggcgaactgcactccccgcacgtcgaacgtgacgtcggcgtgggacttgaggtcgaggagccggccgaggtgcgccgcgaggtccggcggcgggacgtcggccgccgtcagcggcgcggcggcggacacccgcggcttcccgacgacgcgcacggcgcagtcgatggtgaggcggtcgcggcggacgtagttggcctggagcgcctgtatcgcctccaccttgacgccgtacatggcggcggaggaggagcggagtacggtgctgaacgtcctcggcgcggcgagcggcgggtgcacggacagcggccggccggagtcggcgcggacgaagcggaggtcgaaggtggcggcggcggcggcgcggtcggtcaggagctggacgtagacggcggcgtggtcgcggtcggcgtgcgtggcgccgcgcgggtagaagacgacggcccagtcgtagccgccgacggtgaaggcggccgaccggacgtactcgccggcggcgaggagcgccctcaggcggctgtacccgcggatcgcgaaccggtggtggccctccaccgtccccatcgtgcacgtcgacatggtgctcctcgtcgtcgacggcggcggcggctcttctccggcgtgatggccagccggcgccgcggaggacatcatcatcattaattacgtgatgcgtagctacgacgctgccggcggcgaggtttgcggcggcggcgatctgtgcgggtgcacgtgtggcggagatgtgtgtatgtattggtcgcgcacggtaagtacgtgtcggaacggaatttggaatagtgtcttggtaccctgcacgtcacaaatcacgatgagggaggccggatcggactttggaggcattggttactgggctgggccgaactgagtacggaagttttgggcccaattagtctcggctagttaatgtatagggagtgtctagcaaacaatgatttttggctagttaatgtatgatttttttgcaactcgtggaagttaaatttgatcagatttatcacatattaatctatcttgttaaattttattattttttttcataactatttggatgacatgcaaacgagtggatgtccccttgagagtaatagtttctcctcagcacggatatgattcatttagtctgatttgggttgaatttggctgatggaatttcaataaatgtgtccccgtatatttatcccaattataatcgaagtacattgtgtatttaacttattttcatcctaacaatggttccatatgaggatttgttaaacttaggagcttagagagtttctgttttgtattaaggccttgtttagatcacaaaaaattttagccaaaaacatcatatcaaatgtttggatatatgtatggagcattaaatgtgggaaacaaaacaaccaattgcacagtttgcatgtaaattgcgagacgaatcttttgagcctaattacgccatgatttgacagtgtgatgctatagtaaatattagctaatgatggattaattaggcttaataaattcgtttcgcagtttacaggcggaatctgtaatttgttttgttattagtctacgtttaatactttaaatgtgcgtccatatacttcaaaaattttacacccaaagaactaaaaacccactaaagagaaaaaaagggcgatcagttaacgaggaaagctgaccaaattaaaaccatagggaaaaccgataaactctgtagaaaggcgaaaattaaaaaagcatgcgatgtgagtcaacacaagtcatcattcccaactctatagaagtcatcatcgccacattaccaagatgagaacattcgagagttattgttatcgagcttgtcacaccttgtcaagtagttccgattccatcccgacacactctagtgtgccgtatgaactacgaagtaaacaacaaataccaacttaaaatttgcagcagatttgccatcatatatactttactctaactcagttgaacaaattaatccattttagaaaaaaaatgaattaaatcaaaagagcttgataaacccatcgctaattaagagatttgcttcagtccaacaaaaagtttctcgaggtactgttacctcacggagtcacggtactaaatcgtttccgatcattagatctagctaggcaagatgtgcattgttagatccaaagatcaaaaacgatttggtaccgtgaggtaccggtaccttaaagatactttttgttggaccgaaccaaatctcgctaattaatgttcatggctatatcaccctcaacattgcatgagcaatgttttaatatttactctcgacgtgatcggacgatcctttcccacatgtctgcgacgaccaacggacacgccctcttgagattaattgctccatgatctaacaatgtggtgctacagtaaacatttgctaatgatggattaattagatttaataaattcgtatcgcagtttataggcgaaatctgtaatttgttttgttattagtttacgtttaatactttaaatgtgtgtctgtatatccgatgtgacacccaaaacttttcacccctagatctaaacacagccttactctagacgtgataggacgatcctctcccacatgtctgcgacgagcaaagggcacgccctcttgaggttcttgtaaccatcactctccacgattcgcttgctatgagaatcgatgaactcgaggcaagcttccttgagctcgccgcagctatgctgttcggccaatgccatcgtgtcgatcaccgtctcgactccgaggcttcgccggagcacgcgctcgcagatcacccgcagcctctcgacggcgtatcggtcggcggcgacgagcaggtggcgtgccatgtcgattctgtcggtgtcgtcgtcgtcagcggcggcgaggccgaggtcgggtggcatgtcgtcggtgtagatgaaatggaggagggccttgaacacggccggctgcacgtcgacgatggcgatgacgtggtcggcgtccttctccttcatggcgccgtagagctccgccttgaacaccggcgaccgcgcggcgagcatcaggcggtgcgccgtgaacgtctccccctgcacggcgaacgtcacgtcggcgccctcggactccacctgcgccaccagctgccggagtatgttcgacggcgggacgtcgtccggcgcctcgcggcgccgcacggcggcgacgacggggtcgtggacgacgactcggacggcgcagtcgatgacgacgctgtcgccgcgcaggcacgcgggcgacgcctccagcttgctccgctccatgaacgcgcggcggccgaagcacgctgtgccgggattgctcgacgcgaacaccctgggcgcgccggaggcccgggcgacggcggcggcgcggccggtgtcctggtcgagcaggcggagctcgtagaacgcggtggccgtggcgcagcgggtgaccagcctgagcttgaccgagacgtgttcccggtcgccgccgccgccgccctggccctccgggtagaagcagatgcaccagtcgtagccgccgacggtgaaggtgccggagcgaatgcaccggccggcgccgccgcccttgcacaagctgtagccgtgaaatgtaaaccggtgcgttcctcttactgtctccatcttgctcatcgactccgtcgccgtcgtcgtcgtcgtctccatgggcattgctaatcagatcacttgctgctgtgagatcgatcgattcacgcgttgcgatgcaggtgtgggagagattaattattaattattaaggaaaccctagatcaacctatcacaatttgattttagcagcgccgtgagtactataaagagtgttgaataatatagggagatcgagagagttataccgaaaatattggacttattgacttgttgtattgaatcttagaggccggtatatataagagcatatatgtgacttagattttaagtaagtttagagatatagatagaaactaattacttttattcggtatgacaaacactatactagattttatttatatacggagtattaagtaggacctttgtcagacattataagacccggtcaaactctaattcctgagtagttacgctgtttcacagtatagaaggccacagtttaatttgataccatcttctaaactattattttctcatagatcatatttatagcaacaaaatctttatagtagaaaagtaaattcaaatatctactactaaaaaaattcggattgatgatggtgaagctaaaatagacacacgatccaacatagaaacgtacatccacacgttttggagcgacaaaaataaaaaaaagggtacatgcgatccggaaggaaaaaagcgtaaaaagggtcgatgcccccgcgacccgcgccccctcccacgcgtcccttgaccgcgccgcctcatcgccgccccgtgctccctcctcgccgccctcgaccgccgccgccaccgcaacagggcatcgtcgccatttttgctgtgccctacgctcacgagtggagttcgtcgccgacgccacaacccaccgctcgtggcatccatgccgcatctccctgaccgtcgccaccgttgctccattcatctggtcggtaacgatggaggaggcggccttgagtgggcagcggtgaggttttaccattttagtatggtcgctagagcaccgtggcacactggcacgcggaggtccatgcaccactgcggcggctggagaggaccctagggtttgcgcacgcggctagattgaaaggctgcaatgtgtcctggcattcaggcaaatcatccatctccaagtccgaccgctgacgctcgatctgaatcctctgcctgaaaatgggctgctggccggtgtgtcgttcctcgccatcccctccaccacagttcggtatcttttatgcttaatagacttctctttgttaattcctcttcttttgttcaggtaaattaggcagttccagaggatagagcaggaagagagtcagcaccatgaatgtgagtccatcttattagtcattgctgttgtgttcgatggtgttctactgctccaaaattttcttgcgctgttgtcacccctacctcctttttctacatctgctacatatgaaataaacaatggaaagcaactgataggctgcagattatctatcctatatattgttcatcaagttatgctcatgctgcacgtatttcagattgaattgataactgatgcattggagtgacagtagagcagcagagatttgcttgcaaaccggttggctgattttctgtaagtcaatggcttggaaatattttgctcctgcatgtttgcctgtatcactgcatgttataggggataagtttggatatttacctaaacatctgagacgtacgtgtgtaatgctgatatgttagagcaattttgctaatagcatatggtttggcaaaattgtttctttggtttattttcatgttaaaatctgagtaagtttatttgccaccaatttatctctttctgactttccctaatggcctaatcccttcttcacatgaacaaaaaaggtagtaagagtgtagtggcttgttttcctgcagtgttttattgcttgatttctccacctctttgaaggcaaaaatgaggtgttagctgagtgatctccttttttttctctttgattgttttagagctctgtatatcagtatatccttatctcggattaaatcttttgtcacttttttgagaagtaagatatcgtgccagcatatctatattactaccaaaggatttctgcttacagcactgaaaatgtttgtttttattagtcatccaactgaatgttttagcccttttgccagaatgctagatgtaacccagggaaaatgtctttaatacattatgtatttacataaacattgaatcttttgtcacttttttgaaaagtaagatatcgtgccagcatatctatattactaccaaaggatttctgcttacagcactgaaaatatttgtttttattagtcattcaactgaatattatagcccttttgccaaaatgctagatgtaacccagggaaaatgtctttaatacattatgtatttacataaacattggcttccttaaagttgagacttattaggagtgatctgttctgtgtatgctttccccaagtgctagggctagaatctttactttaatttgttgagaactggcgatgtcatctgtacatgattcaaacaaatatgttatctggtaaacaattatttgagtcccttagttttaacaccgatacatcctgtgtttgtatatcttaacaatggatgcattattgtagattttaacaatgttcctctgtattatgtttgcagcgcaaggattttcatatcattatggtacacaggtaagtacctttttggactgtaatattaagctttgttctaataatttcttgctgagcatctagaataaagaccctggtatgagtgagttgtctagcagttatacaaatcattgagaagcccatagttggtcgataccattctaaggctgtgttcgttggggtgggttgggaacaaatctcctgtgcacgaaaaacggagtggtccattagcacatgattaattaagtattagctatttttttaaacaaatggatcaatatgattttttaaacaactttcgtataaaagcttttttaaaaaaaacacaccgttgagcagtttaaaaagcgtgcgcgcggaggagggacaggggttgggaaccctttgaaacgaactcagcctaaaggtttcttcattgacaagctcgagtgccatagccgatctagatcaacttaggcgcagtaatttgaagcacttgcaaataaccatcaccttgagttgcaaaaaatacacttccttccaataagggaaacctataaggttatatgccgttctatccccttgtagcactattttggatagaggttcttagtgttgcgaggagctttaaattttcattggtttcagatggttgatagttcttaaaaggtattgtgatcgatataatggaagggcaatatgaaaggtatacattgtttttgtcatttatggctagatgatccaatttggtaatgtatacatttcttatcaattttgcaacgttacataaacatgaattttgtaggttaagcgtgtggagattgagtggtctctttgaatgtggggctatattaaggttttgttataatttacacttaatgattacttaacattattttattcaatgtaacttaaaatggatgcatactttttgccccgtagcaaggcacgggcactcaactagtatcatattcaaatatcaatcattaattgtggtcatccaacccaacggccatgaactgaacacaaacatccttgagcgcgtcgcagtagtgctgtgctggtcagccatggcgagcgtcgccgcgacggtcttggcgtcgaggctcctggagaggatgagctcgcagatcaccctgagcctgtccatggcgtaccggtcggccgcctccagcagctgccgcaccatctccttgtactcgccttccccgaggtcgccggggagcgccagcgtgtcgctgtagacgaagcggaggagcgcgtcgaacacctccggctccatgtcgtcgacggcgatccgcggcgcgcggtgctccctcatcgacccgtacagcgatgccatgaacaccggcgagcgcatggcgagcacgatccggtgggcggcgaagggttgccccctgacgtcgaacgtgacgtccgcgcccacgccgtccgcccgctccagcagctcgccgaggtgcctcgacaggtccggcgccggcacgccggcgaggggggacgccgcggccgccgtgtcgtcgtcgccgccgttggcgacgacgacgtcgatgacgcactcgacgatgaggcggtcgtcgcggacgaacgccgacgactcgaggtcgcgccgccgcatgaacgcgcgggtgccccgcttgcccttgcacttcttgtgcttgacggagtagtcgaacaccactggctgcgccgcccggaacaccgagcggggcagcccggtggcgcggtcgatcagccggaggtcgaaccgcgccgccgccttgcccctgttggtcatcatcttgacgaacaccgacacgaactcccggtgcgccggcccgaacccgccggggtagacgcggacggaccacctgtagccgcaggcggcgaaggcggaggaccggacgaactcgccggcggcgaggcacctcttgaggctgtacccgacgatctcgaactggtgcgtggcgcgcgccgtccgcgtcgcgcacgtcgacctcgtgatggtgctctccgagatggggcgagacgatgccatctctgaatctgatcgagcttgctgagagtgaccgatcgagctgatgaccatggaggaatttatatactagtagcaagtttggaatctcaagatgtgaagattttttgaatttttttaaaattgaagaacaagaggggtcgagagaatttaactgtatttgtcagacatcgaagccgaagcgtccattcttttctctcttttttttccctctctttcttctagtttggccatcatttttacacgacattgaggtgcacgaagagtctatagattgtgcggtgcaattcatcaaggaaaaaaaaatactactgcccataatttttacaagtcagctacaaaaacaaagcagactttgcaagcggtaattgccaaacttatattgattagtattactcaatagccacatttcaaagggaaaaaaaaccaagacagtaaaattcatcttaggtagttctgtaatcggccaaattcatcttaagtaagattaacacctgcatgtagtattaaatataggctaaaaaaatacttcctccgtttcataatgtaagtcattctagcatttactacattcatattgatattaatgaatctagatagatatatatgttagattcattaaaattaatatgaatgtgggaaatgctagaatgccttacattgtgaaatggagggggtaactaattacacaaattatgactaatttgtgagatgaattttttaagcctaattgctctatgatttgacaatgtggtacgcgacagtaaaaatttgctaatgacggattaattaggattaataaatttgtttgttttttattagtgcccaaacaccctatgcaacaccctaaataatactcgatgaccgatgtgacacgctcaaaactttaacaccaccccccccccccgcgcgatctaaacaccctctaagcaaacaatgtatactctactaaatagaaatatactagcatggtgtactaaagcaaaaaaaaaaaacacattaagcattgcctattagtaactcaccattgaaagtggtggataaaaaagtccttgaccaataaaaacaatattttggttgtcctaataacgctatatcgtaaataagaaattctactactttctacatatttacaatttctgaatcatatatcaaccacattgtctgctgtattattttttttgcttagcttaatctttgttgctgtcagaatgtgggccccctcctcgtatctgctgcaacacgtgtcatagtacttgttccaaacctctcgccggagtgaaggggagaggcgcccatggctgacgcttcccgccacgaagtagtagttgtccggcgacgccatgaactcggcgcaccgccgcctcagcgcgtcgaagccgtgccgtcggccatggccagcgtgtccgccgccgtccccgcgtcgaggctcctgcacatggcgcgctcgcagatcgcccccagcctcgccatgccgtaccgccccgccgcgacgaggaggcgccccagcagcgccgtgtggccggcgccgtcgaggccgctcgccacggggagcgtgtcggtgtaggcgaagtggaggagcgctccgaatgccgccgccgccgccggcgtgtcgtcgtcgtcgtcgtcgatggtgatggttgccgcctgcgacgtcgtgttgttgagcaggccgggagcacgggcggcgagcacggagacatgggcggggaaggtctcaccggcgatcttgaaggtgacgtcggccggctcgtcgtcggcggggtactggcggaacggctcgccggagggcggcgtgtcgtggtggaacgtgaggcggtcgcggcagacgtcgacggcgcactcgatcttgaggcagtcgccggcgacgtagggcgagccgtcgaggaagctcctggcggcgagctcgccggtgccccaggtggacaggtcctcgctgccggagtcgaacaagatcggatccttctccccgaagaaggtgaccatctcgccggcggcctggtcgagcagccggaattcgacgtgcgcccacgccgtggcgtccttggtgaccagcacgacgaacacggccacgtcgtcggtcacctcgtcggcgtcgccctccgggtggtaccggatggcccactcgaggccggcgacggtgaacgtcggcgagacgatgcagccgccgccgccgcagtgctgcctcctcaggccgctgaagccgtggacgtccaagacgtacgtgccgctggccggtgacatggacgatgacggcgccgtctccattgttaccaattcaatctacgtgtggtttgtagatgtggttatatataaagagatttggtccattcgacacggagggctccatgtatcttgcaacagattaaccgaacaagttcgatcatggaattggataagaaaaagtggtttgtagatgtggctatatatatggagatttggtccattcgacactgaggactcctaagtatttttcaatagattaatcaaacaagttcgatcagatcgatattcagatggatctggataagaatttgacgggaaagcaaagtgtgtttgtcacattttctcgtaaaaaagtggtttgtagatgtggctatatatggagagttttggtccattcagcatggaggactccaagtatttttcaacagattaatcgaacaagtttaatcagatcgatattcagatggaattggataagaatttgatgggaaagcaaagtgtgtgtgtcacattcgacatggaggactccaagtattttgcaacagattaatcaaaaaagttcgatcagatcgatattcagatggaattggataagaatttgacgggaaagcaaagtgtgtgtgtgtgtcacattttctcataaaaaagtggtttgtagatgcggctatatatatggagatttggtccattcgacacggaggactccaagtattttgcaatagattaatcaaacaagttcgatcagatcgatattcatatggaattggataataattcgatggaaaaccaaaatgtgtgtgtgtgtgtgtctcactctggtagtgctaaagacaaactaaatgtttgagcacattttctgagacacattttttttaaaaaaaaatgtttgaggcacattaccaaatttatttagagtttttatagcgaaaattaataaaactactacagtttgggaggaatatgttggtgatagtgtgtttggtttgctacattgccgaattttaataatgacaaaatttagcaaggttaaaaatagtatcaaagtgaacacacaagatatcaaaacacgagtagcaactcatgggcaatttaagataaaaaggagtgatggggcaaatttctagcataaaaacttaagagagttggtaagagagtaaggtttaaaaaacaactcgatctaaaggtaaaaccatttgcatgatccagatagccacattacattaaggtgcaaccacgcgtgcaccgtatcagtcatcacattgttgagagaacattcgtcagatcatcaaatgtaccaaaacaaacataaccaaaaaggaaatctccagacatcgcgcacatatatcttctgaatcaagaagatgttaattaattcctgcgaacacggctcctcctctcccacacttcaaacgccagagagggaaatgctctcttcagctgctggtacccttgacttgcagccacggcatccattctctcagatgggaccatgaactccatgcaagcttccttgagcttcttgagatctagcaagtcagctagacccagtatcgcagatacatgctccgtgtcgaggttcgtagctagaaatctctcgcacatgatcctgagcctctccaatccataccggtcaccggccttaagcaaatgcatcatcaaatgcatcttctcaccattgccaagatcatccattcttggaacacaatcggtgtagatgaaatagaggaaagcctcgaagacagatggctgcatgtcttggatggttatctcctgcatttgtgtctccttcttctccttcatcggtccacagagctgagcatgaaatactggagacctcgcagctagcaccgccctgtgggcacggaatgtgtcttctccaactctgaatgtcacatctgctcctacaccgtccttcaacatcttggcgaaatccgacgatatctccataggaggcacctcgatctcgcgcaatgccgaactagtttcagcgtcacacaatgccctggttttagacacttttggctcatagatgacagtaacattgcattcgatcacgatgcagtcattgacgatgaaccctggagtgctctcaatatcgctcctcttcatgcacttgagagaccccaaggtagactcctgaaagcttgaagatctgaacggggtaggcacatcggtcttggtgaacagctgacgaggttgcccgggttgcagctggttgatcagattcacgtcgacgagtgcccatggctcgccgttcttgctgatcagctcgaggtagacgccgatgtagcccttgctgtcgtcgtcgatgccgtcagggtagtaaagcaacgcccaatcgaatcctcctacgttgaagacgccggaccggatggagtcgtcttcggcttcggtgttcatcatgctgtaactgaagatctcgaacctgtggatgccttttgccgtctcagttgtgcagcttgatatgctcctcgacgccattgctgttgcttaattggtgtccaatgatgatcgatgaccctgcagttaatatatagtgcagattaacaaatagcatattttttttagataatatagaaacactaagaaagtactcagggattttttggtggatgtgacacatnctctntanaatgngnnttanaatgtgtcacatccacccaaaagcacatatattatgggacggaggacattttttatatatattttatctttgtagtagtagtatagattaattggaaagcttatgcgtcttgggaattaatttggaatcagtcaaacatgtaaaggtactatatggcaagaagagtaagaaatcaggtgcagattttttcttgcgattataagaatttatctcttgctaaaacagccttacaaactcctaattaggcacaatttccttttagcattcgtagatcaatcattcacaaccaatcttgtccatgcaaaacatcatttggaagtgccaacctattgttcgttggtgagaaaggtaggagtttcaacaaattcaattttgaaaacttttgcataaacataatttacatacaattatttactttcaaaccaagatatatactaataattaaacattcactactacataaaccctaatgggtgccagttgggaatcctacgtaggtgccagattttccaaccggcacctcataggtggcactgatgaggaggaatcttaggtgccagtttaggaaccgacatctttgagagtcccgaatccaaaacaaaggttgctcgattcgagccgatgcatcaagcaactctccatcatccctaaaatcgatcaacatccaagaacacaattataaaatcaacattcaagagcaaaattaacaacacagaggagaacacaaagagggagttgagggagccaccgtcgtcgttgagcagccacccctgtgcctgtggcgattgagggagttgaggaagccgctgttgtgagtaggccgtcctcgtgtgcacggtggtagattcggccgcccccaagcacacggtggttgagggagttgagggagccacagtagtcgttaaatgggctgccccgtgcttgtggtggcggatccggatacccccgagcgtgcggcggcggatctggctgtccctaagcacgcggcggcggatctggccgtccccgagcagagaggaggagaggagaaggggcgacggaagacaggggaagggaggtggaggagagggggagggtcggcggaggcaaggaggtagcaaaagagagggggaggagtggcggaggcaacgaggacagaaaaggggatcggagagcagtgagaatggtgagagatatgtgaggagggcgagaagaaaaattaggtcagctcggttttcatcggctcggctttcacaaacgtgtcggtttttagaaaaccggtactcatatattcttctaggtgctgattttttttaaaaaaaatagcacatgtatttatatgtgctggtttttttaattaaacttgcacctataaaggcatgtcagtatcgttttttaatcttagactcatgtgaagattgtgaagaggttaaatgtgatggttttttagaaatctgcacacgtcccctattaggattttgtagtagtggttagaggtaaatgcggctaccctgcctagcacgccgattagggcctaatttttctccttacatatctctcgccgttgagagcccttgctgcatcggtggctgttagctaggtgctcgacggtgagaaaaattagggcagcagggactcaccatcaggcacctaaaaaccaccgaggtgatgactgcgccgatttttagaatattgaacatgcaagggttttttgcttgatgaaatatagaataaagtgctcctttcccttgtgcgcctgttgtagcttgtagacatatggcaacccagcagtccaaatttacttctaatcgctaaccactagcagtttatcctcttgacagttttggcagccttagttgtattaacccatttaattacttgcttttgttgtcttcaatctgatgtggtaatagcagtgacattctactggggacatgtgccaaacaaagaaccaataatccccttgtcagaagggagcagtaacagcagcagctactgcccactgtcgatcaaccccgacgagctcgacggcaatgccgggctgtgcggcggcgtgctcccgccgtgcttcgggttgtgctccatggtgggcatgggcgccaccggtgtagtctaaaaaggccgatcagctcccccgcacgcgcgccgtgatcgccgtgaagaagctatggcgaccagccgccgcccaagcccccactccggcggcggcggtggttgtggacaaggacaagccggtgttcagcacgacgccggactccgagtctccgactacgtacgcttagctaggagcaagctagctggacggccgcaggcccaaaagacgtcatgcctctatgcaatctccaagaagaaaaacgatgactggatcggagatttggtctcggagacaaacccgcaaatcacggcgacttttgtggaatagctcgtggcactatggatcgcagtccatggcatgcatctggatgaaggagaaccagaccaaatcacatggaagttcacaactcacgggtagtactcggcttcgtcagcctacaaagcacagtgcattggcacgcttgacacgacctttgacccattaatttggagagcttgggtgtctggaaaatgtaagcttcatgcatgctcatcatctagaatagagtatggacctctgaccggctcacaaacaggggatggcagaacaacgggcagcgccccctctataggggagaggatgaaacggcgtttcacctcgttgcggaatgtcgatattccaaaaggatttggagactggtagcggactgggttcagctcaatctctggcattgggagatgacccagacaatcaaagattggtgggaaatgctagccgcttcggcgggcatccccaagaaggggttacgcaccctgatcctccacattgtttgggaaatatggaatgtgcgcaaccggcgaatctttgagcacaaagaggccacaacattaatgtacctcattgcaaaaataaaagaataagctggcatgtgggcgttagcgggtgctaagagattgcgcgagcttatcccgcaccttgtatagtgtacagtttttggtttttgccttttctttgcccctaggggctgtatttttctcccactatattcaatgaaaaggcacactctcgtgttggttccattaaaaaaaaagagcaagctagctgtgtccattttctttcttctttcttttaattttctttcttctttctttttttctgcggtgcatgttaacacggccggtcctaacttttcagggccctagcgcgaaagtaaatatagaggccctttcatactatataataataatcaatagatacatatactgaattattaatgttaacatttaaattgcatttagaaataatatttatataaaaaacatatgttacctcaaaagttattatagtactttaactcatataaattacactacaaaattacaaatctaaatttagaatcttaccaaatagtttatcgcgagcgtccagatgcgcaccgcaaatgagccggaaacacaactagtgccttcgtcagtttgtccaactatcgggacaactgaattgccctaatataggactatacatcagtacacgggcacatatatagctatttacatgttaacagatataatcacaatgttacaaaattagtgatgatgtattgatgtattggtgttgcactcacctgaatagaatcctccttgtccaatctcgagggggcagccgggagccggcggcaggcaaccggcagcggctgcaccagcacctcgtggcctactggctactgccgtcgcgcggagcagcggaaaacgggaagccgtgagccgcggagtcggcgccgatgcgtggcctctggacctggggattgcacgcgatttcggcgccgtgaggaggaggagatcagaagacgtgggcggcaggcggtggcaatcgcggcatggcgcgtgcgccggtgcgcgttctggtggcgcatctgttcgccttcgggcctacggccttccgtattgggctaggcctgagcctgaggacccggccctgctgcatgttaatgatttgttcatgtatgtagattattctaaaaaatgtaagaattttgagcttgtaacaaaccaaccaaccaaccattttctgtaaggattagacatagataatgtagattaatgtaagcaatttgaaagcatgtgaataaacagcccactcggttaattactcttatttatttatccgagtaggaaaattaagaatgaaaaagatgaacaggattaaaaccaagctttcgaaagggccatgtgaatattcatattctccaatccaatattgcagctcctatttatttattttttggaaaaagtacgaattatcgccccccctgaactattgcggtcgaccgaattacccctctaaatccgaaaaccagatattactcactctaaacttttaataccggacgaattaccctcctcaatactgttttgagcggttttgaattgagcttgcacacgtggcgccaacatagcaatccagtcagccaaaaaaaacccttcttgggcccacctatcatacccccccccctctcctcggatgccacccagccacagcgcgagcgccaccgtcgtacagggcagcgacgaccctcgccgcccccatgggcctctcccccactaccgccgccaccaccgagtcgttgccgttcgcgcccacaccgcagagaggaagccgagacggacgaactgtccacagcaggcggtcagtgggcggcggcacgagacgaggaggaaggaggagcccgcgccgctgcgatagaggggaaggaggatcccgccaccgcctcactccacgtcccaccgccgtcctcggttccttgcccgtcaccctgccttcgccccctccggctgccgtcctcggctcctcacccgccacccgcacccgcctccgcctcgaccggctgccatcatcggctcctcacccgccacccgcagccgcctccacacccgcctgccgccggcctcgactcctcgcctgctggtcgcggccgcctccgcgcactcgctccgcgccggcctcagctcctcgcccgccgcccgcggccgcctcctctgttcaccgagagagaaaggcagagaaggagaggaaaaaaaacactgacaggtgggtcccagcggtttttgctgtgtgtatcgccacgtgtgtgccacgtaggcttaaaaccgctttgaatcaagttagggttataatttatccggttttaagagtttggggtgtcaaatgtccggtattgtagtttagggggtaaatcgtactaccgcaattgttcagggggagggataattcgtacttttttcttatttttttaacgactcgcataagacggtgcgaaattttattgatagagcagaagaaaaattataagattaaaaccatgggatgtaaaggaaaagattacagctcctatttatgggccatctaacttaagaatgagctagctagcggagattgattcacggatcgccacccaaaatcctgacaaatcgaatcaggatataacaaagcaggcaagaagattgtttttcgtctagatttacactgctagcagaaagaaagtaatcaatcaacaaatcatctatcggcagcaggcgtgtggagcaacatccagcgatccttcgagtccgggaaggcacacgccgagggcgaggtgaattatatatcatcgttttgattgattactgcactttttttttattgttgttgagctagtgatggtggtggtgtgaggtttgtggatgcgcagtaccaggcgcgacgtgcggtggaggcggtgacggacgccgccggcgccatccacattccattcaaaattttcactgttatacctctcaaccacctttctatcatcaaccataaattattttataaagtttatagtaatttgttcttaaccataaattattttataagggtattatagtcatttgttttaaactttaggatatgccaaacaaccttaaaaaatactccctccatccacaatagttatacatattacttttaacaccaagaccaaggagaaattaaatcacctcggatgttgtaaaatcaaggagtgaatacaagcatgcaaccaatgagtatttagatgactccttgggttctaataaaacatttaatttatctcttcatttaagtcttgaatgcataaagactacaaataggaacaacttatttgaaaaaaatcaaatgtgaaataggtgtaacttttgtggatgcagggagtaaataatttgagacggagatattacactgcattccggccaatgggtgattcgaattcttggccatggacagcctagggccgtgggccgtatgcaagtgctagttgtaaccatcaatcagggaagtgtattagagcaagtatcatagtaggctgcaagtcacttataaatatatgcggaaaaaaataagtcaaatataaacacatgcggaaaaaaaataaaagatgagaggactacagatttgtagcatggactttaatatgttgtgtcaatggcagatctagcactaaaatttagctatggtggatcatcacaccagaactaactgcatggtattttaaaaatgaagcaacattttattatacacaaactataatatgtcagcacttattagaatatatgccattaaggatgattataatcctaaatttgtcatgcagtttttacaactgaagccttataaattcgtcgtataacttctacaactaaactacatttccacgagtgtttctctgttttgttttctaggtgtgtttattcataataagtagacattcattgaagttacacatatattctttaacattcaatttttaccgattaacattttgttgttagctagatttgttcattcatttgtgcagacacaaggcagtcccactataggtctttatctcctgttaattaaacgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39799 - DNA, 7809 bp, Oryza sativa
  unsure (1)..(7809): unsure at all n locations
ctgcacccccattgaacagtcgagaaagatcttggtattcattcaggcatttctcattattctccccactggtagcaatcaaactttctggttcttcacgtttcatctgagtaatgggagatggaaatacttgtgaattgcaatcctcctgcttctctgcatcagcagcaactgaaatatgtggttcttcagatttcagttgagtcaaagcagttgaggatacctgtggctgtaaatgcccaaggttctccgcatcaatagcaagccagattaatgattctttagatttcatctgagttatgggagaatggagtgttggtgactcaagttccataagcatttctctggcccgagcaagagacctcacatggctttcatcactgcagttgtcaggtatagattggagaaggtatttagcttcggctacctttccggtctttatcaggcagatagctaagttgcactctttgttataatcagcttctatagcaagagcttgcctgtgtcaaatgacatacggctagtcagtagtcagtaccagctggattagttgaataacgtaaaccagatatcactcctactagtatcagcattcattagagctgattgttgcttgcagtttcaataaatggtttttattatataattacttctaggattcataagtgctgactgctgagtatagtcatttcaagcccacctagatgattttaactgtgcggccacatgttttgttttcctttttgaatgaaaagggtatgagctctgcctatacatgttttgttttcagttttcacactatggaactattgaaggaatatagtagcgcctattttttcctcttaattttctcaaatgaacaccaaatgtgagcatttctaataaactagaaatcaggataaataaatactgccactttgggagatacaagccatctgatgttgatgaaaactggactcaaaagtatacctgtagagcatttcggcctcatcataattttcagactgcatatgggcccaggcaaggttacccaacaaccttcaagacaaataagagcatcagaatgatgtttactggttgaatagcaatgtacgaaagattttaaataccttgctttttcatccctgagagacaaataaactactcttccatgagatttagacaacttggttttccacctgccagaagctagctcctcatcaacaattctcaacttcaatgtcagcatttcaatctgctcttttgtcctgccgcatttctggttttacataaaaatgactagtatcagaacagaaatggtcgcatcttcatctaaaattaacatgtcatcagtgcagcaatttagatgtctttaggatctactgctataggcctaccaaatcacagaattactttacaacagaaagatttagcttgtaggttcttggtttacaggccaagataccttgtacaggtcaagaagaatattgtcaagagattcctgagcttcattgggcaacgatcacggaaggatcttattgcctcaatagcctcttcggctcgatttgcttgcttcagtacagtagccatatccttcagtgcgctctcaattcgatcaccactgtttatagccgcccagaacaatggaactgccttgtttgggtccttttcaatcacctgcagaaaacaagacaagaaaacaaaaacctcagatctagcttatgaaaatttctagattcaggttattacatgcatttttgttcacaaaactgaaagagctgtagaaaaagaaacgctgtcactttgcaaaaaagcaagtaacatgtactgaatgatttagcatgaatatgttgaagcaacaattaagggaaaaattagtacccactacagttactagttagaatagcatgcgttagtggcaacacaccatcaaaacttgcccaggtggtgtggctggtgtctattcaatcttttttgagatggtctatcagtcttttagtataatagatttctggtaacaagggagcctagtcatgagaacacaatttctatatcgctttacgattttactctaatactggttttgttaaagaaacatagaagtagttttatctatatcatggaaattaccttcatattctctcttctggttcaattaaaagtgttttttttttttgtgggttgaggggggacagagaagcagagcttcccctttccattactggaaacaaattcagattacagagttctagaaagcagaaactatgaaaaaaagctaatcagcaagaaaagcttcacaccaaaacgatgccatcccattgctttttgtgaagtttttgcccccaggatatcctaaattcaattcaaacatatcatgaaacaatggaaaatactgtaactaaaacaaccacaaaatgcttttgcccttccttctccctcacaaactactcattattgaaattaatatagtacacacagtcaccatattgagcatacttcagcaacctaatttgcaacctctctccagagtaaacgaaattgcatcgcacatgatggtttccgaattccaattacctgagcctgcttcgcccgcacgtagggcgaatccaccgacgacagcggcgccctaggaggccgggaacacccgccgctcgtcggcggcgtgacacggtaaccgtaacacccgccaccaccgctcgccgggggcgtcacgtgcgaggagcacccgccgctcgccggcggcgtggcgtgggcggcgcggcccgaaccgtccgcgcccgcaggcgtgcaggggctccacctcggcgccgcccccctcggcgacgtccacggcggcagccgcctccctccgctcggcattgcggaattccgtcgaacacctggcgcgcagacaccaaaatccccccatcaaaatccatccaccaaaacaaccagatcaaacacaaccaaattaaccaccgcatgcaaaagcgtcccccaacctcgatcgagaagtcgagaacccgccgccttcgccgccgcgccgtgctcgggctcgacgcggatcacgccgccgcggagttgaaagcgagtggagggagacgcgaggacgaagcggcggcgcgttatatatatacccccgcgcgcgcgcggggaaggggatttcaaacggcgctgacgtggacgggggaggtggggcccacggatgcgtacgtggacgtcgcgtcacgggtttccgatgagacggcagcagtaagtgcagctcatgcggctcctgtgaattgtgatgcgagattgcgtgaaccacgcatacaatgtgctcttcctggcttattattgaataactttagtgtgaattttgtgtgtgaaaaaccataaaaatggaactgaatttaccctacttaacttactgcgtgcattttcaaattcgaatttgtttttgtttgaatttgctgtgtacatggtgactgatttgggtgataaaaaggctgacagatgaggcacgatgaaaagaatctgcttttctgttatctaaaaatatactgtggctgtagcttctgttaaaacaaaggctgtttttttggataacaggtagcgctcggcctctgcatccgaaggtagatgcacaccgccaaacaaaatgcaaaggctgggtttaatatccattatctaacaaaaaatctgaaaatatatggttgactaattacattttggggtcgttatgtcatgatgagaaattgagaatcacatattcattagtcatgatgtagatgaatcatctattgctggcatcaggttgcaaaaatgagcatcagctttagctaggggtgaaaatgggtggatactgtcggattatggcatttccatatcctaaccatattttcctttaaattcggagtcggatacgggtagtgccggataagatattactcatcccgtatcttattccatattattttcttcgaattggatttggaaacggacatctatttgtatctctaattatagatattaaatataaaaaggtgattaaagtattaaatgagatacatcaagagaaaaattatacaatattacatgtgagctcgtaaaataatgattaaccattttttatcatgtttgtaggtggatttataatagattttcatacatattttataatatgggacatatgggcggatacatgacttcctgtatccttatccatattttctaacgaattcggattcgaactcggatagtatcgggtatcccattttttgtcccatatttctcccatgagcctcgggtcgggtgggcggtcgggaaatacccgccccattttcaccgctagctttagctgatgaaataatcggatacttgaactcaaattcagtaaataacaagtaggatagcattctgcctgtaaaaatgaaaaagagagaccaaaattgggatattgctgtgatgtgcatgtaccaccagctgaagatgaagaacataatgtgcttttttgtgctgccatggtcactaacaatagcctaagactataaattgctgtgtagtttcatgcttgctaatatctcagcctttaactgttctcttctaattttccctgttgttgtcactggaaatggtttactccactgataatatatccttggcaccttgaatctgtttcagaaaaaaaaaatagtggagtactgatcatttgataagtaaggtaaaaagaaaaaagaactactacctgattacctagagagggtcatttaattctaagattttagagctgagtccatttaaagtttttccatcatgatatcagtggattagctaacactgtactagctgaaaaaattcagttgtaaaagataacatttgcttgttagttgctgcatcattgatccaaagaatcagtggcacaggtagattttctgaatatagtgacacctgatagagcatcaggaagcaaactttccgtcttatctctcatttatttccattgtttaaggactgatctgaaacagttgataatttgactaatgaaacgctatgttgagacagaatacctgctcaatttgtttgtacggcaatggtcttgaagcatctgtgcagagacttctctgccttcccccttgtgcacagctcttgcatcaacccagttccagccatccctgatgctaacacaggcaacaattttctccccgagacgactatccggcatgccaatcacccggctttagctagacctgngtgctgagacagtacagattctacctgaaaattttgagatgaaaatcacctaaacatggtttcacatttctacatatgcataagcataatgtcaccctatgaacattgcactacagcactaatagtagaatcagtacctcctctgggtacacattttcacctccagttttgattcttcccttttgtcgccccatgacccacagattaccagttttatccacccatccaatgtcgccggtgtcgagccatccattcctgacagaatctgatgtgtctatgctgttgttcacccagtatccggacatcgtatgtaagcctcttgtcaagatattcccaattggtgaagaagaactactgttacttccatttctgttgatctgtatctcaatatgaggcgctggtttgccaacacacacaccttcagaagagctgcctaactggtccttaggttcttgaatttttggcctggtgagaaccatgaatgtcagagatgaacaggcctcagtcatccctgatgaaaattttaagccagttagtgaactttgcagtaggtagccaataacatgattcagagctcatagtaacagtaacagtgatgtctcagttcagttttttgagatatgttacaacttgcaagaatcaaaatgactcctaatggtacctaactttagggaatttttgcaggaaaaatgaacttgaaatcagtggtaagtagttataccataagctgagaagatagtggcattaggaaataagtgagaagctccagttatcaattcactcgacaacccgccaccgccattgagaatctttgtcacggtcatcccgtggttcaatatcttctgtttcctgatgtaccaaaacttttaatcagtcaccaacaaattgttcattcctaggcttccagaatcatattgtatcgccgttgtcataccgagcataggatagtaggtcagccatgattgcaggaacagtgatgaacgaagtcactctgtgttctaggatggcgtcgaaagccgatttcacgtcaaatttaggtatcaggacatgacagcctccagccatcaggattgccaagcatgaagagatccctccaatatggcacaaaggagctgtatgcaggtagatctgcaggccagacaaatgtatgatgaaattccatttatatcacatctagatggttgctaaggaaaataatgtcaacattaagtgaactatatattcaagaaaatcatgtgacaatatttggatcctgaaagcatacatcatcctcaccatagccaacaatggcaatttttgcaagggattgaatgatcaaagatgtatggcttatcgctacaccctttggtcgtcccgtagtgcctaaatccaaatagcttatggttatttagaatcaaactgatcccaattcaacctgtctataacatgcataaaaggccgcagactgaaattccccaaagtgcagataattcagtgcagaatgagggaagaatcagctcagtgccaggaagagcaatcgcttaccagatgtgaagcatatcagagcaacatcatttggagcagacacaggctctactgctctagtagttcctcctgagctcctcttgatctgctcaactgatacaactgatacaactgaaacaaattttcatgtgtaaatacgagttgcactgagccataattcacagggcaacaatattctcatataaatatacccagcttgttcacaataataaaataacaatctgaagaacttacagtttgcagcttggctgatgctgcagagattccccaggaagaggtaaagattaaccgatgtcaagctgttgctctccttcagccgaagcgcccatgagctgtagctgccatcgaagatgaacactgttggctgcacaagctccagtgcctgtgaggcctcctcaaagctctgaccacccacatggaagatgacacagttcaatgttcagtataaagtatcaacacaggctagaacagcacatggaaattcagacaaaatgtttgaattgcagctcttttttttcccttgaatttgtgatacatgaggtgaaggaattgaattattacccagcggtagttgagaggagcgatgatccctccgatgtaagtgacggctaagaacagctcgatgtactcgatgctgcaaagcagaagggaagccatggatgaacacatgagtgcatcaatcagaagccacaattacgggtttcatttctcaaatcagagaggcaagctgaagagaatgcaaagctagctcccaagtcccaacctgttgaaggcgacgacggcgacgacgtgaccacggcggacgccgaggttggagagggcggcggccagcctacgcgccccgtcggcgaggccagcgccggtcaggcggcgattgccggagacggcgacggtgtctcggccggcgagggcgccgccgaggcagtgggcaatgtggccgcggccgtgctgctgcgacattgcgcatgcaacgcaacagcgtgagcgagcgaggaaggagaagtgtcaacgtgattgcgtgacatttgaatctttttttctttcgattcgagataagaagttcagagcagcagagatggttgtggtcaggatagg

SEQ ID NO: 39800 - DNA, 719 bp, Oryza sativa
ccacagaaagtttcataataacactaatacagttacaaactagcaaacggatcaagcatcagatttgcaatttttttacataacacgctactaatatcttccacatataatcaactgcgagcgtgcaacccaatgaatcacattcaacaaaactacagaatcaccacaatacaatctactatccatgcagtctagaacacagattgaatgccagttataccttgtacttggcaacctcctcgcggacctccttgaggtcacccttggtgaagatgaggccaacgtttccctacaaaaaaaaaacagcaagaacatcacatcgatttccagaaacacgcgtaggcaaaaacaaccgcaagaacacggtgagtcggacttacgacgaggaggggcatgagctcgaggaactccttgttgccggtgttgtcggcgtgcaccttgatgcagcggcggatgagggtgttcttccccatgaggacgatggagtcgccctgaggcccttgcggatctcctgcagctggttggacccgacgttgtcggcgacggcgatgagcaccttggtgtactcgtcgagaagctggcagagcttcttgtcgtacgccaccttcttctccgccttggtcctcttgatcgccatcgctgcgagctacacaaaccctaaccctaggcttagatctgcgcgtggggagaggagacggcgaggaccaagctctcggcga

SEQ ID NO: 39801 - DNA, 797 bp, Oryza sativa
cactagattctcctcctgctggatggatggatggatgtaaaacactctaacaacaactcactaagttcgcagttacgacaccaacacggcaacacatctactgagctgatggcactcgattatcaagaattcagagaagaagaaaagtgaaaaggattggtagtgtgagtgatcagcggatcatcatcatcatgcttctatggacagcttcttcttgtgcctgctgagcttcagccgtggcgtggtgtcacccttcaccacggccatcttctcctcgctcgccgtcgccgttgtcgtcgctgtcgtcggaatagcctccttggtgctgcaaatctgtggtttcatgttgagggagaatctgcccttgccggtgctccggctgcggcccagccgctcgatctcatccctcatggtggagcactccttctccaggtcggcgacgcgctgcttcatgttgtccatgccctcccggagggcctggttctcccgggaggccaggggccagccggggcggtattgctcgccggagatggtggggatgagctgcctcgagccgccttcgaggttctcggagaccatgaggcactcggcgatggagctccgtagctggagctgctcgaagaagaggacctgcacgatgacgcgcagcgggagccgctcgttctgagccgcgtgagtgcaggcctcgagagagagcttctggcagtccatcacccggcaaagttcttccttctctgattcagacaggtgaggatgcgcctatggagaaaaaatccagacaaattattaagcatcta

SEQ ID NO: 39802 - DNA, 745 bp, Oryza sativa
tgcaccacagctgccaattctaggtcatgcgttgggtagttattctcatgaggacgtaattgcctagatgcataggcaaccacctttccttcttgcatcaacacacaacccaaaccgagtcgggatgcatcacaatacacttggaaacctttcctcgaatcaggcaaaattaacacaggcgcagtcactagccttttcttcagttcttggaaacttcgttcacaatcctctgtccacttgtacttcacttccttctgaagcagacgagtcattggtctggcgatctttgaaaagttctcaataaacctgcagtaatacccagcaagtccaaggaaactacgaatttctgaaaccgtcttgggttgcttccaacttaatactgactccacattgcttggatctactgccactcctccacacgagatgacatgaccaagaaacttcacttcggacaaccaaaattcacatttactgaacttggcataaagctaatgctcacgtagtttctctaaagctagacgaagatgctcttcatgttcttccttcgtcttagagtaaataagaatgtcatcaataaacaccacgacaaacttatccagatattccatgaacaccttgttcatcagattcatgaaaaaggctggggcattagtgagtccaaacgacataacggtacattcgaacaaaccataccgagttgtgaaggcggtctttggtatatcttcctcacggattcgaagttgat

SEQ ID NO: 39803 - DNA, 8056 bp, Oryza sativa
  unsure (1)..(8056): unsure at all n locations
gcaaagccgaagctgctcccaggccatgcacccatgtcattgctgccgcagcggagtgtggcataccagatgcaatatatgtgtcatagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcaacagcagatggagctcgccctacgggtgaaggcactacctccactcgaccacgtcctaggcgtcgtcgtgccacgtctggctccgtggtgtagttcttatgttctatgtttcgtcgtgtaatgtcagacttcggcatgtcatgtcttttggtctcgtgatgtaacgtcggactaaggcgcctaacgtctttaggtatgctgatgtatgtcggacttcgacacgtaatgttatgttatattatcgagctctacatatatgttaaattgcacgtcatcggagtgtaccattagtaacgtttgctatatttaaatagcctgtactcttgttgtacataattattctcatgattttattactatttcataattttgcaaattatcttttgttttacattactactttctgaattgttctaacacgaaacactatatttttcagagatggcacgtcagtatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgtattactataagttagttgcgctgtaatattttttataatgacatattaatttgttattgcaggctgcgtgaggccggcctcctaccgatgtgtcggctggtggaggctgccgccggcgacgcggacccggccagacaatagactgtggacaggtccctcctagcagctttggtcgaccgatggaggccagagtcacacacttttcacttgccgtgcggtgaggtagcccctaccctgcaggacgtatcgtacttgttggggctaccgctcgcgggagacgctgttgggccagtgaccacggctgtggactggtaggacgatctgacggcacgtttcgcactagtaacgttggcgacttttgttgaggactggttcctcgcaaccgaggaggtcgtggaccacgagggagagccacacactgaggaggcgtaccaggcctacctacgctggtaccagccacgcacccgtactagggtcaccttcgctcctttgagcagcagccccacgttgcgagcactagagacctctacgccaggcaccacgaccaggacttcgctcgtgctgtgagtaccctgcatcgcacccatcctttatgtttcatgtctntctcttcatcaaattttacgaatatttacgaacaaataaccatgcagggcgacgacatcaaccgggtcgtcggtgatggttcaacgacgatccaacatttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtactgactggtccccgtccagctgcgcacgttcctaggccgactccccctccgcacggaggtaagtatttttattactatttctgtacatgcctcgcacatataagtgagccgtttcacctgccgattgcttcagggtttcgtgcaccgttcagcaccccgccttcctcggctaggccttctgttgtgccccccacaggtacttaaaaaaacaacattacttcgacaatcaatttacatgcattatgtcttagcttacaagggtcccgttgtcgatgtgtaggtttcgcccagttcgctatgacgcaggccgcccacttctcccaggctgcaaggtcagcgtctcaggcagctgcgtcgacctcgcacttagcgcagttctggcagtacaccgggacttcatcacaggcagccggcacgtcgagtcagggtccaccactggaccatgctgggacctcgtcggaccgcttgctgccttccaccttgctcttcgacatcactgactttgacttcgacttcgcttcaggctcgacagaggatgtcatcggcccctcacagctgggaggcgcaccgccggtgcaaacgcaggaccaggcgcaggccactcctccgcgggacactcgtgctacccgtgctgtgccaccggatcgtttcacctactcccaggactacgtgcgagcacaggcccggaggaccaagcgtggtcgcggcccggggcagggccagtagagcaatcttctctttgtttatttgcttcacttttcagtactgtatgcttgtgtaatgactacgttgttgttatatgtgcacgatacctttcggcgcatgcacgatacctttcggggcatgcatgactactttctgccgcaccgatgcagcctcctttattcgcgtgcgatacgatatttgcccgccatttggcgcatacgaccaatgtaactttcggcgccgatcatgcatgtaactttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccaaccggctttcgtcaatggctagacgccggggtgttgaggatccaaactggcgtagcgatccttgtgtatacctactaccaccttggtgccagcgtcctctctgcctatgcggtgatcgatgccaattaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgtgcatacatcgagtgggtcgatacagaaaatcccgttctcgacctaaccacttgtttacaagaaggttgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttctttgttccataaatcctacaacattgggtcgaaggttctttgtttgtccaaatattcttgacgacgatttcatggtaagaatattttgattacatgaatccttattttctcacaacatttactaactttgcttgctttacatttaatctttcctcccaggaaccaccaaggagatgtcaatacagagaatggatagataccagaagggttctaactccacctagccgtgttgtgcagcttgaactaccagagcaatacagggttactaaagcgcggtttgagagaggagagggatcctcacgtaggggttagctattatcggacaacttagcatattgaaatttctactgtcatgcttcttgtcccattactatatcggcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctatgacccagactgcgataggcctatataaattatctgagtactaatacatcgaataaggtacaaaataatacctcacttaacatatgaaattgcgcaacaaccaacttcaatacatttttataacaatattaacaagttttaccaataaatacttctttatttattattaacataacatagaaatatcttttggccgtacttttttcatttgggtcccttgtcgctctctattggggcggcaagggacccagatgaaaaaattacggccgcaagctctttatgggcggccaaaattgcaattagccccttgccgccctagggtctaatcgcaattttggccgacggcggcagacggcgtggtcgacccaccgtctgccacgtcagcttgccgcccaccattggggcggcaggggctatttctgcaatttttttggtcgatagattatttctgtaaatattaaaaaaaaaattcgcccgccagccgagtgctctggagcgagacgatactcgacggagacgacgacggcccagtagtgattcttcatattgggctttatactgggcccagtagcttttagccttcttcccaccgcattggcgccgaaaacccccccaaccagcgaaagaggcggacacacggcgatggcggcggcggcggcgggggaggaggcggagagctctgccgccggcgagcagcggcgcatgcccttcgctcgtggcgggcccgtgttcgtccccttcatggtcggacccgtctccacggtccccgagttcatgtcctccgcgctccacgagctgcaggttcgaatccccttgagcacaccgccaaaccctagctcttcaatccgtgcccttgctttggtgtaatcgcgttctgtgttactttgcgagcagtcgctgaaagatgaattgggcgatcctggtgatgaattcgacgaagagctctggtaagccccccaaattccgccgtatcaggtggagaaatcccccagtgtctgtcatgttgttcatatgcttattcgtgttctggtttgtacattttgtggattctgcagcgtagatgagttgagggtcctctcagaggaggagctggtggagcgcgctctccgggaggctatggaggtgaccgttcctatcgagcttatgctaatgtgcttaattgtagttctagttttgtgaacaatattttgatgtgatgtctctgttatttggtgtttttaggagggctgggattccactgctttgtcacagctggaggatcagaggattgatggagggtaagctatttttgcttgattggtgcttcttttatgcgagttggaattagatgcaacacggacggttaattgttggatagcgtcattccatgccaactcataaagaaagttctattgtgaattggtagcatggaacagcggtttgcactttatgcaccaaatcatctcttttcaatttttatggcttgtagctgaattcctggcatctaaattttcttttcatattattatatttaatattcatgtcttatgtggctcacaaaatgatagggtctgatgttctttcgaactatcacatgcagaatgtcagctagttccacctttggaaatggtgctatcacatcaagctcatcaggtgagagagagacttccagatcacctactgaggatacggcaagcataccacatgtgcatggaaacaacggtaaaacaagaggggtaaaaggggaaactagaggcaggaagcgaaaaaatgtcactccgaccttaaattcgtcagttgaaacggagatacctggaccatctgttgacacggcaggtgtattatacctaccacaacaaggcatcgaagggaaaacaggtggcatgaaggggaaatccagaggaagaatgaaaaaggtggaatacacttcaaattcattaagcgagaatctggaagttgtttcacatgagtctgtaccacctgtcgaggatctggaagttgtttcacatgatgctgcaagcgcaaatggagatacaaaatgcggaaagggcaaaaagagaagcaggcattttgatagagaagttcgagcacatattttacaagtatgccttaccctaatgttgcatctctgcttaattgcatgcattttctgatgaatttatcttgtatagtagttagctctaaaaaaatatatatacatatttccctcttcttcttgcatctattgttaatctctggaaaatctgaccatggttttgcgtcatcatatgttgtggcatggctataactaggggagctatcttactaaagcagtgaagatggcagaaattaaggccaaacaagaggaagacaaacatgcagccagcttgcactcattcaggtaaaacagttaactttgtgggcatgtatttatttgaccttgatttgtgggtatgtattgttagtaattccattttctgattgtgccataagctcatagatatatattatttaattttctaccgaatgggatggtgttatcacagctttgctgaagagctgtggaatttctgttgataagtaatttgaacttttactgatgggctgtggcaaataacagtgtaaaagtaatgtaaatcgttctttgtggttcagatgatagcaggatgcaccccagtttggctagattcatgtttcagtaaaaaattggtacttctgtgctggctgaactaactaggtatagaaatttacctccccttaatactggattttgattagcccatacatttactcatgtatcctatttattagcccatttatgtaaatcatatatggtatgcccggtaggaatagtttgcttcctttttataactgagccactagagaataagataagtataaaatacagctgtccaggctatgcacttatggccataactagatgatttgattttatctgttatattgttttcattacagccttctataaacatatttttttgaacgcagtggtgattctgtgttggccaaagtttctaagccatcagctgagaaagttgatgttgcaaaatctcttaggtacatcagcacaacttggaaggtttgcattaaaaactatagcctatttcatttgctcttttacacaagtggctcatttgtctcaaatttcacactaaccatttttgttatcccagaacaaaactttcaaacctggggagcacagacctgtagtctatccagaagtacttctgtgtgtggaagtttatgagaagagatatggctctgtgaaagtaatgacttatatacatatattttttggtatacttatttgtagggtgaaatatgtggggaataaattttttggtgatctcctttccttgcagagccaggaatttctagtgttgggaagccagctccttacagatcttagagacaatatttactgtttcaaagacaagctgatgaatgtggcaaagcaacacgttcattctggttattttcttattgaggtatgcatctgtgaacagaaatttgctgtgtgttcttaaagaattgcaactgtattaatcaacgctctctattgtcaggacacattctataatgacacaaggcgttctactgttgattatagtaaacctatacttgactggattaaaaattccagaaatgaggcggaagagaagtgggatgccattacttctggtgtgctgaagaaacgacaaaaggatttactgatgggtttgaatgtttcaaatgttcctgattttaaatctgcaaaaatggaaaagactcgcttttctgatctgaacttccgtctcggtgctgggtacctctactgtcatcaggttcttatctattctccttatgcctttattgttgtgatgtttctgcatcactttttttgtggaaatcaaatcgtcatttagtcacaatcaaacctgtgttgtttgttatctatgttttgtgatgaaatctaaaatcgattaacttgaagctgtagtaatgtatgatggttgaggtagagatctacaaccctttcccccatgtttctgacaataccctgcacatacgttttcagg

SEQ ID NO: 39804 - DNA, 5911 bp, Oryza sativa
ctttatcaccatactgtatatgattacctccaggagtaaagtactcttcgatgcaagtatattttatctgttgcatgtagcccggatcacaggtgcatctttcgatttgttgtccgtaaactgggcagttttggagcaacagaggtattcttcgtgtctatgggcctgtttggggagcttaagattctgagaatgagctgctgagaagctagctagtgagaatctggagaagctgggtcccagcttctagcttctagttcatttttcagattctacaactacagattctcaaaatctagattaaaagatgaactgtttgggggagcttctggcaactgaagattctaggagaagctgcagctgctaaaagctcccccaaacaggacctatacttcatccacaaaatcatctcccatttgcagtcccatctgctttctctgtttcatattacatgtacctttgactttttaagtttgatcaaatttataaataaattcagcaatatctaatacattaaattagttttatcaaatctaatattcaatatgttacaataatacgtttgttttgtgttgaaaatactatgatattttttatatacttaatcaaagtaactcgtaaaatgaatatgaaacagagagggcagaatacaagaattacataagtgacgcatgattttctagaacagtttctataagaaaacattgtgttcttcaacaaaacacgaagctagaggcacgtgaaagctcaggaaagtcatgcccatcctgggatacatcttcctcgttgggcctagaagaaggcagtccactagaaaatactagacctatagtagttggcacgggccaattttgttttcccttaaaaaaattgaggaaaaatagaagagaaatgagaaatggaatggactagcagttgttgggccagggctaatggagcggaggccacatgtggcaacgagaggccgtggagcgccgcgccttatcctcccgccttttcacgtcccgccacgccgaccgcgccatgggccaccaatggccaccgccaccgccaccgccgccgctctcttctcctcccgcaccctttccccctcctcctccccccggcgacggcgacggcgaggcatccccgccgccgtcaccggcttcctctcccgccgccatgctcccgcgctccaacgccgcctcgcccccctgcacggtgaagatctcatctcaccaatgcgatctcgccgtgcggtccagctcgcacgtacgtgatctaattaactcccggctctgtgcgtgattgcagttgtggatgattccaaggaggtagagacggctgccggagatggtgcggaggagaggtcgcagacggacaagctggtggacgggatggacttcggggagctctgcaacgacttcgagtgcataagcagcccctacgtggaggccaccgcgaggcagctcgcccgcgacatcctcgacctccgcgacgacaaccgcgccttcacctgctacgccgtctccgtcaaatacaaggtgtgcgcatcacccttgtaccaccaattaccactttactgctactccgtactatgtgttatcagtaattcagacattaatttggtaccaatctcgcaccaatgctttgcatctcctttcaagttaatctagcaaacatgtaagctacgagtctgatatgatcatgggattccatgaactgtggcaaacactatctgtagttttttttttaacagtactatctgttttttttttcttggaagggaaaaatagagctatgccatttcaatcagcgagtaacgcttttgcgtattcgctccgaaggtttagcaacaccaacaagaatagtttcaggcacagagtagaccccgagaagctcttgcaaaagctctatgaaccaacacaaaatactgctgttagctgatgaatgttttttttccccgaggaaatctgatgaatgtttaagtaggtaacatgcctccattttcagaagttttagccaggctgatgctgattttatattaagaagaatagcaacgaaagtaccactcaaacaacagcaagaaacaaactactgaactagtgacagattaggatgtccagatgcagatacaataactgatgagctacttgacatcaccttgtggtttcgtgcctttctttttttttcaggacccggtcagaacatttgttggacgggagaagtacaagaggccattgtggatcaccaaggcactcgaaaaccctacagtggtaaggattgctgcaattctataccatatccatgaagttagaactctgttgtaagatatctaacccaaacaagttgcataacatactgtccaaaagaaaaaggactttgtcagttcaaattcaaacaaagaatgcctctctccttatttcacattggcatgctcatgagtttggattgattccagtctgactatctaatcagcattcgtgttattgcgtcagacagtccaggaaatgtcaatgcaatcgacaagcaacctgaccatcaaatggacattcagaggcaaacctaagaatccaatcttcgcaaccatcggaggagacctgatcgtctctgttacctcacagttcgtattgaaccagattagcggccaagtgctcgaacaggtcgactcatgggacctctctgcctcgtctcctcctgcccaggcctacttttggttgtccaggagggccttctccactgttgaagccggaaaggacacaatcgaagctgcaaagggtacagcatctcggctatcatcaaagaaagatgagaacttggaggtttatccagatccctcaggggatcctactaaggtacatgaatcatacattgcaaaaattgatgtcactttatataaacccacccacttatctgtagctatccagtgatagtgttttcaactttttgagcttttgtgttcaatattgcagttcttccaaaggccggatgatggattgaaccaagatgtgtaccagattgcgcttttcctggccgttctctacttcattgtacagtttttgagaacgactctgtgattgtactagctcccacagtcccaactcaacctgatactctggcctgattctccaggtcaagcttttgtgtatcagtgtatgcatatatgtgtgtgtatctatttctaacgaaatcctatcagcggcatgatcgacagttgattcagcatctggctggccggggttttcagatgttccaactgttaagtggttcgtgtttgcatgcatgtatgccagattgcgcttccttttttttttggaaacaaaagaggaataacgtttggtcaaaaaaaaaaaagaggaataacggagctggctatctttgtattaagaataaggggtacaagaaacaccatgagatgacgggcctattcactttgataaaaaaaaaaccttaccaaattttggcattgcgaaaattttggtaacttgccaaaattttggcaggattttttatatagttaccaaaatttagctacaaactaaatgtagccatttttttggcaactttattaaaacttggtaaggttgaaaatgacattaaagtgaacaggcccgacaagtctgatttaggattcaaaaccaggacccaggttgactgggcgaacaccctcgcaccatgtcacctgagctatactttgaactattcacggttcccttgcatgaagaatatgtttttttttacaccacccattttcaagttctgaaagaaaatttaattataatttacattcggaaaatcatttgcatgttgtcataactcaaaatccaaaaacatctctgcagcttaaacaaccaccttatccagttaaactgatcgtcttatacatatatgttgaaaattgtacgaacaaatgtgttcctttttttcccccttattacaacttgcaagaaccaccacacaccacccaaacccattttcaagttctgaaagcaaatctataatttaaagggagaaactggtgctgcgcacaaacacacgagctccaaaccgcaaagatgcaaatgttgtcagctcagttcggtttgaagaattctatgaaagccatgtatatctccaaatggttcccggtgatcaccgccgagaccatggccatgactgccctgacgatccgcctgaacgtatcgaggaacccggccgatttcctccggtacttatccacctcgagcacggggaagctgttgcattccacaatggcagtcgaactactagttgaagaagcagcgcttgctccagcagcaggcggcggcggcagcagcatcttcggcttttgcacgccgtaaagcctcgactcgaactgcgaaacgagagctttccggacgcaggcgacgtgcagctggatcatcttctcgctggaggcgtaggcccatgggttgctgaagctcccctgattccgctcgtggcacatgccgcatttcttggtgatcttcctctccagtttcagctgcaccgtctcggtggttatcacgcgggggagatctgcgcagcaagggtgcaggctgaccttcttgtccgggcagtagtacacgtaacctcgcacctgcgagcttcctaaagcatggtgtaaattaacggcgggaaagggttttctactgggaaactattttcatcgagaggatatcctctcgttatttatatattacccaaatagctataaaaaattgaaaaaatttgagaagatgtattaacatgtgatatatatatcactctacaaatatgtaagttcaaattcaacttctacacctcgcaacgaaaaaaacaaattaaaccatgtaagttcaaattcaacttctatattgaatttgaacttgcatgtttgtggagtgatatatcacatattaatatatcttctcaacttttttattctcaatgtatatggctagcaccttttaatctttattcttctaaaagattaaattgaaggagtagttttgaggaaaaaaaatctactaatactattttcgtgaatacatatatatttcatggaaagtcatttttctccttaaggcatcgtttcttcgatgccatcttaaataaaaaaatatatctaataatatagatcaaaggtggtatgttatttcagaaacattaaagttaaattcaacctatatacaaattaagttggaatagaaataataaatatgactgtgaatatgtgaacaatacactagcttgctagttagtttcattatctttttttcaacttgtatgagtcaaatttaaacttacatgtttacataatgatatatatatatatattacatattgattaatgttgtcaaaaataatttatattgtttggatgatatgtaagaaacgagggacatccaaagaaaagaaacaactccatatgttttggaggtattatcgccggcttttacaatggatcggatgacgtctctttttttaatatgcatttaccttattcaaaatatgtacaaatatgtaaaaatacaagtcatacttaagtaactgtaatcataaaccaaaccataataaagaaatcataattatataaaattttaataagtcaaatgatgaaatctatgtaaaaaatcaaaacgacgttctttactaaaaagtcatagagagtattaatttgcagtcaaggtcaaccttgccggaaggaagtattaagaatggagagagcgaggacctcagtagcgcatgcctcgccatccaaggaaagaaacatcaacatatgtttcgggggagtggattctgataactcgaggagatgtctcatcgttgtttgtatgtcacttaaataattatgaaaaaaatttaaaaaaaaagagaagatatattaacatgtgatatatcactccacgaacatgcaagttcaaattcaatttctatatctagcaaagaaaaa

SEQ ID NO: 39805 - DNA, 35873 bp, Oryza sativa
  unsure (1)..(35873): unsure at all n locations
gctctttgcagccagagcaaatgaaaggttcgtccttgcgaaccaagcacaccttgtgctcgtgatggttggtgtccaaaatttcggtgtacccggccatgctgagtatacgtacgtacgtaaacgtacctcaccacctcacgctcgccaagctagatcgatcttttgagtagctaggtaggtttcagtagctcatagcataccgtggcttggatcgatctcgcggtcacttatatatatagaaacgtacgagagattaattaattagctagctagtgggagaaacatataggtacacagtatatgtagtatctaataacgtcgcgtaccacgcggggtttagaatgtaagaaccggcaagtgaacttccaaacttccaagtaaacgagtacatcgataggcatcgatagggataaggtgttgattattcttacgagaatgctccttgtcagtcgcccatgcacatgcactactagctacttgcatatgcgtgagagaagtgctgctaattgaccttgcatagttggcaacttttaaaagggaaaggggaataagaagagaggggggggggagtgaaaagattcatacttcatactcaagtataacatgccttaaagcatgttataaggatatcatatataaagatgacaaacacacgtgacatgtcttatagcgaggcacgctactttgtaaactattctaacctaaaaaataaatattaccaaactacatgaaagataaagatttaatttttttttagaagtactcaagctcagatacaaattaataaatcaaaactatatataagaataatattatagttaaaaataagtaaaattgtatattgcataccgatgcagttttaggcttatgaatgtgtaatttttaggtgacctaattttcgcaaatttttatgctcttggaatctagcaatacacattttttaaaatgaaattcatcccaacatatgctacaaagaagctataaccaattattacgtaggttgtggctggatcgaatggctacgaattaaaaataccaaccttaagataaagataataggtattgctaaactttaatctatgtttggcgagaatctacatagccattcgttgtttctgctcaatggcttataagttgcatgaagtctttatcttctatgaaatcagtggttgattattgtgctaatcgaattttgtgttgtatgaagtccttatcttctgtgaaatcagcggctgattattgtgctaatcgaattttgctcacatctgacatcgaacctaaatagaactggagtaacatcggagaatatcagtcgttgacctagatattaccacctccaaagtcatcaaagccgactaggcaaggatactgccacaaagtacacaccacatcctgccgcggttcccgtccgctaaccacgctcacgaaggtcgccgccaaacgcacgacctcgatctaagcatatcaacactgctccatgtgccatccaccaaaaaaaaaatcagaattgttgattaggcttgcttgtttcaaagacaattaataatgttgagttttaaagcgtactcttaggatttattgggaatttttcatcgttttatcacttagctatatcttttggtccactaactaaaggtaagggtataaaagtcttgctgtaaattaactgcgtttttccattagtggtcacatttttttttcacttacgacccataaccctgaaatgcctgaatgcccaacgttttgaatgcgtacgttgtgccccatacacactccggttagttgctacatatgtctgtgtcaatcagactatcaaagtacctagtttacttgcgtttacttgactggttcaatgcatatactacttttttagactatttttattattattatttttagactagttcaatgcatatacttgcggtcatgtcacttgcaagttgcaacatgtgtcctgatccacataaatggcgtagtgcctaaaacgacagctattaatctgatccatgtgcttgtgcatattatcttgcggcagctacacctacaaactagatcgatcgaccacgaattaacaacgcgttaactgaataaagtcgaatataaatttgacatgagataaaactacactactagaaaaatgatctttgctggatcggctgttttccacaataataccggttccaataagaaccggtagtcccggttataaaaattttgatctttagtcccggttagtaacacaaacccctgtcagaggcatgtcaggaggctgaggtatcaatcggcactaaagtagtcccggttgatactaccaaccggaagtaaatatttctctccatatctgatcggttaagtcccagatgatatttcctcctcaccaaaatatttagataagatcatatcctccttctatccctcgtatttccttcctcccctcccctctcctccccccttcctcctcttcccctctcctcctcacatctggcgggcagcgtcggcgagcaagcggctagcgggtggtggggcagcacgcggcggcggccagcggggccgcgcacggggcgacagcgtgccggccgtggtgagcggcagcaggcgggaggcaacgcgccggttctcctctccgtttttttaataatttgtgattaagagatgtataatttcttttattacaatttgtgatttattgcatggatctgatatgtataatcgatctatgatgcatttgatttgtgtgtaattttttttaagatttgtgatgtagttgatttgtgtgtaagtaacttaggatttgtatttgtgatgtgaatgatttgggatgttacgttgatttggggtttgatttaggtatatgcatagcacacgatttggggatctggtgtttgatttaggtatatacatctcactcaatttggaagggaaaaaaaaaaagaaaaatggaccaaccgggactgccgctccctatcttacggcagtcctgggactctctagtcccggattcgtacgttatatataaacaggtgctagtacgtacactaaggaaattagatgagttttcttgtgtggcgctatccatataattcttctatacattgtcctcgcaaactcgcaaggtagaaattcagtaactcatttgttagcagaaacttaaaagtttccctgttatattttatttaaactagttgaattccatgtaattgagaaatcacacttaaaattaaatattattacatgacgtattttattctagaagtattacttatgtcatatgagccaacgcatattcttatatatttattatttaaactctaatggatgaagtgatgtacatacttaaacttaactcaacacctatgatacttcttctcaccatatacgttgaccgaatagtatcaatattttttttttcgattgtgcatccatatggttagtgctatatggagaaaggtgtgatttttctcacacaagctgagaaaatagcccaacttgtcttgaagctaagtcatattcacacatacttaaactctactggatcaaatgatgcactcaaatttcaagaccacactacacaccaatattaattataactcgtctcacgatagacacatcacccagaaatttaattccattgatttttcgattgcgcgtatgtagttgatgccacacggagaagagcttgatttttctcgcataagctgtgaaaatagcttaaagtctcgagtcaaggtcattttcatggacatccaaacttatactctagtggatacccattacaaatgaggattatattatcacccatttgcgatgatgatatctttagtagggacacaaatagtactttctcacgatagatatatatccctaagaaatttatattattttttgattacgcgtacttagttaataccacgcgtagagaggtgtgatttttctcacataactcaaggtagtggtccaacttgtcttaaggcaacatcacacaatccccttcgttccatattactccctctatttcacaatattagtcattctagcatttcccacattcatatcttctattatattattaagacagctcgaaaagaaggcaccacgttcactgtgggggctagaaattctcacattaatcggagaaaaagagaaaattatacaccgttggattataatagatttagattacaacggtttagatttgctatagaaaaaataaagaattatagagctttgatatagattaaaaagtcctgtccgtttagaaaaatccaattggattactatacggtatcaaaaattcaagcgggatacaatacggtacagaatttgttatgattccaaaacgcaagtatatatgcattgttaccgcacatataaaacgcagatatatgaagtagatatacttgggctgctgcggcagaacaagtgacaagcaaagttgattaccatcgcccccaataggtaaagcaaacaaagcaaagctgcaaccagcattccagaccagcaatgcatgcaacccacccagaagcgtccggccacattggcaactgacaacaaattataatcataatcgtgtaaatttattttaaacgtattcagctcggagctgtattcacctcggagcataatttagtgttaattaatgtagttaagcctaaaatataaggcttataggttataagttttacacagaccatctaaaattcaaaatgagattaattatatttataataaaatatgaaataaatttcaaattggattttcaatacggaaaaaatatcattgaaacgagtccatgctcacgaggcatcgaagcttacaaggtgtcggttgttaagaaaagaccatctaaaacacatgacgagataaattaattaacaggcctataaaggagtagagtggtggcggttggtacgacatataaaaattgttaataaaacaccaaattgaatcctaataatgattaaaagaagggatatcaggcagaccgtgaagtaaacaagtaaggcggttgccgggacttctagaaagtaaaaaaaacccattgataatcatatttgatttttaaaatctcaatgacaataaaaaggagaagcagcgggcggggtgcataagagtatagttgcagagctgtcgacggttgacgggacttctagaaaataaaaaatgaattccaacgatagttatattcgatttttagaatcacaatgacaataaagagtaggtggcggacggactgtacaggagcatagtggcatcgtttgatgggacttctaaaaattataaaaaataaaactacaagttcaattttttaaggttcagaacttctaaaaagtaaaaaaaaaacaattattatcatgttcgattttaaaatctcaatgacaataaagaaggaaggcaacgggcaagccgtagaggagtacaatagcaaagccgctgacggtttggcgggactactagaaagtaaaaaatgaacccaaacgataattatgttcaatttttaaaatctcaatgacaataaagagaagagacagtggacatgtcacacaggagtataatggtaacgtttgacggaacatctagaaattataaaaatgaaacccaatgtgacaataaactctaaaaactataaaatccaatttttaaaggttccaagaagaatgaatagaaatattggtagatcgagcaagcaaataaagaagtagatgacataaggggtagcaactggtgtgacttttaaaaactatataattagaaacacgaggatgataaggtttgatctttcaaaatcttaagacaatgagatagctatttaataaattttaagtaaaatcatactaaaaaaatatatgattttgtttgggtactagccgcgcaattgcgcgggccacccagctagttgatgttaatgaatctagacatatatatttatctagattcattaccactaatataaatgtggaaaatgttagacttacattgtgaaatggaggaagtataagatattttgagtttattctgagttaaacttctttaagtacataaggtttataaaaaaaaatcgaaatctacaacataaaattagtttcatcaccaccattgaattttttacagcctatttgttttttttaagaaatgtcgttgctacattcattctataaattaagttgatcaactttaaaaagtgcgacttaaaacaaaccaaaaggccaggtcttatatagtatataaagaggggatcacggagtagcatgatagcagcatgctctacgttcttgctctccaagtataacgcttgcttttagagttcccaatccgattatattgttgcatatatgtgatgcatatgcacctgcacgtagatatcatagctagccggccgcttcacttgatttcattgtttttgcgagatgacggggcacagtaagcttcgagctcccgagcaccacgaccatgagctcacactgacggccggaaggagtcattccggtgcgatggctgcaaggagcacgggtaccacatgagatacgtgtgcaagctgggagggtgtcgcgcggggttccatctccacgaggcgtgcgcgcagcacaggttcggggattcttaccaggatcccttcaagcgttacagcctcgtgttccataaatctcttcccaggtacagtgcaggacgacgttcgctgcgatggatgcggaggcaacgtaagtcacctctttctagattatatctcgtgcgatatcccctcgttaattgcatgtcactcaaataattatgaaaaaataatctgaaaagatatattaacatgtggtacatcactccacaaatatgcaagttcaaattcaatttctatatctcgcaacgaaaaaaacaaatttaactgtgaatatacgttaactagttatagtttaatttggttttccgttgcgagatgtagaagttgaatttaaacttgcatgtttgtggagtgatagaccacgtgttaatacatattctcagattttttttttcacatttttcataaacatttgagtgacatgcacaaaacgagaggatatccccttaagaaattaaaatagtttcccattatatctctccttctcttgatcatgtttcttgtcatcgatcgatgttttcttatttttcatctactaccttaattagcttcgtccaaataaaaacttttgaaacacggatgttgtcgatcgtgtcttagttggttttaggtgtttcttttttctcaatacctacatgcaattctcgaaatatacgatacttggcatgtttttttttttgagaggggcatgttgttttatatatgtatgattcggaagatcttccgtccccaaatataaaagattttggctacatcgcagaaaactctaagctagtatacgtacgtgtaatcagttgtgcacgcttgcaggtgaatggttatgcgtacgtgcgggacatcggaaggttgcgcaccctgctcaaacgcggcagggtcctgcacccctgctgcgcggcgctgccgaaggtgatcgaagccgagggcagcgtgacgaagctgcggctcacgcggaagctcaggtcgccgtgctgcaagtgcaggcacgtcaagctcggcgacaggaggcacacctgggggtacgtctccgacggcggcggcggcgccggtgtcgtccagatccatgtcgcctgcgccaacgacctcttccgcgaggagtacgagggcgcgcgcctgcagcagcagcagcgcacaagggtggaaaggctcaaggcgcgtctggtgaatatgctgagaggagcggcgaccggcggcggcggcggcgtcatgatcctccctcagctgcggaccggcgtgccggaggagtcgtcgccgtcgccgtggacgatggacagcccggtcgtgaaagcgttgctgtggaccatctgcaccgttggtgctgtcatcaccggtaaccccgtcggtatttctaatttctttttaaccttgtaggaacaaggacgcatgtgttgtacaagaattcgatcaccactgatctagcaattggttaagtcgttaagatcaaaatacggcgacctcaaaacatgtacgtacttatgtgttctggtttgtaaaaagagaaaattgttgactatacatttgcccaatttcaatttcagtttcatatatgtgtattttttgtacagaaactttgttagccatatatgcccaatttcagttccacattaccatatatatatccagcatgtgagtttttttttttagaaaaaggtccaaggacccggcttctattgaaaaccatcacgggccacgagtctgctggggatgccagcttgacagaggttcagcacaaaagcagaaaaaaaaaaaacattaatgggccacaccccggcttgatagggattgcaagtatcaatgaaccaaacagaaacaactccaggctaactccaaccaaaaactctcatgaaactagctctaaacatcacctaacgaggacagctaaatagaaaatcaggttcagaaggacacagtgttaaccaatcccagttcttgagcgtaggcctgatctcgtctccctaaggtgggtcatcagcatctccagactttgtttctgatcagggtgaagcagaggtttcaactgcagcataagggaaatgatttgaaaaggaatgtttagaggatagtaaacgattttttctctaaaaatcattgcatttcttgtcaaccaaagtgacccggcagttgcagcaattaaacacatcttaacagatttgctcttagcaattgagttcatctctaccagtaaaaaaatgtcatcaaaactcctggcagtctgcccccaactcatggcatctctccaggcacaccaaacaaaaaaaaaaacaatggggcaatcaaagataatatggttaattgattcaatttccccacacagttgacaaaacaggtgaggttttccagtaaaggagatgctttttttctcctatgaggtagttctatgaaactaactggtttcatgcatggtaggagatagatccatctcacagcatgccacatagaattactagggtttactaaacatttgaaatcatgaatgggttaagaaatttacgaaaaaaaacacgttatttcttaaggtttttttcggttaatctcaaggtgatcgatcttcgagggtgattcattccacaccttgattccgagggagatttgttctacatccactaaggtgcatggaattaatcccatcaatccccttcaatccatcctcctgtattaatcgaataaggcattaatgggagggaaagtattttaacagccacatgtaacgcccctcataatttaaagtacatgcaaacttagccaaattatgtgcatctacatttagatcccaactttcatgacaaaattctgctttaacaaattgacgtcttcttatattggtgtcattaaggactgccaagtatctgcattttgatcttgtagcaatactcgaaataactttcatgacaatctgaatctatacagaccttcaggacgttgcagtccatggcgatggcaggtccttcattgcaagcaagagcttctaatgtagttggatcggatgtaggtcactctccggctcacatgtcagtgagcgatatgcagtaacctaaaggatctcaattgagttggattagatatcccggtatcccctcccaaaccatagcgctagctgctataaatataccggatgtgtcatgacaaaataagcttcaacaggtccttagttgcctgatcgagtaacaggggcattcgctttgccagatgcgtgctctaagccgcctctgcacatgggccgtctcttccaccgtatatgttgggccttgcctagcagctacatttggggctatgtttgggccggatgcatgtttttgggcctcatcttggccttcttggcatgttgtcattttgtgtcggtttgggaatttgactagtagggttattaaccatcctgaataattatgattgattatttatcattataatgatcattaataataatagtcatagtgactattatactattgattttaagataaggttattcagaaacttgatactaccattcacgagcctgtgaaatttgttctcaaactcaaactctcgaagcaagatagttagtgcaaaaagaaaatgaacctgattgcattggttcactaaaccttctacctgtgcatttccgacaatgagcaaagagaaaatatccatgtaatacatgatactactcattgtgacatctggcatttacctacaatatctcaggaatattcctctgttttttttccaagccagaaacgagcagtccacaattattgttcaatatctggcggctggagtttgactaacgagattgtgtcgagtagggtagaattcgcaaaacgtggcgatgatgctgatgtgtttgtgcagctggattggcttttcgctagagacgctggtgattttttttttcttttcacgtggtactgattctttgatggtacagtgcatttggaacacttgtttgttcactgctcaaagggaagacatacaaatagtagaaaacgatgctgaattgctgatgtgtttgtcatagactggaaataacccaaaaaaaacgagataaatatctgttatagcatctactcgagctgttaaattgtatcaagcatgtgctggagctgtaaaattgtataagaaacatatcccgttttcaacaaccagaaaaggagtaatactatggtttcactgttaacataattcggctagttaaaagtctacactgtcaacataattcaattactatggtttccaagtaatactggcccagcatcatgttggtaagttcacaacgctatagcgcctaactccaattcaaccactatacaacacaaccttttgtgtgcagtttctaatctttacttcattagggtctctagcaatctaacatagcatatgtgtaaatgtaaaaggatctatgacatctatgatactgattccatgttaccgtcaatcgtgaggccatcagttccagacacaaagagccatctacaaatgttagacaagctctctcctccatgaaacctcagagatgcgcaggcaccacacaacccgatctttcagataccggaaatgccccatcccacagaaagctataggtggagtgccaccacaaaagtgcaggaattacctggggcagccatgtcatttccccgccaagaaactatctccactagaaaggctatgaataccgccaagcaatgcaagatatcctttcaagctcaccactcatctgccgctgccgctgctgaagaaaaacgcacatccttccttcctagcaccaactcgccacccaattaggccattaccttccaaaattctcccatccaatggcgctacgcctctccgtctcctcctcgcacgggccggcttcctcgccggccatctccacatgccgccccgccgcctgcgggcgcttccccgccttgctcggcggcggtgtggcttctcagaggaggagcctgacggtggtgtctggccctgagacaagggcggtgatccccgtgaggtcgagcggctcggacaccgccactgttggggccgaggcggaggcggtggccgtgaccgggcaagtgacggaggtgaacaaggataccttctggccaattgtcaagtcggcagggcccaaggtcgtcgtcctcgacatgtacacccaatggtacttcacaaaagccacaaaactccactgatctcttcgcgtcaatctccattgatgaactgttgcctcgcatgaattcttcagtcttatcacgagctggatttattttgaaatgagcggcgtgaataagaaagggaacagatctcatcccactgctcagtgtaataactgtaaaactgactggttgatttgcaggtgcggcccttgcaaggtgatggcaccgaaattccaggagatgtccgagaaggaccaggacgttgtgttcctcaaactcgactgcaatcaagacaacaaggtcagttagaactgattttctttctcttgtctacgctccacccaccattattcgattggaatgtatctgctgttttcctgaataaatcgtgctaagcctccttggtgcgtgcgattcgcagtctcttgcaaaggagctgggcataaaggttgtgccaacattcaagattctcaaggacgggaaggtcgtcaaggaggtcacaggtgccaaactagatgaattaatccaagcgatcgagacggtgaagtcaagctgaggaatgccctgaaaatttgcatcagttagcttgttgtcactagtgtacgttatgggtgaaccaccagttattgaagtgggtattcgacatggagacaaacagttaatctagttcttctgcctatgatgatttatcaagcatccagaacaatatacggccatttatatggaatgcaccatgtaaataactatttccaacgtcatgatgatctgttttctaatcttactgatttgcaagtgaacattgtattcatggttagcaaaatttcaaaatatatcaacaaatttccagctgaaccatcatagtttaaacattcggatgccggtttttttttatgacacatcttaaattcttgataacacagatacctacctaagatgacgagcttaaattgcaagtgtcatgaaactatactcaattcttctagagataaacaagcatatttttttaaaaaaaaacatggctcaatgaacacataaaaggatcaaagtaatttatcatggcaaatttcagacatgacatgaaccatgaagaattgaagttaccttaacgacaaactgatccatagatcatccgcccctgataattagcttgtttaaaaccagcttagcttgcagcatctcagaaaagttaacaatcttgcagcaacgagaattgtctatcaattccttgtagtcagactactatgctcccgctgtcaagagtgaaatcaggctgatcaataatacccagaataattgcaccaattagcatcctttcgtgaaagtggataatgaacatggagaaaaaactattgttctagttcttctgcacatgatttaccaaacattcagaacaaaatacaatcatgcatgatggtgatgcaaataatcgttccatacttcatgtcttcgtgaggagactgttactttctgaaattattgatttggaagcgatcgacatgctcttgcctgagcattttctgcatactagattacagaaaattttctttctaaactcttgcagttacaagcattaagatatggattgcaaattgccttatttgcttaccccacaccatttattaaaatatcttgccaaacaattatctaagatatagaggttaaaatacaagtgttggtattatgctgtaccgcatcaattcattgagatgccaaacttactaaagcaataaagttatctgaatacttccacaaaataatttgcattgggatctttcagatataacatgaactgtaaagaagtgaaagtaccttaatggcatcagtagctcctgcatttctggcagttcaataagatctgtttggcatcatctgaaaatttacatttgaaacaaagagagatatgtgttcgggttttcagctcctcaaaggaaacctgccacgctccctctgtcgatcctccacccaactagagcctggctgtttgaagggcagtcttgttctcataactgatctaattctttctgcctcctcccattgttctttctcagcatatatatttgacaacattatatagttcccagtgttgtgaggttccaactcaaaaagtttgtttgcaacaatttcagcaatctcaacattgccatgcgtcttgcaggcactaagcaatgcaccaagagcccctgggtgggggcccattggcatcgtttgcaccatttcaaaagcctcctcaagcctccccgctcggccaagcatgtcaactacacaagcatagtgatcagctcgacgctccatcccatagtacttcaccattgcctcccagtaatccaaacctttatcgacaagtcctgcatggctgcatgcggtaagcacaccgacgaaagtgattggatcaggccaaactgactgagcttgcatcctttcaaacacttgaagcgctaattttgcatgaccatgagctgccagcccactaataagtgcagtataagggtatgcatctggctgtgcaatctccctaaaagcactgagagcctcgtcaacattcccacacttagcatgcatatctacaagtgctgtaagaactttatcgttcctttcaatcctcttcttgtcaacataacttccaacccacccagccaactccgtgctgccaatctgcgaggcagcagatataacgccgaccatagttgctgcatcaggctcaatcccagcagcctccatttctctaaacagcgcaagtgattcctttggcaccccactctgcgcatacccattgatcatcgctgtccatgccacaagattctttgccggcattctatcgaacacctctcgtgcactccgcattgaaccacacttgcagtacccaacaatcagcaccgaccacgaggtggagtccctggtaggcatttgatcgaacacgcggcgagcagaagagacgtcccctgcattgacgtagacgaccaccatggcgttccacgatacctgggttctggatggcatggcaacaaagagggactcggcgtcgggcacggaggcgaggcgggcgtgcgcgcagaggagcgagttgaacgagacggcgtcgggggccgcgatgtcggcgagcgcggtgtgtgcggcggggagatcgtcgcacttggcgtagagatcaacgagcgcgttggcgacggggaaggcggcaggggaggagcgcgaggcggagggcgagcgcgtgcagggaggcgccgagcgggagcaaccggagcgacgcggcggcgttgagcgcgaaggggagggagaagtggtcgggggagacggggaggcgcggcatgaggaagaacaggcggagcgcggcgcgcgggtgcggcttggaaaggcggcgaatggcgcggttgaggagggaccggatgacgggggcgggcgtcccggcgtgcgcgcggacgagatgcgcgtggaccgcggcggccgccggcggcgggtggtcggaggcgagggcacgcgagaggcggtcgaggcgcgggtcgccgccgtgctgggacgccatgggaggtggcccagctgtggtcggtggaggcgattgagtcaggagcaagaaataagggaggcaaagtagacttccactgtgccggagacgtgtagttggggttgcggtttttttttgtatcttgggccttttgaaccagactgggcttttcctgagtttgacggcccaattaatttacctgtccctccttgtttttaattagggccgttttggtttgataccaaaacatgcctttccactttgttggcaaactgaataatatgtgtgttagtttggactaacaccaaatatttggtagtgcctaccttatttggtcatattctagaagtttctcctctatactataagagtttggttttatattggtagcaatccaaatattagctaaataactttaccctacaatattttgatagtgccggagtttacctagaatttggcactaccaatgaattcaggcgttaatatgcagtttactggtgtgatgagatcatgagaagagtgacacacacaggcacacgggtgacaaatgcctaatggttcatgtctccctatatttcacatttttactgcaaaaaagttcttttggacacacctctgtgtgcaaattgtacggcactctggctctttccctgaatggaattggaatcaatatcagaaagttgtatctgatgtcaaatagatcgtataccattaaggcattttaccatacgaacatctgctccaaaaataaatacgtaaagttcaagctatgatcagtgtcatccaaccagctagccatccggcactacaattgacctggcgattggttgtctaacgacggatagaaatgcatgaatgcgaagacacgcaaacagcacgttccaagtttttgccaagtagggatcatacgcattcacatttgcatagcaaatgtttagtgatgtgacctcttaacttaccaaagcaatttaccaataaaaacccccacttgctgactggaccaagattcatatatcatgccaagcctaaccatgatgatccacaagagatgatcagatcagatcagatagaacatcagaccccattcttcactccggttaatctacaaaaacatgattgactgacgccaccccatcagcatgtgacatgtcacccgtccaacaatgacacagtttcaacaggtggacacccaaacacctcatcacccattgcatattatcccattgcatcgcatggcttcctcctcgtgcctatccagatcacctaatactctatccaaagttccaaacgcaccaaaagtgaacccaagaagcagcaacggacagtgaaaaaagaggagggcaacaagtcgacgacgatggcaagcagcaactgagcaaaatgcagctgatgacactagttacccaggtggctgtggcctgtgtggctcctaccatggtcaatcgatcgatcacttgccccgcgccggcatcccactcccacccaggcgcgggtggtcgtcacctactccaccaacccggcagctgcaggaaggcgctgcagttgatacgcttgtctctttcccatcattagctttcccccatagcacatgccgctgctcctccaatccacccatttctccctctcccgtaatgcaaaatacgcaatcgctcgcctgatcctctccccctctctgtcgctcgctgttcctgtgtaacttcaccagttcactcccaagcgctatgcgaaacatgctgtcttgccccttgcccccgactagttcgttcgttaccaactgtggcattggtgtcacaaagaacactatgcaacgcaggcaggattgtgacgtgccacatgtagtttagcggttgcattgacttaagtagcatattcatgatagcaaattttagattgggttaggctaaatttataatttaaaaatattgcatatatccggtcggatgtagaggccgataaaaaatacccttctctaagaaaagatcgtgatgtgccctatgggatccacgtgtcagtgacgagtcatcctgggcgttgccgagctgttcgtaatgccgattggtggttccaccacgtcagccagccgctgtcagcttgcggtgtgtgtggatgtgcagcagcgaattattgcccaggccgggacttcgatcgatcgatcgatcgcaacatgcaatgcgtacgctacgccgtaccagatccaacttatcaattcggagctcgggaagaatgctgcgcccatgtggcacatagcggtgcacggtttcgccgctttgattgataccccaaagttaccaaacggggtttacacctcgagaagaattccgtgtgcgcgagaagaaaaccgtgtacgcgagcagagagcatttacatggcgctcaccgtgcgtgcagtatgccagtattcacatttcacagacaagaacgggtcacacaccacccagcagtcnnnnnnnnnnnnnnnnnnnnncgtggcgcggtgaatggtccaatcttatccaatcgccgcccccccgcccccgcgcgcacaaagcgagctcacttttggcgagacatgtcagagaagagccaatggcgagagggagggagagaggtactgcaagctagggaaggcatatggtcaatttggtcatggatgggcacagatcacaatgctcgcccattctctcgcgagactggcgctagctgatcgagaaggcgaatgccgccgaatctgacgcatcaggaggagactagtagcagtaccgcaggatgcgcgatcccattggatgccaacatggacggcttcgcctcagatacgcgccaccggagcatctagcagcagcaacaggacactgaaagccaccggaggagacgcatcatcagcagcgccgagagagacagacagcgacgcttgctgtgctacccaaaaccgcatcatccaacggaacggaacacgcgtgttttgccgatcgccacgctggattggatccgggaacgatccaagttcatcgcccacggcaagaaacagattcaacacgttgtaatccccgaaccatcataaccacgaaaaattatcgccgtggcggcgaccggaggccggcagcctcctctaccggccaccgtcggccggctttgatcgcactggacaacaagaacggcaagaagaacagagtgatgaggaatgaaaggttactaactagtagtagaaaacgaaaggaatgttcattctatctatctgcacagatgccggcccgccggcgacggaccggccgaccactcccatgcctcaaaactgcgcattcttttggtttccgcctcgccgatttcaaccatcgagtccgtccccttcattgcgacgccgcgccgccgccggcgaccgatccgtcctcacacacctgccccgcgtgagcgcccaattcagagatgaactaggtgggtggagatttcacttcgtgattggttcgaggaagaaggattagattacctgcgtgaggaggaggagggggtcgggggtgcagggcggcggggcctcgaagacggcgagggggaagtgcttgaacacgacgccgacgtcgaagtagatgacgccggaggaagggacgtcgacgcggatgccgcggacggggaaccagaggaagaggtcctgcgcggagacgcccgacagcgacgcgatccggccgtagctgatgaccccggccaccgtcgcgttgtaccgcagcccgacctcgaactgcgccgtgcacgactccccgagcgccgcctcgaacctcccgctcccttcgtcgtgcctgaaatccgcgatccccgccggcaggagcccccgcggcagcccgtgcgcccgcagcacctcgtgcgccgcctccgccgccgtcgccgccgccaccccgccccaccccgccgccgccaccaccatcaacaacatcaccacccaccacgacgacgacgacgccattatcaacgaggagataactgccgacgcgaggaggagaagatatggagatgaagatggaatggaattggagggggaggggatggacagaagcggcaataattgagggggagaaagaaaagaaaagaaatggaatggaatggaatggccggggtggtggagtggatggggacttggggtggtgggaccgacctgcccgtgaccgagaaagcggggtttaattttagttaattagttccgcgtaaagcgctcctctattctacggtgtgtttagttatgctgcaatgatgcccaacccttagctgggtgtgcgttttccgttttggctttggtcgcgggtgtaacgtgatttgttgttttgttcctttaccttagtgtgcgattttggttgtgttctaaaggttgttcattaaccctaattttagtttaagggttggtttggtttgtggcctaaataggccttaccaaattttggcactactaattttggtaaggcaaagttgtgtttggattgaagccaaaatagcctaagttcactattaaaatggcctattttgttaggcatgctaaaatttggcttcaaaccaaatagacactaaacactattgaaattaccaaatattggtaagcctaatttagacttcaaaccaagctagccctacatcttaaagttgttccgattcttttttaaaaaaaaacgcagttcatacaaagtttgagctccgtcggcaaaaaccaaaatttaaatttttcaaaaataattttgaagttgattttaagatattttgaacgtttttttttcagcattggttttaaatcactaagaacacatatataaaaatttacctgtaaaataatttttatttcttaataagcccttacggtgtgtttggataatgggaaatggagggtgggattgggattaggaaatgaatgaagggttaggattaaatggaaaagggagaatgaatggttagaatctaaagatggtgggaaatcatttccgtttcccatttgccaaacactttcttactgtttattagagaatgtgggcaatcagtggtaccttagtaacatttgtactgacattggaacagcgtgttgtgtatggtaggagcatatgaccgggccataagggagccgtttgaacgtaaaagcatggaacaaatggatgaaacttaagtaagacttgcgtaaaaataaaaaaaaaaacttaagtaagacgacgatgaggatgagaatgtcgggcgccctcaaaatgctaatgccaatgtggcggagcttgagccagtttggctttgcacgaattatatgtaatttgacctttctaaaaaaatgtaatttgttgcctgtttccttctttcttaatgacacaaattgagtttttttaacacaccctaattttacttgtagactagagactattgtgaatttgtaattatgttcgtagtttggacgatggttcgttactctctagtagaaatgatttgatccattagttattagagataaagataaactagtaatttactgatagattgattaggggtaactttattatttatcattttttgactaatcgatatgtggccatccacgttggcatcactcatattcaatcgaaatatgccaaaaaagaaaaaaaaaagagatttagccactactaaatttcaattatatttctccgtacttttttttatatataataatgtccctccatatttctaccaccgttatttgaggtggggtgatgaaaatgtacatttcactgagagaatgaacgaaaggaatgtaacacgaggaagacaatggtgaggatgagaaccattgcatggtaggctatcctacgatcacacctactacttgcaaacttaagtacaactagagggcaagatggtggagtggacgggaacgagatgatggtgctaatttgcccgtgaccggtgacccccaaaacagtttaatttaggcggtaatttcacgcatagcgttctttccttcccacatggtagaatgtgttttagttttgttgaaacttgagagtgatgcaaaacctgagcggttttaccggttcggttttggtcacatgtatgcctactatttgggcttgttttcctagtactccaagtatatatttttagttgtaaactgaaggaagacgacgacattgacggcgagaatgccagtccgaccgtggagcagcagtgtcttctgctgtcatgtggggcccttgttgcagccacagtgtagagaaagccttgtttctttctcctctgaagtctgaacttaacgtgggctgcctttcctcactgacgcaaccatcgtggcacgaacacgctgtacatacatacgcggtgaaacgcccctaatgctttgcagaattgcaaaagcacaaacgaacaagaaacaaaaatgtcctgtgttctcttctcttggtccaatgccccatagagtgaatgcattagctgtgcatctgggtttttggatgcttccggttggtacaaggcatgtgcgccctcgtatatcattctgacatctcggtgtaccgcgatgaccgggagataaattttgcatccagctcaagctagccaacgaggtacagtattaattaggagacgaaacaaaagcaccgaaacagtatactccttgtttcccggttcagaaaactactgaacaaagttaatgctttggtcttttaccaattaccagtgttcccatttccgattgagcgacgaatcccgatcttgacggtatgacagtttttttttcaaatttcagttaaatctatcgtctcaattttgaattcttaaaaaccatttgaaattttacttataatccgcttccgtcctccgtgaaaacaaaaaaaaaactacagttctcaaccagtttttattgaaaacttaaaccctggtctatattaatgatagaatatcatgtagtaaattatgttttgagattcatgcaaagccctcaaaactctaaccttttctttttttcctttttcctccccatcaccacatgaagtgctcaacacttccgcttcttgttgccaccaacgccctggccttgtcagctgatcgaaatacgctaatggcaccagagaggctccctcgaccagccgcctcccctccctactacccttccccctctatttctcctcaaggtggcggcggcgaggtgcccccgccccaccgtctcccccatctccagcgactcactattgtcggatccaccaccatctcctaactgtacacttgctttgcctccaccaccaacaccagtccaccgtcttcctccatccccgtgactccgatgtcgccgtgccgtccactagttccaccatgcatcgtcgggccaccgcttgtcggcaagacgccggtcgtcatggctggtgaagaaggggtaattggagcttgaggagaaagaggtgaggtcgccggagcaggaaccgcaaagcaaatctaatggtagaaatttacaatattttagcctcaattttctaccaacagtagtttagcatttccgtgtaaaaaaaaatggttgacatgtccgtatagctggctagctattactttctccatttcacaatgtaagtcattctaacatttctcatattcatattgaatatctagattcattaatatcaatatgaatgtggaaaatgctagaataacttacattgcgaaacggagggagtagctagcagctgtagttagcaatctcgtgaactagtgttggccctgcgaggtgtgagttcaggctgcacctgatgggcacaacctgtcggggaagctagcgagccatcattgggagcagcatgatagcagtggggatcaacccattgatccgagcaaaaacacgcacacagggcaggcagagcaggcaccacacgcgcatacgggattcacacgcctccagtacgcatagtgcgaacatattctcctttctgctcgccatgaagaggaaaatctctgcagaaatgcagcctctcgaccgtggcgagctgaggctgagctgagatgagctttcggtcgccatcgacgcatcatgggtggcatcgttgtcgtgcatttggatgctgccgaaagaatcagagaaaacctcgagaagaaagaaagggagagatgcagatactctgtctgtgctgtccaggtttgccttcccttttcttcctttcatcagtcaccaacctgcatgcatggatgatgatttggagagaaaaggggaaatggatgaatgatttgattgcacaagagcgagctaaagctctcatcatgtaccacaacctggatgcacctgtaacaagctcgtagccgtcacctacatcgggaaatattcagcctgttttttttttggcttaattatctgctgttccagcctgtatgattttcagaactactcggctgtttcagcgtatgagcagctatgattggctggctgagacagtaccactgatcactcatcattcgtgcttgcttagatcttaatggcgagtgattagcaccgagttagttaagggtttggtgaaagctactactagtgctgccggattaagatttaacggcgatggcaaggacggggacgtaccgggccgggtgtgtgcgcgggcaatgatcgtgtcgcgccgaggcggagcccagatggcgcgaatgattcgggcggcgaaaaacaaaccactgcacatgacctactacagtaccactccgtcctaaaaaaaaatactgctagctacgaatctgaacacacatatatatcaagttcgtatgtaggatgggtctttttctagacagagagagtatacttcatccgttaaaaaaaacaaacctaaaactagatactatcatatattctagtgcaacaaattatagacatacttctactagtatatatcacgttcagttttagattttttttaaaaaacatatgtagagtagtcgaatgcaagattgcaatgcagggatcaggtcaccaggacaacggatgggccatgcacccatcgccgtcgccggccgcgcggcgcggtggcgcgctccgctccacgctctcttcttccctgatgcccgacaagacccgttctttgctaatggtggtatagaatacttctgtgatgcgcttacaaaagtagatttcgccaaagttaaccttgtacatcagtattattagatataacttttctaactatttgttattttctctttttgaatttatttatgtatttatttatgggactagctatatttatgatatcatattaaaaaaagttaaaatcttgttacaatgtaaatagcatacatttacacttcaaaacttatactaagtaagttatttatattgtaaataacatacatttacaatgtaaataacttatggatgttaacatatatataaatacgaacaatattagaaagtcttataatatgaaatgagggaagtacaacatttatactgtaagttatataagagaataatgataaaagtaaataattaccaacttggaagataagattgagagagaaacactagcaatcacatatttaaaaaatgattgagtcaagtcagaaatgtggcactatatttacaccaaattcgttaatttattggctaataagcttactaactaaaccgaattaacatgccataattacggtcacttggagcctggaggccaagtcatcaaacggcaccggctggacccacgtttggttacgtctcaccaaccggttcccgattctgtgcaacagagaccgaaaggaaagggaaaggattgggatatttgggattaggacaaacagatggtacactttgtcactctatgattattatcggtcacgtacgtactagtaagtgcaggcccctccacctgagccggagttgatagcattagtttagattgttagctagcggctacagaaagaaggattagttggtctaataaaaggtttagttttatggggatcttagaaaggctttaacttttggacgtgttttagttaatcatgagcttgattgggtgccggctgctggatgcatgggcacgttaagtacgaacacgcggcatgatggatgcgttgtcttagctttcgggacgtcccggccggaaatgcctcttatgattattaaagaattaggtcatggggttaataatacatggaaatacagggtctaatgggcgacctttgatcgaggcccagtactggttatgggcccaataaactgtgcaaaggcttcatgggctacaaaggagatcatccacaaaatttgtgggtccaagatagtcacggcccattatttgcaacatactccctccgtcccaatatataagagcatccccagcagctcatctaaatttcatcctccatactcccatttggatagccatccaaaaaaattctcactctatataacttttcacttcaacagatcatccatattacatcctaaatataccaacatcctatattttattaatatttttcaactaccacacatttttactcatatccctctcacctttcaccacttaaaaaaaatctcgggaagtgggtagttgaggatggagtgaggagagagaacctccatatttagcataggaagggctaggtttggagaatctccaaaaatggagtatgtgatggtgactttgctggagcactatttttctcctccatactccaaatatcggatggatgactagataaaggagctgctggggatgctctaagaacctagaaccggataaaacattttatagtactatgaatctggacatcataggctacctgtccagattcgtagtactaggaaatatcccatccgattttaggttcttatatattgggacggaggaagtactcatcagcttccatgtttaatttccacgataatttttttcactaaaaaccaaactttcttcattcattcacgggagaatgtggactggactgtcagtaccgcgcgcacacaatcaacatgaccaaaaagcatcagatgccgctagggatggcaatcgggtgcgacgggtacgggtagtgcctatccatacccgtgcccatgagattatttttttccgtgggtatatctattactacatgacgggtaagaatggttgcccatgcccatcgcccacgggcgccttgtgcccgcaggcgtgcccgtttacccgccactacaaaagtagtggaataaaaagtctacaagcttctaagttcgatatcgaatttaaaacatcaaatattctctgtctcggtgtggtgtctctcctctgacggcgatagagtaagagggagagataataagggaaataaaaggaaaaccgtagaaaacaaagaacgtggcttatgtattctagtggattttgcttctagcctacatgtaagttagatttcgtgggtaaacgggcaaagcgggcatgggtagtgattacccatacccatgcccatttacccatcaggcatagcttttaacccaataaaatatctatgggtataaaatggagaacaaatttaatcctaatagggtttttaaccacgggtaaatagaaaaacgggcacaattgccatccctagatgccgccatggactgtctccatccaaacctacgtgtatcttcaggatgagacacgccgacgcgtcatgccgcctcaaaggccgcggaaacccaaccgcccgtccgccagcccagccgctgtgacgtgctcactgtttcggcggacggacgcatatgtgtccgtttcgcaataaacacacgggagcaatcgcatcacgccgacccaaaaaaaaccgtcccgtccgctccgcggcgcttgacaacgcgtggtgcacccaatagctctagcgtgacaagactcctacgccgtcacgcacccacgcacgcacgcacgcacgcatatatgtgcagtgtagcgtgatgtaccacttctaccaactggtggtagtagcattgcctactttcacatacgcgcggcgccgctggtgctggctggctggcgcgcgcaccggcgggcggagagcgaggtttttcgccggtgttttggttggcctccgccgttccgcgcggtggtggtggtggtggttgctgtggtagcgagggtacgctttggagacggagatggagatcggcgccgttgagaacgggggtgtcgtcggtggtgaagttgtggcaggcaagagggggaagacgccgcaaggttggaagtgcatgccattcatcataggtgaggctcccgttccagtgatttctttctacgttttgcgatccgtatagtatgttaacggccctttgaatcgtaggattaagaaaacataagaataggaaaaacgcaggattttaaaaaggtatataagtgtaaaacagaggattacaaaacgtaagaaaaacacatgaattaccgtttgattgaaccgcaggaattggatgagagagataaactcaaagaaaaattaccaagaggttaaagctcatgctaaattttctctaaaatctctataagattgtgcattccataggaatttcaaagaattggataggatttaatcttttgtttcaaatggcttcatagaaaattttcctatagaattgaaatcctctaaaatttctatgtttttcttccaaatcaaaggggccctaaaggagcgaaggcaggcctagagtagttagggcttgagccttagacttgtcttcagaattatggttaaattatcttaaaccaccatgtaactttaagaaaaaaaaagcaactcactagtttaagttcactctttaatgatttctagctccgtcgctgacgttactagacctaatacctctgccgtcactgatgttacttaggctgcgttcgtttccagggacctaataccaactccccctctcatatttcgtgtacacgcttttcaaacagtgcgtttttacaaaagtttctatacaaaagttacttaaaaatcatattgatctattattttgaaaaaaaataactagtacttaattaatcacgcactaatggaccactccgttttacgtgtgaagggaatgagttccttagccaagaaacgaacgcagccttagacctctcaaatgctgcacggctacaccgtaggcttgaaaataacaagatagacgcaacgctcaaatacacgtatgtatacacacgcacacctacctacacatattgaatggcaaggtttattttggctacaatttaaacatgcccgaagtcccctttttatagatagtttcatgtgaaagatcaattcatttcctttgataatatagaaaataaattgcatcctgagaagggccatatatatagatcatagatgtatatgtccatggtattcgtattcgattagcacgtacggaagactcttttaatcactcgtattcgtgaatcatctcattaatacttctacatgactaccgtaaatcatatactaatatccattcaatataagagtattttcagactctgagcctagaccaagtatatgttgatttggtctggcttggcttggcttctttgtctaaatttagacatgacaacatgggtgctctaacccggtgatccctgcacaggatacaccctgcctcaaatcaaagcaaaaagggattcacgaatgaattatgttgtacttcaagcggatcaaatcaaaatgctcattataatgtactgaatggatgcccttttctgattgtatctatgtagcaactgagacatttgaaaaggttgcgacaattggagtggtagcaaatttgacggtctatcttgtgaagcgcttcaacattgggcaaattgaggcagctaatattaccaacatattcttcggtacgcttaactttgcgccattgctaggcgccttcatctccgacgtctacttgggaaggttcaaaacactagcctatggatgcttcgccagcctcctggtatgtccatatgatgaccaaaccatctctcttagtagtttcatttcacctgcttggcagcagaaagaaatgcaaggtcacttgtcattgtcaaataaggcttcacccaacgaataaaaagatcagcaatagcttaatgcttttttttcattagaaacgaagaatgtacaataagccccaactgatgcaagaaactgatatatagtgcacatccaacatttttgttgatttaagctcttcccaggagtgtagttcatcaacatgaactcattttaatttatttatttgctaaaataacaggggatgctgggaatgactttgtatgcatcacttccagctctcaagccaccgatctgccatgaaaaaacccgactaggcggaggctgcaacagtccatcaacactccagctaagtgtgctatacctttctctaggctttctaattatcggtggaggagcgatcccgccttgtagcttgccctttggagtagaccagtttgataagaccgacgaagaaggtcgaaagggactaaacagctattataattggtactatggaacaagtactgctgcccttgtgttatctatgattgtcatcatctacatccagaacaatgtcagctggccaataggatttggcatacccacattactcatgtttctcgccattatcatgttatttctgggtaccaacctgtacgtccatgtacaaccagagggaagcatatttgctggaattgcccaggttttagtggcttcatttaaaaagagaaatctcaagcttccttgtcctcatgatataaaccaacaaggattgatgctctacaaccctccttccaagggcaaccgcgtattcagattgccacttacttcccagttcaggtaaacatctgttaccactaaagatgaacagaattggaactaatgtagctagagatgtaatcaacttagagtggaggaaaaactaaaacaatgactagtcatagtgaaagtattagaacatccaacaaactgagaagtgataaatgcattgtcatatgtatatgtgcacacacttttacgcgtatagtgtgcttcaggagtttttgcaagaacattacaatgaatcggatatgggttggttttcttgaaatttatatctgcatcaatcccgaggcacatttgaaattatgatgttgcatgtatatatgtacatgtggaaaaaaacgaaatttgaaaaacataagttcttgacattgttctattttattgccaaaacattgtaagttttcaaagcaaagcaacaccaaataattaatcaggttgttgaatttagtgatttttattcattacctcttaccaagttgtaagactcagataccttttatacagttgaatattaaactcatatagatcatgcatatcataacttgcacgagtattttgtatgcttatcaacacgagcacacataaatatttactgatagatgctatattgctatctatgtgctgggcaagaaaatgcagaaattcatatttgttggtaaatatacaccctttttcctctagtaaatgcatagaatgcaccacatgcttaaatggagttaagaagaaacatgctggtcatatcaaacaaaatactgaccctttcaaagaattatatgctagatgccatcatagtttgatgcatgttactcatcctcaggtttctgaacaagggtgcaattgtaatgggtgatgatataaatgttgatggttctgcaagaaactcttgggagctttgcaacgtccaacaaatagaggaggtcaaatgcttaataagaattgtgccggtttgtatttctggagtcttatgctttgtcgcattggctcagcaattcacctatataatcttgcaaacatttacaatggactgtcactttgggacgcactttgaaatcccagcaggctctgttgtatccatatcccttattgccctaactctattcatccccatttatgaccggattttagtaccaatagctagaggattcactggagtggaaagtggtattacacttctacagagacagggtataggattggccatttctcccatttcaatggtggtagcaggacttgtcgaacgtaagaggaggaactcagccttgtcgaatggaggaatatcgcctatgtcagtcttgtggcttgcaccccaacttgttttaatgggtattgctgaggccttcaatgcagttggacaaatagaattctacaataagcagtttccagagaacatgcaaaccctagcaggatctctgttcttctgtactatagctggagcaaactacctgagtactgctctggcaaacatcatgagaaaggtcacgaccagagatggtcactcaagctggttaacagacaacattaatcttggcaaactcgactattacttctattttattgcccttatgggagtcctgaaccttatttattttcttatatgctcacacttctaccaatataaggtaatgtcactccattctgaagaatccatcaaaatacctaccaaggaagaagaagccacagagatcgacattgacacagatgcacctagcaaatgaatagtgcaactgcgagtctaattgatctggcacaaggaatatacttttggacatggtgacatattcaaattccaatttcgaattcactttagaagaggctctaatgtttgtaacatcaaacagacctctgtgtcatcttatggatgtgacaaaaacaagtgtaccatagcaagggggtgacatgttatctagcaaacatgaataaagagtttaaatggcctgtcctgttgtattcgaagtaatggagtgtgagtgatagcttatgaaacttaaacaagtccataatggttatgcgacaagtaagcacaggtcatacaccatctttttctattagagcctttaatgtgcaatatttgaaattcttatagatgcttttacgaacatgatttgcagtaactagccatttatcaggtaataagaaaaaagtgagctctattaatagttgtgtcatctttgaactattgctgtcggtaatctcacattctcacacagtgtgggtgatccttcgtatacttaatgtctaatataagtaacttttttttattaaaaaaagtcatgccaggtggagagatcttatttgattgcttaaaatgttatatgataaaaatcacagaaatgtttatatagaataaagaatttatggtaccaaaaaaatcttcattccagaaatgtaatgaacatgtcaatcgttaaactcaccgtggaaagtcgtggaacaacaactggagcaccacggaccttgtcaagagcaaaacttatccgcaatggtcgtcctagcattacctgtagaataaaaagaaagaccatgtttattttcctgtttatttttcactgaaacagttaatattacaatctgttagacatttctcttcatcaaacagtacctttccatccatagcatccttggcgcacttagcttcatactcgtttgagaagtgcacaaacccaaaacctcttgaccttccagagtttttgtcatacattattctcactgcatcatcaaatagtcttcatataattctgttcactaataccagcgtaatgaatatgtaaggaagggattaagcattgcaatttgtggggtaaatagaataaacaatagcaaaacacatgttgccacacacatcttataccaggcaaacaccaatatgcctccaccagataattccatggcatatgcatattgagatgtcatctttcagaataaaactatatgataggtgataaataatcacgccacatatgaacctgcttcaaacagaagcaatagccattgacactggggcatacgcatgaaaagacatgaatggcagcatctatacaaatatgtgggataatttagacttacagagcagacaaatgttcattgattgaagagaagtgttagtacttggtagatatatatgtcatgaaacaaatatagctttcctctatgattatctatcgagtgtcaacatttgtgaactatatctgttggtgggagcatgaaacgttaacacctttaaggcagaaaagtgggacaacgctactagatccttgaacaaacatccaagataaattttaaagtggctgattaatagggactgccaggctgccaaatgaaatggaagtgcaaagcaacacttgcacatatgtagaggtgcacacccagcagccccaatatactgctcatttttttttaaaaaaaaaaactgccacagctggtatttacaggctctatcaccaattctttttactatcaatagtatgttgttgtcctagcatgtaggaaagtcaacatgcacaatccagatgagggcataaggtcagatggaggatcaccgtaaaaactccaaggcaacttttaaaaaggaaaaaaaaagacaaatgaaaaaaaggaagtaatgaaaaatgagtatgcactaaacaagctgccttagaccttagtgtgtcagtaccattagaatccatattcacgtgttagagattcctggagcaatagtgagttgagatgtgatatcgttggtcatgttccatagaccaaggcatatttttcttttaaagaaaaaggtccaaggcaatcatctatttcatcaacttgcatttgaaaatcatgcttgatgctttactttttccacaggagacttggcaacctgaaagtgaatactcaacttatgcctgagatagattccaatagcttgagacagacagacagtgaatactaattgtttgatgtatcttctctcttccctaggtaagagttgttctactatcttctgctgtacggcactatctcaatggaactaagccctaaagttttccttgtaattcgctttgcataacaggatctgacagattcagcagctctatatttgccagatgatgcataagcattagaaagtaacacaacatgcccataatcaaatgattccgtggtgagcaccttctttgcagcaactttagtaaatttcatgtcaccatgcaaatgccctcctcccatcaaagccttccaagcatttgctcctaatttattgtgagtcaagctagccactcctgctgcttcctccaagcggccagctcttgccaacatatcaactatgcatccgacatgctctgggcatggaattattcccttgtcattaaccattcttctaaagacgagcatcccatcatccaccagtccagagtggctacatgctagcaatgtgttcaaataagtcacactgtcttgatcctcgctagatttctccatttcattgaaaagtgatactgctttctctccttggccatttacaccataggataaaatcatagtattccatgagacagcattccgagaaatcatctcatcaaacactttatgcgctaaagtcgcatatccacacttaccataaactgcaatgagggtattaagaacaggtttgtacagacacaaacccgatttgtaacaatatgcatgaagttgaatacatagttcaaacttagcaacctcatagcaagcaagcaataaggtgaccagtgtcacagaatcaatcataaaggaaccttcatgcctcatcttcgcaaagagatacatcccttctagggcatatccattttctatatacgctgacaccattgccgtccatgaaaccaagcttttctccattgtaccatcaaacaacagtcttgcagaacttaaatcctcacatttagaatacattgtgattaacgagttaactgcaggaagctcaccactgaacccacagattacaatctcgttatgaaccaactttcctatccttccatcacccagatgtgcacaagcttgcgccactgtaaccaatgctaccctatcaggcactatgccactcaacctcatctgaacaaacatatgtataacttcaatagcctgggcttcctcaagaaggaaacccatcatcatcgtccaagaaacaacatcattaacagcgatctttttgaaaatctctcttccaatcgcaagactaccaaagctcaagtacatacccaagattgagtttgtcactgagacatctgaatcaagcccaatcttgactgaataagcatgtgcactctcacacaatccaaggtcaccacaaccagcagaagcctgagcaatgctaatcatagtcacaacattatgaactggtccaaatgaaaacagcaacctcttgaaaaccagcaatgcttcctcaaacagatcgttgtgcactagaccagaaatcaatgcattccaagtaactataccaggatccctcatttcaccaaacaatgcccaggccttcgtaggacgtccacatttcgcataggaatcaagcaatgcggtccgaacaaaaggattggattccaacaggctcttcatagcccacccatggatgcactcagcaagcaccaagttgcccatcccagcagctgctattaaagcaccaaccaatgtgaacgagttggggctcacccccaccctcatcataccaacaaacagcctgacagcctcgccaaacaacccgctcttcgcatgccggtagattgcagccgagcatgcgaccaaatccctaacaggcatttcatcgaacatttggcgaggtcgcgcgcgagcggaacacccacttcctcctccgagccgtttcatcgaacacctaccgcgcacaccatctgaaccctcccccagtcccccaccgacaaccactcaataggttattctctagaccctgaaacgaaactgtttcaagtgacaaaaggtcgcgattcggggat

SEQ ID NO: 39806 - DNA, 5927 bp, Oryza sativa
  unsure (1)..(5927): unsure at all n locations
tcctcccccctcttcctcctcttcctcttcctgagggggcgagcaagggggtacccgttctgcaacaaaacgctggcagcggtgggcgggagcaggagtgccagtggcgggcgggagggcaagcgaggactaaagcggcgacgggcggcgacgaccgtcggcggtgaacatgagggtgccggagtgatgccggtggaggccgttgttgcctccctcaccgcgggtgaccccgccgacctccgtccnttggtgcgnnnacaccgccacaccaacattcccctccctccgcatctcttacgcgcccaacttgccacttttcctctctatttttcttggctccggccttgccgtcccttcttgctcgtcctcaagccgtcattcggcgattccaccggcagcagagacgactcagcgttgacgacgtcgacccccgccgtggccacttcatcgtctacggaggtgacaatggggagcgtcatcccagtgtagggtgacgtaacgataaggagagcgagaagggggaagatgggaatgagagatatgatgacatgtggggtacatatgtcactgtgtcccataatatttatttgtgaatgacatataggtcccacatatttttttgcttttagttttttattctaatacaacataagcgacacgtcgacacacgtgggacaaagaccgggtcaacaccgccacgtaggcaccacttgaaccaaaaccgcttccaaaaccaccaaaagatatagtttgtatcggttttgatagttagagtccatatacccagttttgtggttgaaggtcatgaatcatactcgggccatacttgagggagtcaaagtatactttttccctgctatcctcattatgcctatccggcccgtagatcatagcccaaaagaagcccaacagggcagcagcaagcagacacagactcaccctataaagacacacacatatcctactctagatgtacattcggaagattggaccaaattggagtggcatataatatagttatatgctatagcgcatgattcggatatgatatttctaaaactgtgaatgatgcaatttttaggtggattgtttgacaaagttctatttggacaatatgatttgatattctaatctatttattttatattataagtcgttttgatttttttagttaaaagtaaatttatagaaaaatatagtagtatttccaacacaaaataagcatattactccctcccccgcattcaattagacacggtcaaatttagcacggtttccaaaattaatttttaactctaaatttatcatatattacaatgtttgtagcaacaaaatcataatcatataaaatatattcaatgttaaattcaataaaattaattgttttagatattgctaaatttttctatgatactgatctaacttaaaaaatagtttgaccaagaaaaattcaaaacaacttataatataaaataaaactgagggagtacaaattagtacggaaaacaatcacggacacagggacgcttgacggcttgagtaaagcaatcttgctaattaattcatcgtatgcggaaatacactggctgatatccaaggcaacgaaagaacaaggatcacatactgcaacaaaagaactggagtagtagaaggctagaagctagccctaccaggtgacacgcaactttcagtttatactgtacgtacggtgctttgccaccggcagtacagtagcctccaggtagcagagatgcgttgcttctctgtaacgagcattagctgttatgtcactcttcctaagcttgctttcatccatctcaagaaaacggcgttcctgcacctaatgcactaattaccctatactcagtagcagaccagagtgagaggccgagagcaatgccaggtgcaaaaaccatcttaaatcacacgcaaaaatcttgacttgacaggcagaatcattcatcatttcgtcaaaggaaaactcagctaccaccactgcactgtaaccaccgagacattcagaattaagcaacgaattcgatctgaaagtgcatgtctaggacaattaatcattagctcaaaggaattgatcagctggtgtgtttcaggcaaacaagtaaacaacagaattcagtagtacataaatatatatcagcgcgtctccatgtatagagaatcgattatataggtttgaataaacattatgcgaccgaagaacaggaagaaaaagagaaaaaagaaagtgtgacaagctcaaaacaaattaaaaggcgtttaacgatgacgacacattgaatcatttctagaagcaacagcgcatctgacttggcttagctagcagctaacatgtttctgaagcccttttttagttccacacatcattggatggttggccactccttcctaatctcaaagtagtaactcatctccaagtagcatttgccatcatcatcaacaaactgatttaacagaaaaaattacagccatggttagtaaggtaattacctcgattaacacatcagagctgaacttgatgagtttgaatacctttagtttagcagaataggaacctcttgcgaacatgccagctggggtggtctcctcttcaccctcatatgtgtagggctctagctggggactgaatgtccccagcatcaccttctggttctcaactgcaagtcagaatgcacatatatgacacatcatatgacattattggagttcattgttccatagataaaagaataccttaaatgcataattaaatttctcttaattaacatatttctttactgaagaatgtaggaaaatcctcgaataaaatgacctaatgatctaagatcagtatctaaaatggcatgtcgtcgttatatttatgaagagattgcagcacatacatgaagatcatatgggaaatttaatggaacgatcaatttgtgccgttgtttctagaaattcaagcgccattttatctgatctacaaaataaaatacgcaggttcaagtcgtgcgttgtgtgtcacctcttactccagtcttccagacagtgttggtgtacttgaggcctgacacgatgttgttggagacgatgaagctgaagcggaagctgtaagtgctcccgtccttgagcgcgaaggcgtagcccttctcgtcggggacgaacgggatcggcagtacaaggtccggcctatccggcgacaggatggtcaggttcagcaccttcacctccggctcagcagtctctgcatatccatgcgcacgcccaaaatgtcgttacagatcgcacatcaagaatgtgtcaacgaattcaggcgagaagcatatataatgatgaattggaaacaagcgtagatagatacctccaagctgttcagtatcaacctgcccgaggagttgctccttccacctcctcaggctctcatcatcctgcattcgcagaaaagttaaaactatattcagactcaattagcatcagatcaacaacaatggaggaatgcagtggattatattacgtaccttgtcgagctcgagctgctccttgagggggacctgggggccgagcacgacggcgcgcttgttgccctcctcgtcctcctcctcctcctcgacgtcgttcacgtcggggttcctgcccgacgcggtctgctcatgctccttctccttgtccttactgtccatgggcgcgcgcgcgcggccggccggttggtggtggctcgcggacggacgacggcggacggagctagcgaggtagcagcctacagattaaccgatcgatcgcgcgctgcggtgggtggcgctccgtatgtatgggtgagggggagggagcggctgggcgcgaggggtggagggccgcgggatcgatcgagcgcgcggtggtggtggtaagtacgtggtgtgcgtcgcggggggcgaggaaagggtcgtggcgtgcaggagaaacgcgcggccgcggcgggacgggagagggtgccaagtgtgcgcgcggccggcgcctccgcggcgcgcgcgcgcgggatgtccgctcgatcgatcgctcgctctctcgtcgatcttagcagcttgctcgatcgttggctcctggctgctattgtggttggcgggccttttgcgttcgagttcttcctccctctctctctctctctctctctctctctctctctctctctctctctctctctctctctctctcgtattttcccatgttacatgctctctcttgcgctccatatcctcgctcctcttcatgcaacgaacgacttcattaacgaactttaaatgatattttatcttaaattatacttatctaatatgtaatccgaatacagcgccctatttgttacaattaaatctctactagtacaaaatatcatgtaattatattctaataaaaaatgtttagatggttaaaatattgtgttttataccggacagtgaaatatttcaacagatattttattgtgacgttgcaattactaaaacgattttgctatacatcttacaagtgattttttcactagagagaaatcacccgacaaaatggatagacagtttcctttgatcatgtgacgtttgattatttttttttcgccactagtcagacgcccgatacctagctgcgtccaatgttttagaaaggttttcttcatggaaactgtagtcatcagatttattgtaggaaagcaattgattttttggaaggcatattatctccagggattcaaatcgattttacattagggggaggtgttaacagactggactctggagtttggacggtattaaggcctactcaggctctcggtccatattacaactgggcccaccaagttcgtgtacaatattgtactaggtgggctgagcaaagtcgagtcagctaccagattgggccgggccgagtagcacgaaaaccatcgcgtgcacgaccactccaaagttgctggaagtccgggacggcgatggtcgccacgcctgtgcggtggccgcgggtgctgactccggcgcacctcgccggcgccatccgccggcagaagagccccctcgacgccgtccatctctacgccgacgcgccgcggcgctacccgcgctcctcctaccgccacaacgacgccgtccactcctcgctcctcgccgcggcctccgcatcctcctccgatctcctcccctccttcntcngccgcatcctcccgtcctccccntccgcngactccntcnttgccgcttccatcccgcacttccctcccgntgccgcagtctccgtcttccgctcctccctcccatcctccctcgcgccgtcttggtcacgatcattctccgccctcctccgccgcctcctctccgatggcttgcttcccgaagcggcccgtctctttgcggacttcgcggggaggccggaagtctctctagcgtcagaagacctcacctcgttgatcactggattgtgccgtgcgcggagacctgaactcgctctgcaggtgcttgatgaaatgtctaaccagtgcctcgcaccagagaaggacgcttatcgcgcgatcgtgcctgcgctctgcgatgctggcatgctcgatgaggccacacacgttctctactccatgctgtggcgcgtgtcgcagaagggatgcgacgaagatgttgtggtgtaccgggcattgctggtggcgctctgtgcggctggccgaggtgagcaggcagagattgtgttggataaggtgattaggaaagggttgaggtcctcaggtagccggcgatctctccgtgttcctatgcttgctgggcttagtattgaggatgcccaggaaatcattgatcaggcattggttgttcgaggtgggcgtactgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39807 - DNA, 1078 bp, Oryza sativa
acgttcagaacgggatcgtaaggagtttccctcagtatcgcttgaacggccctgatgtgctgggctggagtagtcgattaattccccgcttctgtgttggcgtgcgctgacgtgccaacgtcatcgatagccaatacctcccgcggcgcgctcgttgtcgatgacccatagtcctcaaggagatgtaagaccgatggttcgtgaggatcgatatcgattaccccaacgaatcaatctgaagttggagtcgctccttgttccttgccgttatccctgatggggatatatgacttaggagactgagctttcatggcgccgagaaagactttgcagctcgagaggacatgattctttgtcttgtgaataggacaatagacatcccgagttggagaagtacgctgaattccacgttctttgcaggcgcgaatttcagcacggacgttgaggaaaacccagcaatcttgcagggtgtgtttcttggttttgtggataggacaccaagaccttgtggcttcgtaagtcatctttgtcggctcgtggttcatgtcggaaggacaaggtttggccgtatcagaatccttcttgagcttggatgtcatcgatattccgttctccgtctcgacgggaggatttttcgacatggaatcgccttggttcgtagccactgcgttctcgtctccggtcattggaggaccggttgagatcggtgtcgtggtgtaaaccgggaagacgatttcgccgacttgagtccataccagcattgttgaagcagggagtacttggctgaggctggtgctgacgttgttgtcgacgaagctggatgacatagtagtagaaccttgagtaccaaggacccctacctggcgctccactgtcgacgggtgatacccgtagaccggatataaagggtattggggtacgttggtacaaggatctacgtagtcgacatcaagcaaacaaaagacaagatttatactgggtcaagagacaagaatcccccagttgatgtgggattatatggtagaaaacacaggttacaaagagaacaagggaacttgtcggatccggcgagattgta

SEQ ID NO: 39808 - DNA, 11609 bp, Oryza sativa
  unsure (1)..(11609): unsure at all n locations
gcgccgcggatgtgtctcacgcgcctgtggggcccacctgtcagggggtgacgacgacctgccaatatatgctcatatatcgaatcgatggatggatcgatcggcgcccttcatgccactgttttcgttctaagagatccgtcgtcgtcttctactagtagggcctgttaggtttacaaaactctcaaactatcggtagtgtcaaaacttaaatacgttctgttacgatagatttttggtaagataaaattgtatttggtataaaaaaccaaaattttttattagaatatagaaactaccaaattgaacattggcgatactaatgatttggctttaaaccaaaacaaccttgtctactatgtattcaagataacaagctattagtaggtcatgttttggctttaatcaaaaacagcctgtacttcccatcaactctctttttcgtcgcatctattggtaactgattatatatataatttttaaagagcccaaacaaaaccatggttacaattgtctgaattatgataccaatagactgaataaaaccaagtcgttccacttcatttcacctcaacgtatattcttgtaaagcaaacaagcgaacgacccatcatgtcgttcgtcgatcctaaatacatcatctgagcattaccgatagacggttaaaaataaatccccttctctaataggatttaagggatgaaaatattttcacctataagagagaatctaatttaaactcaaaaaaggtggaccacatatgaaacttccaaacaaaatcgctcttttcgtactcccgtgtgaaaactctccaggtgcgtgccaacttggcgattgggagcaaggctgtgtttagttcacatcaaaattgaaagtttggttgaaattggaacgatgtgatagaaaagttagaagtttgtgtgtgtaggaaaggtcgtgtttagtttcaaaataatttttcaaacttccaacttttccatcacatcaaaactttcctacacacacaaattttcaacttttccgtcacattgttctaatttcaaccaaacttctaattttggtgtgaactaaacatagcctttgatatgatgaaaaagttgaaagtaagaataaatttggaactaaacatggcacaagaggtgcttgcgacttgtggagagcagcatttaagaagaaaataaggactaaaattttaggattgggagtagtatacgataaattgtacacccgacggaacagctcccggactacgacacagctcccggactatgacagtccgtgtagtctgggagttggttccctgtaatttatcatatactactcccaaccctgataaggcttcgccgccaatgtcaccattgtcaatcaccaaaaaatgcccttaaaaattagccggcaaaaaaaaaagctcttcgtcacccaggctccacgagtccacggcaccggcgccgttggcttggctacagcactattctctttccgtgcaccagcaagcctgacagtggttcattaacatagagatcgatatataggaagatcacgtagaattacatgtacatgtctactgctcctatactagagtactactatagtagctggctatagggcgacatggtcaagttctgatccatatatggttgctgctgctgctgctgccttaatttgcctgccaatctcgtaacagatatgcaggtcaatctgcacggagcatgcatacgtgatgaactgatgactcggtcagtccatcgattgatcgatcacgattcactagcagccagtgcattgaccattattcactctcatttaatttcctcggtttttcatctgttgaatatgatcgatctgattgcgaggtgttgtggagtaattcattccccatatggagtatgtgtgtgcatttcgtcctcctcctgactcgctcaaagtgtagtagtaatagctatgcagttaaggattcaggagattggggcattgactggcttctgaaatggaggttgaagttgaacaatgagacttccagtgcgtaagacctgtaactgtaattcattaatacgagtaactggttagaagaggtcaaaacggccatctctcatgatcaatggctgaatgatgcctcactttctggactactatcataaatgcaaggaattgaattgaagtagaaactagaaagtgagtactggtattattacaagattgaacacttcaatttgttgtttagcaaatttgcacatccacaattgacaccaaggcaaattcatgtggtacagagtacttgaatactgtatcaaatgaacttttagcttagcatttgggaagccttacccttacgacgatggtcacctcaccagctcacctcaatctgccgctgcctgccgtgcaacaagaaccaagaaccaaccccgtcttcttccccatggagcacgacatgcatctgcatacatgcacagcaccctacactccaagtcagcaacgagctagtagtaccatctgcagaaaagctgctttttgggtggcaaattttgttggcgatacaatccaaagagctttgcggttgagcaggtgtggtagtggtggtactagaaccagtacaccacaccatctagaacctcagcccagccgaaagtgcttaccaatttgttgcaagatcagccagccagaaaaactactgcatgctgctcctctgcttctgcttcgatcccccatcatctcatctcgtggacggacgctgcctgccacgctccctgtcacaacattgcatcagtctcggggcatgcgttgcaagcaatggcccccatggccatgaggtcctcctgacccaagctgaagaactagacaagcgcacatttacattggcggggccgggtacagctacgccacgcccgtcgaaccggaggaggagggaggtctttgttttaggctttcttctaatcttccctgcagaacaaacaaaatgggaagaagagaaaaaaaaatagtatgagtgtgactttggtgtgtgtatttcagatattcatttatgaggagtcaactgctagctacccaactacgatgggttggtatcgccgtgtttagttccaaaatatttcttcaaacttctaaattttccatcatatcaaaattttcctacacacataaactttcaacttttccgtcacatcgttccaatttcaaccaaacttccaattttagcgtgaactaaacacagcatatgtctagtaggagtggttcttgacattcttgtgatcataattgggatagtagtatgtactccatcaaattgtcaagctgaagtgaaaggatgtggatgttacagtcagtttgtcacagtaaaaacaagagaaaattcagggatttttctctaaaaacaatggctgcaccctacctacctaactttggttcaggtcctaacatgggcgtatttccttttttttttaatgctagagctatcgcctccttttctgaaatgaaaaggggaaaaaattgaaattttaggtgagacgactttcaagtatacaataactaataaggtcttaggagccatcaaatctcattacgacggtttggataaaactcaacaagccatatgaaagctggaggccacatgcgcagatatggctgagctgtctataaccttataggactacctttgacaagaatcaggaaaccttctatactgaattcttttggtgtacctgttcacaaccaaatttggtaatttcggcatcgggaaagaagattagatcgaagcaaagtcggaggcggagatcgagttcggaaacagagcaggaatcagctggagtccagatcggctacgattaggatcagctgggtctgagtcaggctaggcaagccgatgcaaccgattccgacaatgcgacttgatgtatgacatcgggttgaattgaggtgcttcaaggtgattgccgcacatggatagagtcctgagaaggcaattgtgtctattaattagagtgttttatgtaatttccttagagatatgcttgagcaaaagtctgccgtaaagacttatggtatcttagagtttgttagagatagttgtcatgtccgttatggacatatcttgtaattttcgggtataaatagacccgagccctatgtaacttttaacacacacgctcaatacaatctcggcgcatcgccacctttttgctttaattttatttcaacgagttcttgctttcgggttgagctgcatcggtttcgatcttcaacaagaggtaaaacttgttatgatgaattatgttctcgagattagtgcttccatctttatgatactctaatcttgtctatgtaattcgtcaagttattatatatcttacataatcttcgacaatatcgtcatctaacctacaatcggctaacatctgttaacagaaggcagccgatttggttaaatagcgacgttgacctagattatataagatatctaccactctatgaaacttccagcggcttgattgtctagatattgttcttcttttcatacttaatgctgcatcagccgaatttgatctcttaagtcgtgcttagaatatcaatctctagcatgtactctggttccgattagggtagtgtcggagtttcagccgatcttacctgatttaactactttttatcctatatgcttgattgacatgttaaatctgccctttatgttaagatcttgctgcatttaagtatattaggcttttgtctagtatattctacttgctttaatatcttaatatagagtggtatcggagtattagccgatacaggctagatctatttgatcggctatgctatgaatgtatatagtctcattattaatatatatttcgatttaagtgatttatattgtctcggcatggcgaccgatctattccaatcacttgatttaagtatatatcgatacaaagattatatattgtcaatatctgcagccgatcgagtagatttagtcccttcttatttattaatgactgccgatcaaagtatatatgacatcggctcaaagataaatgatatgtcatcggcacctagccgatcggctatcatttatagatttaaatgcggtttctttgcttctatttcttgttgattacaggatcaaatcaactggcacgctcatacattcgaaggcgagctttggacctgcactggagttaagcagatctcccaggcctcgtgttttctgtcaacagtaccacaactttaaggagaaactgatgctgaaatccaagaaaatatagtaagcaaagaaatactattaccaaggcatctaaaaaagtaaccaattgacttgcatacctgtttaggtatgagctgagaagtgattgcgggtgttttgctataagttttcactgtaccctttcctttattcgtgctcagtaagggccactcctttccttcgatttatgcagaactctttccaacatccctgtcgaaaaacacaagccaatataacggacatgagcaacatcattgactatgcatctatgcatcagaaaattgcattctgcagagaaaatcggaagtgcaaactgatgggtgagctgctggagcctggaagaacccgagcaaggaatgtaaatactagctaattgacgtcagtacccatcaatcagtattcagtaataatccagaggattggctagatatacaatcgactcagctagtagtttgcatgaccagctgagctacctgtagcccatacagcagactcagcatgcatacatgtaatatataaaaaaggtacacaaaggaaaaaaaggcagagtgtttcttttgacaaatgtaacaatcagcgtactctttgatatatataaaaaaaacaatcagagtaactcatgcacatgagaaagaacgtattcacgtacatggtacagtgcaaggaaaataagcaactgtttatgataaagaaagtgagtgcccccttttaaggaaagttttaatggttaaaatacctatatgcatcgctttcttcttttcaatttttcatatatttgtcaaccacacttcaatatcataattatctctgttaagcaatttccttttcccgagttaaaattttgctctggtacatgtatgattgataaggacattttcgaagagaaaaaagagaaataattagcggtagtgtacttcaaataatttgaataatttagacagaccactctcagggtttcgatggatatccacattgagggctgaaaacgtgttctatgaattcaattctctcaaacctacctatgaataccaaagaacacaatctatgtactcctagggtccagaactgtctactatataaagcaacctatttatacacaatcttgcctccttcaattgtctaaaacttagaaatgttaatttaaaacaacctaaattaaacaatttcatctccttaaattggctggcatgtactaatgttactttgttttctctatttttccggtttattacaggcaaacttaaagtagttggtcccattatttttccaagcatcaagggaaaattccagatgagcatttgcttaagtctgtgatacactaggcatgacaaacttttagaaagagaaatctctaaccaaccgcagaattacaccataatgatggtgatatccaatcttcaggagcaaccaacttgctccactggataagtttctttctttcaagaattgaagtagtctatgatgtagcacaattattaatcgagaaagtgaaactagcgtttgttttcttcatagcatcttcctttccatcggagaatccgtggatataacacatgacaagtatctccatatcattggtgaacatctttctttcgttatgatggactacagcagatgtggctaccttccctgcctaacatggccgttgtggaccccacaaataggaaccgtattaatcttaatatttacttacaagtttctcttactttgtatatagacagaatcctctagcttgcttgtgccaaaatgaaactgtacacaaaaggattgtagcaaacatggaaaaaaggacccaaaaaaaaaaactaacatcatgtaagcttagcaccatatgtttttaaaatgaactttgattaaaagtgcttgtcatttaagcaacctgatgaatgaatgcaagcactgtttccaagtcatacaaattatactaataatgcccattgacattgacatgtgggactcggccttgtattattgtgcttgttgaagtataagtgccgattccaaagttttatgatgtactaattatgtaaacatcaggccttaaagcagagtggtattgacatctgagtgcaagcagttattatagtatgccctagagagaggacgtactggcagcgctacattatggcttatgccccatgtctcagtcctagacttttggggaaatcaagcacttcactgcaccttttcacattagtatgggtattaataaggccttgtgtgtgtgtgtgcgttatatttgttcctttaaggaatgatataggatttgaatctgtgattaaatgtttgatgtggccaactacaacagtctttaaggaaagagtgcaaacaagaggcaggcatggtgaacaatttcacctggcaatatttataagggttgggcacttggcccatgcatattctcttaagcacaaccaggcaaacagagaagaagttccccttttaggccatcctttaaagctaaatcagcatgatgcttgaattctagcaaacattagttttaatgtcataaatatactctaggtatcattgtcatattccttctactccagtgtttaataaaaaccagcccatccataactccaaatactgtttcagctctcggaaaagaaagagctaagctgccaattaattgggagctttatctgaatggcatatcatacctttccagtttaatagtggtagtcttccatgatgacaatttaatgcaagtagtttatacacacatgtgaagctacaagtagtaagctgaacttgggagtaagctgcaaacctgttagagcttgtctatatttggatcttcaggcctccttctcaatgcaattagttgtctttctccttccatcacaattattaaacatttaaacataactaaggtttatgtgctggaaaacagtagtaattgcaggaacaaaccaaatatatctcctaagatatgaagagataactaatggaacaattatctttgaaaataagaggactgataaaccaaaagatcatctttgaaaatgagtggacggatataccagtctctcaagtctccacatccaatacttttttcataaagttattctacctatttcaggcaatttatctatactctcagtcttcccacatccaatagccctttagttaatagaatagcattttgacaattaatgctacgtaatgtgtcaaaccatcctaaatattctgtttgacctcaacaagttaccacccttcttggttcttgtagaatgcaaaccggaggcttctctctgcaattgaaaaacatgggatttataaagtgaagagaaaacaaagttcaccaacgcgatagagggcaatcacaatcttatgtcagatgacaacatgagcatttcaacacaactgtattgaaccagatggccaagatcctaattgaattccaccacggatcagtaattttcatttagaaaaaaataacaagttatctcagatctgggctagacctgatcgtttgcaatataaagataattttcgaccgtgatccattgcgcacatattccacgctagcatcctctagattgggcctgaagagaaggtaacaaccaaacaaaatacagcaaaagaacagtgcgcatttatgtagtattggtggcttggtgctggactgggaagtggctttataccttgtcttgaatagtgggccagctacttccagcatggggtcagatagcacctccaatggtccctggggacttattagtggagcattcagtgctcccttgttacagcctgcacctgtgtagtaccagagttaacacagagtcacagaccagcctagtatactgaatgtaaactatcccagaccattcgacttgctatcagcaagatgatgttactcaaagagtatcaggtggaaataaaattttaacttcattttagctattgctcccaaataatatatgtttttccctgtacaaagagataacattgcaagagagggagatatgcatatctctcttgaaaatctaccttttattagtctagagggaacaacatggttggagaatggaaacacttacaatggttatactgatcttacatatttccgtatacaaaataatgcagaaattatttgtacatctaagaaaaaaatatgatggtttgcccagaatgatagattactgatgataataaagctagtagcttgcagaaatttgaagctagcaggtaaatactaatacatgaaagttcagagtaggaactagaatttgagtagtcatagatggacatacgagattgctactgcacattactttccatattcaacttaaggcgaatgtgactggttagtgcaatgatcttctatttcacattacagcgaagagaaaatcagtgtgaaagatccagtctactcttcaagttcaaaatagtgcttgatcatactttgcatctgaaatcaatgtgaacatcagtttaggtttataagttagaagtatacaagcataatagaattaatgaattatacaaggacaaaaggaaaacttcgatactgttgccagaaaaatgtagaagaatggaatgtgctacacataacgcaaaagattgccacctgaaatagttttaaaacagtacagagcacagaaaatttaatttcagcatatggcatacagaggtcagaagtgttcataaaatcaacaaagcaagctacttccccaagaacatctgaggcctatatttatgaacacaacaggttagaatcttttacagcaggaatgagtgaatgagagtataaaacaacacaacactattgcacatcattacacccatgcgtgcaaaatgtgatgccatattcgtaacaagccataagttagagattcagaagaccacgataggatcttttcatattcataccaaacatttgagacttccattagatggcaaatttctagataaaccaacatacttgctcaattctacaggggcatcctaacttaaattcatgagaattgcacacaaataagtaaattcaaataggaaagacagctgttatgttttcagtaaaagcagggccatcatgccttttgtccaaaaattcaaataggaaggagaaacaccagccggaaaatgtataccaggcagaataattagttaatgtagatcagacatggttgagttgtatattgcactagccagcacagaccctaaaaatgaactaacagtaagccatttgaaactattgtgcttgtaaacaaaaatatatgtaagatgtaccattgtacacaaatttcagacaaacataactatatgtacataatctacattagtcaatacatgagattcaggaatgtttcaatttgaatgtgtacagcgaaattactcttaaaccagcaataggttacctgattcagtcaatatttccttcagacaaaattggtcagcatttcctccacctgatctccccccacttgaaacttctcgagtgaatacacaactcatgatcaaatactcttcaatttctacattgattagggaacagaataacccaccaccagcatatacatgtgaatgcaccaaattcaatgtatgttatgttagcaaaaaggaaccggcatacatattcaaatggtgagtgcattgttaatttccgaaagaaagtgtcacaaaactgaaccatcaagaagttgttccaacggatttcatatgaatggagatgaattagaatcatacagctgaattcttgaccccacatcaacgcacaagatcaaccaaagttttcctccgagggaaccgttgcgggagccggagcgacatggcatcctcaatctcgatgggcaaatgcgtggcgacgaacacgatcccacccttcttgcggtgctccgctatgatgtactccagcagcttgacaccctcggcatccagcgcgacggacggctcgtccaggagccagatcgggcgatcgatggcgagcagcctggcgagctggagcctcttcctctggcccatggagagcatcctcgccttctcgttcatgagcctgccgagccccatgagctcgatggccggggccgacttgccgtgcttcccctcgaggagctcgaaccactgcacgttctcgagcacggtgagcttctccttgacggcgtccttgagcgacatccagttgagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39809 - DNA, 5512 bp, Oryza sativa
ttagtagatccacacaaaatatgcatgtaaatcctaaccagatgctcggctacccacgcagaaagaaaaaaaaaaaaggtagtaactatattaaaaacatgatcctatgtctgcttgttagccgcaatggacacgacgattaaggtaattaattaattccataattcgatgcatgtacagggacgacgacacactacaggggttcaacgatgaacaaccaaaccatgcgtacttaagcgtcactggtacggggactacgggttactgatcaaatatcatccctagctagcgctacgattcacatgcacaacttaattaatttttttaggaggttttaccatcggttataatacggagctagctagctaataattaaccttcaaatggactgaagcttgctgctgctgctgtcatctgtttcttcagatgctaaccgccatctggctcatggaggcggcggcggcggcctcctggcgagaacgccgcacgccgtgcggggacttgcccttgcagccgccgccgtcagccttgcctgccgccgccgccgctgcggcttcggcactgtcatcgccgccggtgccgtcctcggcgccggcggcctttgtattggacgagacgccgggtttctccggcgagccatgcttatgcttacctaccgcccccgacgagttgccttgctcttgcgccgcgcgcctcaccttcacaccacgtatcagctgctaataattaagagataaattaagattacggttaataattaattagctgctgcttgcagaaattaacagaagtactccataaacaaagatactgccaaactggtcatccgaattaaagacaaacagtggcatgcagcaactatatatagcttattggcactcaaaatcacatccaactgagttgagttaaagagtactcgaaagaagtgggaagggcaatgatggatgaacattacatatttgcctgacttgatatcggagtagatcacaatgaaatcaccctcctgcagctcgtttgaacgaacaaaatcacctgaaaaaacatatgacaacgattaatcaacaatacttgagagccacaaattaaggatggaagttattggcatggcttgtgactgtaaaatttgaataattcaaaagtttgctattcacctgtgttttcgagaagatacatcctgcttttgttgttgggccaaaacctgtgttcatgaaaatcaatatccattaatgtcagtgaatcaaaatctaagccatcatgtattcgaataacttgtgcatatataatattgccaatggaaataattaaattaattaatcaaaaacatgagctcagcagaaccagcaaaaatcatatgcataatgttagtactgaaaacagcaggaaaagatcacttttatttttttgttgtatgcacttgagcatcaacatagaacacgatgaatgcatgctcctatttgactcccagattccaatgatatgttcgtatgacccacttgcccaattgggaaagggaccatcccatagtcatttactatttctggttcagaggtttctatcccctcccaattaacaaagaagcaagtggacttaaacaagcttaataagcaatcccaaatcatgcttgatgcttcgatcgaatgttgattactcaccggtaccgcatgttccacacctgagacgtcccgatgtcttccatggggatggagacaccatccctcgtcttcagctccggcaggtgaacctctgcttccttctgaaaccatccacagatcaagaaaggggagactttttagttctaccatgatcggaaatgtgaagagaaggttcaggcaaattccgtctttgattaggggagaaacatcaagtatgtgagtgtgtgcaagtgggatccttccatggaatggatttgtgccaagtggggtagtggatttggaaggagaaggtgttcgagatggtggtgactgtctcactttggggagcacgatgcggccgaggctcccgacgtcgctctgcttcagcaccttctgcagcaggaaccgcaggttcttgtccgtcttcgcctgcagcaatccaatcgatgccgtttaattagctaggttgataaatattggagattctatccctggacagcgatgtgagtgagtgagttttgagtgtgtggagtgtgtgtgaggaggagaatcgagttctcactcgcgtgagatcctagctatggtggatagcgattgatgtcaatcgtctgcatgcatgcacacctgccgcttctctgaagccgtcgagcgctgaaggctctccgctccggccgtcgccgccgcctgcggcttcggcttcggtttctccggcgagggtttcggctgcttcgacgtggcgggaggaggattgggcttgtttgataggggattctggatgatctgggccgccggcggccagatgccccagctccggcagccggccgacgacggggtgaccggcgccgagtgcgcggcgcgaggggagggctcctgtggatggccggagatgtggatctggctcaggttgagctgctggctacgttgctgctgcaggcaggagaggcggcgctgcctcgccatccgcttcttccgggcctcctttgtcgaggacggctcgactccggcgaggcgtggagagcacatggcgtggccgccggagtactgcccggggaatccggcggtgaacggcggtggcacgaccgacggcatggtgtaggagctcgtggaggagacggggaacggcgcgaattgctgcggccaggccatgttccctccgcccgacgcatgcatgtcgcccgccgccgccgcggtcggcggggagaacggctggctgctcacgaccacgctgctcttgctgcagctctgctggaaagggaacgggccggcggcgcctgggtacatggcgtcgccgccgtacgcggctggcggcgtgaaggcctggtagggcatccaggatgtggcggcggcggagcccatctcctggccaccggaggggaactcgtagccggggtttgcgccggggctggggagctgagggtccgacgacgcggcgccgtcgtcaatcgccgtgcgggggcgcttcttctggaggtggtggtcctgcacccaggtgaggatgagcttgagcagctgcatggtgccctggcgcccgccgccgagccgcgcgcccgccgcctcgatggtggatcggcggaggcggatgctgcgggggtcgtcggcggagatgtactcacggttgctcgtgagccactccatgaagaacgccggcagatcgtcgggcgcatcactcccctccatgcatgcgtcgcgggcgtcgtctcctcccccgggcgcctccatcaccgctttcgtatcgccgtcgccggtacagtcgtccgcctgatgcggttgcccggacatggcgtcctctatcatcatgccaacgtcgtccgggaacagcggctgctcggcctcccacgggacggacagcgacgcgaggtcgaggagctggtctatgtcggcgagctcaccaaacccgtccgccgccgaggccggctcggacggttcaccgccgcaaccccctcccgccgcggtggtgaaagcgctggacgagttcgacgacgacgacgacgagaaggttgagcttgacggggaagaaaggcacgggaagtccgggagcaacgggaaggtatcgtcagcgaaaaagacgtcatccctcgccgcctcacccctgatctccgccgccggggccttcccccgtccgccgccgccgccgccgccgccaccctgcttccccgggttcccgtgcgagtgcggcgccgacgagccggcggaggcgtccatgcagagtggaggcgggcggggggcggagagcgcgagatgtaggcgaggcggggggtttggctttgtttgtctgtgtgcgtgtaggtgtggaggtgggtgcagttactgagaaaggagacgaacaggagaagcagcgggaggtggagggtgggagagtagagagagaagagatgcggctgcggcccacacgtggcggccgccgagggctgtgggaagcgctccaccgcccacgccagcctctcctcagcgaccgtacctttcgccccccgcacggcacggccacgtcccactgacccgtgggccccacatttcctctgggcccacttatcattgctgggggctgcgtttctggtgggtggggttccccttttttttcctgagttgtaacggtcaatgacagtggggcctacgtgtcagtgggaagtacgggatttcggcgcgtgctggttttgaccgccgcggcagagggggagggagaggagcgttcttgcctgtggtccaatgacatgtgggacccaaaaggaaaaccatagagtggtagggtcgtgtgcgcgtagcgatttatgcgcgccgtaggatgtccgtgtcgcgtccgcgccgactaaggggctacgcgtccggtgtttccgagccgtccgatccgaaccaccgcgtgatcgaacggacgccatcttcgggaggagacctgtgtgctgtctggattaggaatatggggtgcgttttttctacgcgcacgtacgaaacctacacgagctggagatgatgacgtggaggtgtgggtcgcaccttggttacgatgacgtgggattttaccattggttgcagtggaggtggcccgtgtgaacacatgcagcgaacggcccagctcgatcgatcaccagcagccgggaagcgtaagcgctaagcagaggcatggcaatgccatggcatacgtgatcttgttctggccgttgcgtgtggaactgtgggtggagcatttgctttgtcttgttcgatcggaggatgcggctaggtaggatacatgttttgcaggggtaagagcaaatttccactttctctttgcttgtttgcttcgcaacaaatgcatttgaaaatgacagacaggcccccaaaatcagattaaaaaatatgttttctttggtgtccttagtgatgaggagcacccaaataacccatgcgacatcatccaaggattttattttttttttgcaagtttgtactttaaaatgagccaataaatctataatacacatttacgactacgtgtccttttcaatatccgtggaatcaattgatatattgattcatggatgcaaacaaaaacaattgtaaattttgggtcattgaacgatatatatctctctaaaatattatttatatcaagatgacgatatgcatgtatctttcattattaattgttcgctcaagcatatcgtatcctttcgagggaatgaagcatcgaagctcttgactcacatccaatacattgtctaattcaataattggatttgaacatcaaatatattccatgcgttgtgcaatttacaaatcatttttaattagtattttactattctcaatctatattatcgataatatgtattttactattcgatagcaactgtaaataaaggtcgttgggtgttacaggtcaacaatcatttgagcgatatggtagg

SEQ ID NO: 39810 - DNA, 12950 bp, Oryza sativa
tcatttgcattgtgatatattcatgattgatgacttcgatgctcggccacagggtttgtagcgcgcaatctatttgagcgtagccatgtagcattgtaccatgaacatatcaatatgtggtgacttcatgcattaaaagaagatggacacgttgtaaccacaatacaactttcttatctcccaacaacttatattacgtgcggacgtatataaatacaagaggctgcaacaacattttggctctttgtgattcattgatccgaggtaaggtcataaccttacaatggttcaccaccatgtatttttcgaagtacacccatgactacatctatacacgtacgcacggtgtttcgataaaacaattttgctatgagtatataggcttatggttcactgaaagacacacactaataaaaagacacaagatttggctcgtgttttggattcacgaataaatctggaaaatattttcaatgacatataaaattttctactatccccataaaaaaatgtactaactttctttgatcatggaaattaaaccctacaacaagattaacgcatatactccatctatctcgatatatatatatatacatatatatacatatatatatatatgcgatgttgttaaatcttagatatatatttgattttattatgtatataacaaattaaagttattcataatatatcgtaataaaagtttgtaataaaataaaataataattatataattttagtaagataattgaaaatagcgtaactgtatcattcgtgttagaataaacagaggaggtactcctaattcctttcactggagaccaaactacatcatcgactcatggcgtcgtaccacagaagcactagctgctggcaaagccgtagatcagtgggacgtggcggaagccaagccgtcggatcatcccagcgaggaaaccacccgcgaccgcgacgacgcaacagcaggaaaacccaaaaccggtcggactccacagcgacccctccgccacgaagcagcacgcaccaaaaaaagaagaagaagcgaagcgggggcgaattgaggcccaaatacttgggtggggtggagggccgagcgcgagagatttcggagagcagcgcgaatcccccaaaaatccacccccaaatcccaattccaaatccgacctccctcctcggccagatctcgccccctctccccggggggcctccgatcgaatcggcggctgcaccgcggccggcgattcccgggaggaggaggaggaggaggagtagaggaggggatctcgccgagatttggattgggtttggtggttgggtgggagggagggagctggggggtgtggccagccatggcgtcggcgcaggtgtcgtcgtcctccgccgccgccggtgcggcgtcgtcgtcgtcctcgcggaagaaggatctccacgcggggaagaagctggtatgtctgttgcttgcgatagacgtagtcgttggttacccgatgttggtagtttaaccttctggaaatgctggatctttttgtccagacacgtttgattgaatagggagcattgaccgctttgcgttagagatgtagttccatcgatcgttttgcttatggtagagaagtcaaatgcgcgcaaattacccccgtcatcagcacgctcagtttgaaatgttgaattttcgttacctagatcttgctatttcatcaactgatcctgagtgatgatttgatgcgaaattaagttcaagttggttgtagaataatgagtgacgtgttttactgatatatccaagctggcgcgagtaccgttagaagaagaacacggcggcgaagaaggctgctgaaactgcagaccaggcaacggcgcctgttcctgatacactagagaaccctcctccaaatgccaccagtactaactcgggagacaagttggtatcggacgtggatgtgaacacaacaagcacatcatctgtgccaccagtctacgagaatggcccaacgagttattccagaggtgacgagcccttgtcaaatggacctgcccctgtaaatgtgccagtcagtgttagtaatcctgccccatcgcatgatgtcagtagtgttggagggagcaagatttatgggaacttgagcttctctgacttagttaatgggcataatgaggattggagaggcgatgctgctcggaaaagggaggaacatagtcctgacaaggacgtgactttaaaatctaaattgagtgcctttggaaactcagatgaggtctcccattcttcagatgaggtcttgctgagtcagggaagaaatccagtcttgagggaagtaagtgacactgagcagtctagttcatattcatctggcagcctttttggaaagttagaaggcacgcaaagtcagggttactctgcaaacaatgatatctttggtcggttccgaggtatatccaagccctttttcatattaaattatgctatctgatgagtgatgataacttgaatatgtggcacttttaactctttacttttgctgctatgcagccacctctaaagactcttcccaagcagatggcttagcgtatgccagcagccgggagtatggaagtgccttcaataattcttggaatacatcaaattccacacctgtttgttttgataaacaggatccttttatgtcatctggttatccaactacatacaatcgatctcggccatcttttcttgattctattggagtacaaagagctccaacaactgaagtcccatacgtggagcctgcaaaggctagtaaaccatttggcaactcgaattctgagagttcattttttcagccaccaaatcaacaatccgctggaagcaatgatgtggatggttctctaaaatcaggaagacaagaatataacaacgagaagggatcatatggaaattccattcgtactgattcctttccttccaaagatgaacggaatctgcaccatagtactcaaatgttccaaaacttcacaattcctgggaaagatgatgattttgctgcactagagcaggtgatgagtgctcgatctatgttttcattgtctgtgctttcttgaggatatataatattttatatgtatgtcaggaatgacctagtaaaattggacattggacatgatattgagagctgtgcatttattaacaaaatctaaacgcttatttatgtttgtttgaattgatgacgcttacacctgaatgctattgtacacaaaacaaaagtttagctgaagttatgtctgtactagccatatgtccaaaagataattttaaaaagtatatgcttcataatatgtaacaacttgtttgactgcgtgctgcgtatagttactgttctgcgtggtgcagcttctgggtctatattctagacagaacgtccaaatcttgtgatggacgtgccatattctactaaattaacagccttatccttgattatatatttttacttctcctgaattgcatgtactttttgttatttacgagtatccgcatcctactcatgtctgctctggtttggctgttagctcattgaggatttgacaaaagagaagttcgccttacaacgtactcttgagaaatctcaagaattggctcaaactttggccacagacaactcagctttgactgataagttcaaccaacaggtatttccaaatctccattttggtttttggagttggatctagtatcctcacaaacttttgccatttattatgcaagtccacaacagaaaaacactttcttcacaattaataaaccagtttctgctataacgtagtatttcaatgtcaaagtttcattctgcccgtttctctgtctttccttgttgctctgccttattcacggtgaatgatattcaactagcataacatgcttgcaaaagtgtctctagcaactagaaaatgctaaatgagaatggaatagctaagcaatcacccaaaatttaccttacagtcaatacttcttatctgatcagtaaatcatcaattcttttacagcattggtataaggacagaatcaatactgattagtcatatttccagtcacttattgtcttgtgtatcatatttattattttgtttgcaaatgcttaggcacaagttatcagcaacctgacatctgacatggagagattgcagaacgaaattcaagctcaactggttaggcttattccaccttttctagcaatcattaagattctgtaattccatgcttgctatgctgacatgcttttgttctgttggttttttagtagtactatcgctgtgtaatttggaaatataatgtgctagttgcaagacatatgttagcatagaatatgacttatgaaatgtagaatgtctccggatatgaggagctagggaatgagttcataagatcacatggttcactatgtacccagcatgcacaatatgtttagattttggtgtttgactaggcaactggctgaagtatggcgctgaactattgcttgctaaatgcctaattcatatgaaagtatctccactaaatgtttaggttacttagtgtacatttgacttactgatgtttctggtagttagcatcatctgtgcactcagtgctagtatctatcaatatgaaacttatgatttagggccagtttgaatgtgcatattgcctgagcttacttaggggcacgcaacacagaacatgttatcagtgcattattaattaagtattaactattataaacttgaaaaatggattttttgaagaaacttcatatactttttttttttgcataaaacacaccatttagcagttcggaaaatgtgactaacaaaaaacgaggaagttgtagtttggagttgaagttttctcataatttgtatagttttcttaccaactccaatttttcaacagctggcacttgagtctgtcagaacggaatatgctaatgcccagctagaatgcaatgctgcagatgagagggccaaagttcttgcagcagaagtcattctacttgaagataaggtgcttagctatatactcgtctgcttcctctctaatgttgcaaatcaacctaaccttcttagtgggataataatattgacactgtttatagtttttgaatgctcattattttgagcaatgtttttttggagtatgttattatactataccttgagtacattaagccctagaggtgtcacaggctcacagcaacaaatcaaagtataatgacagatatcctatacacctgcaggtaggtaatgcctattatattcaagttttaatgcatcagatgtaaatatataatatcccttgatatgccaaacatgcagctgctgtttttttatctaacacttctctttaaggcactatttatcaaaagcgcatgcagtttgatatatcgctattttttaggctcttagactgaggtcaagtgagttaaagcttgaaaaggaaattgagggtttgagctctgagatttcttcatacaggtgaggttttctgctatgagtgcatggtatgtgttttacaaggtggggagatcaattgataagtgaaatgggcttcaaatataaatgtgaaagaaagtttctggtttttctcacattggcattcttgaaattgttatgcgaaaaaaatatgtgagtcttgtgttaacatgcaaaaaacatgacatgagtttaagtttactgaactcacacactgatcatccgagggtactgacagtgtttcctttacgattttcttttactatgcacaggcgcaaagtttctagtctagagaaggagcgtcaacatcttcaatctactgttgaggctcttcaagaaggtagttaccgttttactctgatgtaaaacttttttgaactcgttctttatcccatgcccaactcaattatctggtgagtcctagaaaatcattagttgtgttcacatcttgcacgcacatttttgttccctattatttaagccccatactcacacatcctttagtgtcacttatttttggctgtcaaataactaaaactaaactagaaatttatctgtaatattctagttggaataagacttgcatgtgtgtgatagacttaatttatgcatgaatattgccggttgtaaacttgacttcacattgatacttttggacagaaaagaaactcctacactctaaattgaggaatacttctgtgactgagaaggtcaatattatagaaaaaccttcagctgataaaagagatgcatcaactgcaacagaagatctaggtatgaatgttgatctccccttttgtttgatatctatgaatatgtatttcaattttcaactagtagtctgcttgacacgaaatatgcatcttcagatacaggggaaagcagctcttcagaaacccttaccagtgccattgacacagtagaagatggtgaaacatctgtatcgcggtccaataatgtggctgattttacttatttagaagaggtgtcttctagcatcccacatgatcagcttagaatgatcgacaatatcaactccttgatgtcagaggtaatctctttgatgtgcaaaaatccagtgtggttggtactttatatcacttacattgatcgattgcacctaaataaccttaaaccacagcacttgagtttcatagcctacaaaatttacttccttgttaatagtaattgttgcattgcagttggcagtggagcgagaagagttgctgcgagctttgagaattgaatcatccaattgctccaagctgaaggttttgttcatttcgcagcaactttgtttctactatttttgattcattgagcctatatttcttcctgtccagagcttcgatcgacccaatataaatgcgatgcatgtataattaagcactaagcctctagggtatacaaatgcctagggtcttgtatagttgcccaagggactatcccagctggcttaacctaccgggccctttcctccggatgaaatcatgtccaaatcgagggctattgtgtactgtaactttgtcatggtgtatctatcttatgcagtccattctttgtcttaaaggaattgaacaaggatctaacgcaaaagctggagattcagactcacagacttgagctgttatcttctcaaaggatggctaacgagaatgtccttccaaagccgatcgacacacgctccatcaatgatgcaactttgtatgctgatgaaggagatgaggtaatttagtttctgttatctaagcatctaacagcaaaactcacagatcacataaaagaacatctctttttcattattgttataaagccttttcatgtgttgacagcttgattttttttaaaggttacaacttatctgatgtaacatatttgattgcctttctccattagatcattgttatgattgtctgacgaaaaatatatacaggttgttgaacgggtgcttggatggataatgaagctcttccctggtggtccaaagcgacgaaccagcaagctcctctagtggaaagtagagttttggtataccataatgttttcttttcatttatatatgatatttttttgccctgttttggtgatagcatgatgagaagttgtatattggaggagagccccttgatgtaaccattcttttttctacagaaaatgaaatgtatggtttgacttctgtggagctacacttttgtattggcaatgaacagaatagctgccagcaggaaaaatacgcccccttatatattccataattatacgtggggtggaggtgtatgttgtaattgctgtatccatttgttatttcattcacttgttatccctagctctactatctccctcgttcattttctcttctgttatttgctgcaacttgtcatccgatttcctatattgctctggctactggttacaccggaagtggaagtgtggaacacacataaggaaaattatggtcctaaatcctaatccatatttatcgttactctaattttcctatggaaccttgaacaccatagcgctctctctctctctctctggtaattgtgccttgtagtttgaagactcgttatcaatgcagtgaaaattgtggatgcgatttatacacttctactcctagcaatccgaagccaaggctaaatgacaataccaatagaaaagactcaaaattatttataaaatgaagttctcaaattataagccgtgtcacaaagaagcaggcctgacatcctgtgtagtacactataatccacttttcagccatgcagcttgtgaagtacagaaatggacaaatcaaacttgcgattcttcggtcgactaaaagactttcctgttctctaaaagaatgcgaaagtcgatttttatccgcatgggatagtatgatctgaccaacgaatagactaaaatataacaagaaataatatatgatgactatttcttgttatgggtaggaacgcttagatagaacttggtgttcctgaaatcatcaaggagtggattatatccatctttggtcctagtcttcaacggcagtccaaactcttccatgaaggcagcagaatcaagctaacgatagttgacaaataacatcatactcgtcagtgcaccgaagtttgtaaaagatgtgatgcaagatgaactaggacactaggttgcatagaaaacaaaactggcttaaatagtctgaacttacaatgatggttctcctcgtcttaactggtttaaatgcaccggggttcttttgctgttttgagaaaccagagcagtcatggtcgatcttctccaaaagccagaaatcggttgggaagaaaatatctgcgtcaccctggcaagtaacataaccgagttcttttaataatatataataacacatagcacacaacttaattaaacacatagcataacaacttaattgctcaaagttatttagttctttttccccatggggttggacagtagggtcaactaagctacgacatgtttgcaccgaatctaatattcagatataacagaacagaaacattattcaaacctgagcctcaagatagttgcgatgatccaaagtcctcccgtccttctgcaagcaggacacaacatcaacgaggtgtcctagagaaattgccttgttggaaaaacgcaccaaaagtcagtgaaggtcttgtcacctttgaagaaaccaatggagctctatcgccaggtatactgacatcaggaagatagctgaaatctgaagctataagggacatgcttggcaaagcttgatgtaaagtatctagtattttctgcatatgtcataacacatatttcagagattctggcagtaagctgacaaactcatcagcatatgatcacatatagaataacagtttataacctaacaagtggaagtgggttcaaaagacataccaagcatccagttggtaaccaagctctccgaggctttgggaatacttttgacacaactccttttgcagcaagtgataatttgtctctcacagacactttctcttcatttatgccagtaatctcgacacagcgggaaactagtgggtcttgtaatggtttgtatacctcagagccttgtgaactatttttcataaaaggcaaccatacaaatttaatgaagtctgtcctcattagttaccaggcaatatcaatcaatacaactgtccagattccagaagcacaagggcgatcgactatgttatactagaggggtaaggaatcagcccttcaacaataatatatcgaaaatgataaatttatctaacaagaatctagtaaaagaccagcatgagagcactataaaacaagcagaaccttcccttaatcttctgttgaagaatataccttttttcctttccaaaatataaagtatgtatactaagaataaacttatcttatgtagcactgtgcttatatatgttacaaatacaatacagtaatatatagaaaagaaatcataagatcaatagatcattagccacgaggtaacagaagagaattcagtaaaagaatttcactacagactgtcagacttccatcattttttttttacccacaagaagcataagttcattcatttcatcaaattattccaaagtccagatcatttcattgaacttgcctaaagccgcacataaataatcggtataagagcaaaaaagatactttcatatattgtctgaagcatacactctcaggaatcagaaaaaggaaaacacaaacctgccatttactttttcaatccatacttccatccatggagagacctgatctggcgaatagacaaggtcatgtggtagattgtcaagtacctgacaatacaccaaatgaatgtgctgttgaggctgctgccatcatgtctctaagatatgattgcgaagctaagaagtccatatgataatctaattcttcacttagcaaacaaaatgatactagcaaccagtgtttccctacttgccatcatcagtcagtccagactactggcatggtcatacaatggttaataagtgatggttggtagaatgtctaaagaggatcctatatctggttgttatggcaatagtgagggtacgtaaaggaacagcgcccaacgttgatacagtgttttgtttgcaatatcattggcaaagagagagtaatcaagagtttatgtctgctataactttataacctactcttacatatcctttgaaacacaaaataacacacagataaactcgacactgaaaaaaggtatatttgcagtattcacatcttgaaagcctaaataacatttgaggtgctgctacacattctgccaagctactaagttagtgcaaaccagccagaggactgcagctaagcgtcaattaataacaggaaaggtggactgtaatgatggtatattgcttctttgattcatatgagacatcaaagaaacaaccgagcagatagtcaaggcagtacctcaagcattaacacccaacaaggttgaggatccttgcggcctgtaaaatatgacaggaaagtaacccaaagtggtcaaggaataaaagtgcaacaatataaagatcagaagataaaatccgatataagtgtgatttgacatggagggattagtgggaagtctgtgtaagtgtaacccacacattttagactgagcctatcagcactacatcaaaatatggtgtaatagcattagctgaaaatttgcaagctgaattatcaaagttcatacattattttttaaatagaatgcattttagagtagattgccctacagaggagcagggacaagaagtcagcttaccccatccagctctgtcagttgcgtcacgacactcaaccatgaactttgacaaatggcttcgcacctcaccaacagtttccaattgcttctcagctagagaggaactaatttctactgagctagcaaattaagataaaagcaaggtcaaagcatattcgatcacataacagagatcataaagtgaaggaaggtttccttacatgtatttcatagtattgtatactttcggtggagcatttaacatcatgtagtcaagtatgcattttgcacatgtgccagaaccaccaccaatttcgtaaatctgatccatgcaggggaaaattcatatggtttggtgaaaaagaaaacagatgactatgtgccataatattataaggtaccttttctccaaaaaaaaaatttggcatgagaactgcagtaatattactagttgagaaggaatgaaaaaaagaaaaggaaaatggtgcagtagcacagccatcatttattaaatcatatgtgagcggttatggcgcttgtaagagcaaatgggtggatggaggtctagaactatgctgaggaggaagttaagaatgcaccttcagtgggactgaaagatttgctgtacggaggattgatgcagctattgcataggcataccatggctgcaccagagaaagaccacgcatcaagggtcaaactgacagaaaaatgacactacatgctattgaacagcttaagaaaacaccttgaagagctccactggagtgaaccaagcgatgtcatgcttcttgtacaacttatcaaggtactgcatatacgcactcctacctacataagcaaattacttccgtttctagtcaaatatccaagatattaaaacagcacaacacagaatcgtaattggcaaacaatcaatggagttcaacagtcgtggaagaaaaacagaagtcccaaatttctgcatgagaggaacagtggcacgcgcaacgtgttcgtcgaaatgccacctcggcaaacaaatgttagaaccggcctaatctgattcccgcaatgccggaacacacacaccaaactcccacatccaaatccggtccaagcaatagaatgatccaagaagcaggtagaaaggaggattaccgtcgagctggttgaagcggatgctggagtcgagcacgcccacgggtcccgcccgcttggagaagtagccatggttggggtcgtacagcgccgacctcacgaagtcacgcacctgcgcgcacgaagctcccaccaaatcatcacccgctacaaggagatctcactgcgcccctcccagcccgcgaaacctccgccccgagcgcttaccaggatgggcttgttctcggggacgatccccgacgagaacatcgccgccggataccaccgcgccagcgtcgccgctcgccggagcgccgccgggacggacgccatgtgcggcggcgccatgggggagtcggggagtgagtcgctgcggcggcggcggcggcaatgcccacgcggttccgggccttttccccgaaagaaaagaaagggaagtccgattcgtgttcgggcccaagcccaacacgagtccgagtcggagtcgtgggctgcttgggccgtacggcccgcggcctatttaagtcgcgcgagaggagacgcatctcctcgcgcacgcgcacgctcgaaaaat

SEQ ID NO: 39811 - DNA, 3111 bp, Oryza sativa
gaaccggaacggcgtcgcctacgaggccgaacaaaggcgcgcgtgcgcgctcatggtggactcccaggaggatgccgcgccgccgccgccgccgccggcgagcgggaatggcgtcgccgacgacggcgagtacatcaacctgggcgggtacatgatcgagcgcaaccgattcgaagcaatctggcgcgaacacgcgatccctcctccacaaagcctcctgccggagtcgttgccggacgacgacggcgagccgctgcggctgtggtcgttcgacgccggcgagagggtaatcctttgaatgtgcccgcgttgagttggcctctagactgattttgttgttgataagagtaatgctatatttactttatggccgtgtggcttgtgacagaagtaagatgtaatctattttcattaaaaaaacactttaaaaaatctgtactagtcttaattagtagttagttaggggccgtttagattgcagtcaaaataaatctaatgctaaaattttagtagtttgacaatattataaaaattgacagaatttcttatatatttactaaagttggacaagaaactaaatgtatgcacatttttaataattttaacaaaaatgatatgatttaaaatgacatcaatctaaacaacccttcagttagaaaagaatgggcttaaaatcaagaatcaatcatattttatccacatcagcttttcaagatgctttttctagacaaataacagatttttgtacgcgtataattttccttttgagaaggttttgtatctaaaacagtttcatttatgcagagctcgagaaaacagcacaaaaaaatgaaaacggctgcgaggggaagatcaaagctcactggacacctgtgttgacgacattctgtaccggctgaagggtcttcgatcgatgatttcacttagatagcagtgcagtggtctgccttttttgtgaacttgatgtttctgtaaatttctatgtgagattcagatgttgctcgatctgtagctagttcctgtcttccagctgtaactgtaactgtaacgagaattaacaggcaaaagaactttgttatggggattctttaataaagctggataactaggtgatctgttcatctaaaaagtagtcgtgggactgatcgagtttgctgtttgccgccttccgacagttgaccttcatgtcgccgccgcagttgccttttgctgaaaattggatggaaaacgtgcatcgagggatgggtatttgattgatggataattggatgtcatcaaacaacaacatggataatatggagcatgctgggtggcttaccactagcttgactctaggcattgagagacaacacaaactgtcaaagattggtggaagacactagctaatacggcatgagtttgagaggtttgcgcaccctcatcctcctcatggtttgggagatatggaagaaaaggaatcaacgaatctttcagcacaaggaggctacatcatctttcctcttcgccaagatcaaggaagaggcgcggacttggacgatggcaggagcaaaacgtttgcgggaccttctgcccctccatatataatatataaagagtacaaagtttttcatttctgatccttaagagttgttttttcttccactatattcaatgaaaagtcatgatctagtgccgttttgcttaaaaaacaacatgattgtagttaatagttattactccataaagtgcactttttttaagtgtaaataagtaaataactgatggatataattggaatatcgtcgaacaacgattggccctttttttcttttcattggcgtttagatcgtttgacgtagcgacgtccggggtcgttgcgccattcgatttgcatcggacggaaaagagggagtacagcgatagaaggggctattgctcggtccgcaacaacaaaaatcaagccacgaagattgtcctgggcccatggaaacaatacgacggtagcattgattccgaggagttcctctacatccattctacaagtgcaaccgtatatatcatgtctaacctgaccgtccgtcttatttaaaaaaattatatacttttattattaaaaaatagtcacacataaagtaccattcatgttttatcatgtaataaaaaatatttatcataaaaaatttctaataaaataaatggtcaaacattggacataaacaatataaaactacactattttgggatggagggagtaccattcttaatgcaataggggcaaatgacaatgcagtagcgaattatctatcgattacgttgaactgctcatccaccttatgtcatattctcgatcaaccgagcatcgtttttatataacgggtaatattttcaaccgctactgtttttttatatataaatgttttttctaatttctttctgcatcgtactggtgtcaacactgagtagtttaaatgatgaatatgatcaattatcgaccgatcgatcattgtttttgaaaagatgctattgattctgaatgttttcgaccgttttcacctcttttaacttccataaccatgaggatactccatacaatctctactattataaaaattaaagatgtttttgtcggtactttgacacgttatccgtgtatggttcggtttttaagttcgttcgcttttggaaatacgaatctgtatttgagtcaagttttaagatcgctcgcttttgaaaatacaaaaggagtcgtataagaaatccccttaaaagaactaccatgctaacttgagatgatcgaactcttaactacacatcatgattttctagaaatatatatatatccaagtaaattcccaccatgaatttcaccttaactaaaccatacaacaataataatattaaaatagccttcgtccgttgtaacatacgggcattttttaccgttattttcagggtagttataaaaggcacacggtcgaggacgatcttcacgggttcccgaacttccaaaaaaaaggggcaattacttatttgaccctgttttgaactgtaattgatgatttggccctactttttgaactttgcttatttgaccctccttttcgagtacgaagctccggtctgaccctattc

SEQ ID NO: 39812 - DNA, 1840 bp, Oryza sativa
  unsure (1)..(1840): unsure at all n locations
tctacctccgctccaccccgcccgtgcgccgcgcgcgctgcgtgcgcgagcgcgcaagccgcgccgagcgcccctcctccgctccctccgctctgtccgcgcgtgcgtgagccgcccgcgccgagccgagtcctcctttccgcccctcctttccgctccccgcgcgtcgttcgcgcgcgcgcgcccgcgtggtcctcgcccgcgtcgcgtatgcgccgcccggccccgctaccctgccgcgccagcagccgctcggccccgcagccagcgtgcgtgctcgagccgcgcctctccatccgccgcgccctcccgctgcaagccgcgcgcgcgtgccgagtggccgaccgtttggtcgccgccgccgtcaccctctgccgcgccagcccgcgcctgtcgcccgtgtcgtcgcgccgctccaaaccgccccgccgtcatcgccgccgtcatcgcctcggccccgccactccgcgcgcaagccgccaagggacggaggccgagccctcctccctctgccgggacgcctccgcctccctcctcctttttcccaaatcggcaagggggcaagccccctttctccccctcctttttccctttttcctcccgccggcgtcatcctccctccctcctgtcgccgttttggccgctagccggagcgccagcccgcgccttgaccgccaaagtcggtttccaaaccgacattgccgccccctataaacccaggcgcccgcccttccccttttccccctcccaatcttctctgtttctcgcccgcgccattgtcgtccctctcgccgaccgcagccgtcacgtgtgtgccggaggagccggtgcgcactaggacgcggaaggggactttggccgcgccctctccttcctcttccccggcccgaggccggagagattactcccgcgccgtcggcctctcgtctcagcgcccctcctcttcacggtagtgcctccctccgttcttcctcctcgctccatctcccccccttagttttcggtggtagcacgagtagcctccccgtagctagccggcgccgccccgaccgttgccgtcgctcgccgtgtgcccgccgccgtcgccgcccgagctccgtagcacccgctcgtcgccagcctcgctcggcgtagctccgcccaatccgacgctagcatcggattcccgtagccgcatagatgctctcgccgccgggaattggcccctcgtgacctcgtcgccgttttcccctcttccctccccgccggttgccgccgccgcgattcgccgccgtcaagcttcctccggcgaatctgagccgttggctcgtctcccctcgtctcgtgcaaccacccggtgtgctcgctttcgccggtatcgccgtggttcgctccgccgctcgccgctgtcgaccgccgtccgttccggccggcgtcgtcgtctacctcccgccggcccgcgtgggagccacgtaggcgccacgtcggcaccaagtcagcctaggtcgggtcgggccgaccccggtcagcccctcccgtgcgcgcgttccaccgcgagccgtgaggctgcgcgtgggcccgccgcatccgcgtccaccgcgaaccgcgcgcgtgccccgagtccttcccccaccctagcgccgcgccgcgtgctccctccgcacggtgagccaagccgctgacaagcgggtcccacctgagaccgcgcgtggtgagcccggtccaccggctttttttnttctcctcccgcgcgcgcgcgtttgggccgttctggcccgcttttggggccggccgcccggtaggctcggcgagccgcccttttttcccgggccgcgccctacccgccgagggaagnctaatt

SEQ ID NO: 39813 - DNA, 1206 bp, Oryza sativa
  unsure (1)..(1206): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcatttcaggatagatctgcagaaagatactagtgtttctctttctgcaaaccatctgcagaagttgcggttatcttttcaactgagtacaccactcgggaagacatttaaacctcaccaggttgctctagaatttaaccctttttttcccagtggaacactatggttctttccctgacttcattgagcaaatcaattttcaggtgttcctcaagttaaagcatgatgaaagcaaggttgagcatttatttgttgtaccaggctctgcaaggcagtttaaaattgttctagttgagtaccccatcccccagttagttacactcatctttttcagcttgttctatgttttcgagtgctacgtcatcatcagtttcctgtccatgcattacattatccagagactagttatatacagagcagtttctcaatgtggaaaggaatagctaggctatgtagcttggtttgctttagaacacatggccaccagcaccatttgaatttgatgtcagccatatttatatgaacactgttggtgaaagttgagatttgaagaaaaagactaccatgtgcatagcatatacattgaaataaggcaaaatttgctataggacacccgaaaatcgtgtaattggctgtgagacaccgcaaaatcttggctttgcccacggacactacgaaatttgtgaaattggctgtgagacaccgaaggcaatattttataatttttgaggcaaaagaggtcagataattttttaaaagaccaatctacccctgcgcccagctgtccatctccctccccaacccgattttccagttctgaaccctaaccctaggcgacggcggtgc

SEQ ID NO: 39814 - DNA, 15331 bp, Oryza sativa
ggcaccggcggaggcagtttcggcgccagcgacggtgttgaggacggcgacgacggcggccgctgaagctgtgatgatgacgcagtaaatcgatccctgtggcaaacccgacgagtcctgacggcaagtgcgcggtctggcggtttcaagccgatagcggcggacggcggatctcagttgccaaatgaagggcacgttctctgcacagtcgtcagttaatcaactaattaagttgtcctttggtgacaaatatttcctggtgccatagaccaattagcatctgagtggattataacagtaggtgcatcgtcaccgtgcaggatcaaggaggaagaagcagccaaaggcagtaatggagcgcaggcggagaagacgagcgagagattttctctgtatggaacgcgctaggcacggccctattcgcgtctgtgcgcggcgaggcgcggtgcgcacatgccatgccggcatgccaattgcgcaggggtagattggtcttttagaaaattatctgacctcttttatctcggaaattataaaatattgcctccagtgtctcacagccaatttcccaactttcatagtgtccgtgggcaaagcccagattttgcggtgtctcacagccaattacacgattttcgagtgtcctgtagcaaattttgccttgaaataaacaactgatttatttatatatgtttcaacataatatagcggggatggatcttcctgtatttttcttggattcagcctgtatttgctactatacaaagacattctcatgttaccacagattataatatcatgggatttgtcagtaacaagtgttcctacgtgtctgttcaatttgtcataggactttcttggtttggtggagaaattctactacctttctggaagatatgacctggagcttgcagttggtgatgctgcaatggtatgtaaccatgttactggactctcattcccgttttgttgcccttgctgatttctttttgttctcaggagaattcatttctacgagcccttggccatattgaattggacctgcctgaggccccagaaaaagccccaaagcctccggcccaggctgttgatccattctcaaaatttggtccgaagaaggaaatatcgcacatattccgttcaccagagaagaggccacccaaggaactctcatttgcgtttacgggcctcacgcttctgcctattgttgggttcttgattggggtgggtcaacaactcctatgtgtgtttcttcatttctcctttgcagttttttttgtttagtctaacgtgtcactcttatgttgtctatgcttgtggcattcgtttgcagcttatgcgtctcggggtaaacttgaagaacttcccgtccttgccagcacccgcagcatttgcctcacttttccatgctggaattggagcagtgctgctgctctacgttctcttctggattaaggttagtaccgttcattgttggtaaagcataattgcattaacaaaggtttctgctggcgctgacattcattcttgttgtaatagctggatcttttcacaaccctgaagtacctcagcttccttggtgtcttccttgtgtttgtgggccatagggctctatcttacctttcctccacgtcagcgaaacagaagactgcttgagaggacgatccaaagaggagtattccgaatcacaaaattttcaagcgtcacaagttgcttaggttccttattttagcaccttcgctttgatattctgaccatttttcttgagcaacttcgagttacgagggacgagtcgatttcagttttgtgggggttaagaatactggagctagaatgtaggacctcaccttcttgtatgatgatgccctgatgtgttctcaatagacgtatgtttgatgatagaattaataatatcttattctgcaaatgcatagtatgccttttgcaaaaattgagttccatatgcagaatatgaacactcttaatcccgaggcccatatgatatcacgaacggtgacttcagaatttagatatgattaaactttgcacgggggcattcgcgtgctccatttcatcagaccatatggttctggaaacacactttcgctgcaacctgcaacttcgaaaaataatgtctgtttatcgtgacacggtcacacaggtatacaaattgtaagtatacaatttgagaaataagtatacagtgtaatgctctatgcaaattgtcaaaactggagtaaactttccctgcagagtatataagttatgatttccgatggtcttgactctgatcagaatgcctatacatttgtattacaggttgcgcctgatgacatgtataactatttgacttctgtaaagaatcatttgcagttacaggttcccggatcctccatactaccgacccgttttatggtgggaaacaacttcttagtttgattagttatcatcatttgtaaactatccagtttcacctgtttggccaccacggtcagggtcactcgtaaagaatacaccaattactaagaactctccttgcctgccgttccacttgaaaaaaaatggtgtggagtagaccaatctctgtgaattcaggactaatcgagggcgtcgttttgtcgcctagctaatctggaatacaaaccatcgtgcttattaataagctcgctgtggtttccatcctgcataccacacaaaagaactttaagaaatctgaatgacatcatatcatgtgtatagtaggatcagattagttctggtttgcgttttcagtgaagcaacagcgggcgaaaacatacctccacaatattaccattttccatcacgataattctatcagccgcttgaattgtagatagtctacaagagaaatgattgtgtcaactaaaatcttaaaattcaaaataaacaactgcagtatgagcatacattacctgtgagctatgatgatcacggttcttctagccttaggatcagtactaaactttgtgattacattctagcaaagcaggagggagcgaatcagcaagccgcccataggcacattgtatttatatctaggtacataattggtcaaatatcttgatgaagaggttaccttcacataatgttcactctcagcatcaagtgcactagtggcttcatctaataccaagatggatgggtccctaagaagggccctcgcaatagcaacgcgttgcttttggcctccactaagaagagcatcatcgacaatggtgttataaccatcagggagagacattatgaaatcgtgagcatatgcctgctttgcagcccactccacttcttcattgctaacttctcttggacacccatacctaatattagaactaatatccattcggaatagcctaggttcctgcacacaccaatatatgtggctatttaatacaacaaaagttctagtggtagcagagcccttgagttagatctgaacctgtccaacaaaaccaatcctttccctgaaccatctgatgtcaagctcactgagtgggacaccatctactaatatctgcattgatcacaaaacataacttcagaccagccaactggtttgctttgaagcgactgcatgcggtcatgtggcacagacaatagtttgacgcagaaattatcttacttgcccatctgtaggttcatatagccgaagtagtaggttaactacagtactctttccacttccactaagaccaacctttaaaagtttcatataaatgcagccagtttgttagtcagaaatgagaattcagaagtatgaaataattaaatcaactgtgttcttctacacaacacacacacatagggagagaactagaaagcaactgtgttctctatctcttacaattgcaactacttcatttggatgaagtgttagattcaatccacccagaattggtacctgttaaaaaaaaggagatcaataatataaggacacaaggtaacagaagattcctcttatttacataacaaatatgataattatgaaattgttctgctttagggttcactctactggttttcagtcaaaagtcaaatgaatattatggttagatcagctggatcataaacaggtattctttttttccctttttggtgggtgacaacaggcactcctcaacagagaagtatccataaaagcactgtaatcataccgtaggtcttgatggatatgaaaatgatacatcggcatactgaatccggccttccaacttctgtaacctgtggcctgcaatggtgacgtactttagatcactaaacaattttacaaccacaagtaaaaaaaaatcaactagccattctaaatcagacatcaggttacaacagtatcttgtaacatgcaatttattttcttgccttcagaactaagctgtctgctaggaagtagatccatcaaacggaagaccttttcacttgctccaacagactgcatcagagaggaccagttgtctccaatccaccatgttgacaaaattagccactcagcatagagtatgaattttgtcagttgctcagcagttagctttcccagccatgatggatatccctccaatcaacactgcaatgacctacacaaagcttatttgcaagaatacatcatcaacggtacaacaaattcatatcagaaccaggcattttatattttacaaaattgctaatttaaatatgttctgattggagtatcattatgaattgaacagaaacatcaaactacctgagtagaatggtatagatagttcaaactcaagctccagcctccataagccattgtttgccgaaagcttacatcatatagcttatctagccactttgcatatctatcagagtacaaggcatcgtgagattttgtttttgtgtgtatgtatgagcgtgtttgagatagagagagagagagagggaggtagagattgccttttaaactcctgcttttctgttccataaacccgtactgtccgaaccaaacttatcacctcttgagcaacctgatttagtttaatgtgaaaactgagatgaaaactttgccttatgaaatgctaccttcatccaaaaatataagggatttttcccatgggacagaggaagtagcttattgtaaagagtacaaacttacattgttggcacttgcagtgaactcctgtgcaaatttggctgctcttttctgatacctattaatcacagtatcataatgatttctctcgcatggatcacaggtgttaagcaacaaaataaaaacgtggtggtgcttccttgaactttcactactcaggtaatgtaatatgaaagacagctaacacagaaaagggagagacaatatacaaggtaaataagagtaggtttttaccgtccatgaactagcataatggtcgacaatgtcgcacaaatcaacatagtgcacattccaagtggccaagataagactagcagataaattagtgcgcctacaccctgaaataaagtgacaaaatggtacgtgagtttttgaagctactggttacattttcatacaagactactaaacaaccttttcacctgaagcaaattgcgtgagataagattaagatcattgccaatgactcgtgacacttgctggcagtcagaaccaagcctacttgtcaaatcaccaacagtttcttcatcaaaaaaagcaatgtcctagcataatttaaaatacagttaaaagcttcatacttgggtcaaccaaagtaaaacaacagaaaactttatgtacattaatgaaatttctttcagcagtaatattttttattccttttgttttacctgagaaagaatagaatcaaacagcatttctctcattcgtttgacctacggaaaattttcagatgatgaaggttagagactggtcaaacaaaggggcaatcgtgaggaataaacttggaaagttacattaagaaatctaacatggttttaccaatatcatgtttgcaacaccaaaacagcagcttcgcacaccactgcaaaattggataccagctagtaagcaaccacaattgatttttcacaaaaaaaaaaaaaaacatgcagaagacaaacaattttggtttcaatgcagattacggagtatcttgctaaatgcctatagtgcatttgacaggacactggtaaatgtagaaatttgtatttatgctaccctatagtgccatgagctaccaaatcgattcatcagcataatagaagattttcaatattcagacccattgaagctcaaagcatttccattcctgccctagatttggactaccaacacattatatgatattacattgtcaaccacaccatccatggaagtgatcttatggacctaaacgtctaacgaccttttcagttttcaccacaacaacaatgtgatcaggtacagttgtattgtggacagaaatacagaatgcatgcttgaaaatgcagcattaccaacttctatggtttttccgatgaatgcagcatcacctacttgttggcttctctaatgatcgcgttcacgacttaagcacagttttaacaaagcaaagaagcaataactgacctaaacactccggaaatcaaacacagaacaaccagaagcttagcgttccggtagaacacagcccctccgttctgcgccgagaagatggacgctgcgaggagatggggtatcgcgatctccgcgagctgcaaccacaaccacacgtcaccgcgttttagacccatcaacgagaactctgcagcagcagaggtcaaacccagaaatcgccattaccgcagcgccgacgagggacgcgaatccgacgaagacaacccatcggtcggaggcgacgagcgcccacatccgcctgagcgcggaggcggccgtggcgccgctggcctcggcgcggccgcccccggcctcctcgccgtcctcgaggcgccaccagcttcccccgggcagcacgttccgcagccgctcgatgaactccccggcgagggcgcgccgctgggccagcccgccgaactctcccccgatcgccgccgcggcgcggatcctcgtcggcctcgcccgccccggggccctcctcgtggccgacgccgaccgcagaagcagcgacggcgccctgggccccaccgccgccacgcccaccgacagcgccgccgagccggtggccccggtgaggagcagccccgccggagtcggcattctccactctcgtcaaaccccctctatccctcccctccacccccaccgcccgattcagattccgattccgcgttcgccggtgagagagtccgccgcctcggcgagcaccggcgaggtttaaataggcgtaggccgctgcgtcctcgccggagttggttgctctgccgtgcgcggcaccggcgccgtaacgtctctaccttctccggctaaattgtattttttccgcggcttttttaatcctttttctcttccacttttcgcgtgtgcttcttttttttttctttttcctaacgtgttttttttttgcgattttttctacgagaagaaatggatggaatgaggcgatgtggtgtggtggtggtattttgggggatttaaaacaattttctggaggagaataatcgtcgttggattttaggattggacacggagaaggattgaaagaacggcttcgtgcgtggtcgtggcattggaacatgaggtcggtgacacactgacacgggatgttagagaacaggtggtggtgccgtggtggtaggccctatatagactccatcgtttgtcatggagttgaggtagtgtttgtaaagtgctcccggttttaagctttaaagtagtgctactgttgttgtaaaaggtcaactaaccacttataaacgttgcagtatgggttagtataaaatattatctcgatcacaaaatatgaaaatataaccacatttaaatagattggatctatcgtactatgaatctagataggggatttgtatgattcacccgttcaaaggttgctatattttgaacgaacgaagaagtaatttaacatagagcatgatgatatatgtcacaccacaaacatttcagttcaaattttatcttcacgaggaaaaacaagttctaaagaaaagctggaattgaatgagcatgggggcatggtacgatgcatgggattcgatcttcgtcaagagcattttcttacaacatattccattcgtttcaatttgatcgtcacccataatagccctactcctattgatcagccaatatataagcgtggaactcgagcatagtggttgaggttagctgttgtaagctacgagattagaggtagcttgtattgtgttatctctgtttcttattggtggttccccactcttctcttgggccttgtatttctacactcaggtgccatcttatccaagtagaagtgtagaactaggatgcaaggatggatacgatccgagtggtcttggtcgggtcaaagtacgattgtattttttttctttatcggggactcctttattttctactacggactctaatataacatacttgtttccgtatatataggacttggaacatggtgctcccaccgaggtatgtacacgtatgtagaatatcctatatttaagaacagtaaaaaatattatgttgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcaactagctctcggtgacttggctcctcgtaagctccggcttcgtaggctgtggagattgtgttggctctgagattcaatgcctaaaccctccccggggggccccttttatatcgcagatctggaggtctccacatagaactcggagatatcagaccctatacgatacgccaacgacccagttctgcctaagtaggattcttcccatctgtagattccgtaaaaggtttccttagaatatacaggaaatatctgcatgcgcgtgggtatgccatatcgatatgtaacgtatatcgaagggtaaagggtatgcctaacccgtaaccttgacagtagcccccgacttctgcttaaaatgaactcgtgcaaccatttgcgacttcgggtgtcgagactattgtcattcccggtgcgaggaccgcggagatagaccgtagtcgagcacgccatttgaagcccaacggtcacgagcgaattttaaactgaagtccaaaaaactgccgcgcgtaacgggaccagaaatttccggcgggcatctctctctgttccctggaattcgcaccgtcggtagtgcgcctatttaaaggaattttgggaatccattttggaagtccgccaaatctgttaaacacacaccacctgcaagcactctttgccttctccgccgccgcaagaaaccctagttcatcaacctaggctcgttttccggcgaccttcgatcagcaacggacctcggcaaatcggcttccaccagtgcaacgttgaagaaactccaggaggatggcgctcttcctggccgtggaaccatggagagtgaagcaggaggtactaatcctcagcccatcttgggtcgcatggttgcgatcgaagattatgttctctgcggttttctccctcctccttccgaatttcttctcctggttttgaatttctatggtctttctcttctccatttgaaccccaattccatcgccttccttagcatctttgtgcatctttgcgaggcgtacatcggggtagagcctttccttgatctttttcgcttttactacgaactgcgttggatggaatccaacagggtatctggttgcgtcgggttccgacttcgggatggcctgaagtcgcgttacattcccttccagtgcccttcttctcgcagcaagtggaggaataggtggttttatcttgagatcaaggactcgaaccctgtcttcgtggttcccggagatcaaccggacaagattccgtcttggaccgccaagccccccttgaccccctctcttcagtcgtttattgacatcatcgacgatctccgagtacgggggtttttcgggatatgaagtcgttgcagacttcgttggtaggtggatccagccgcttcaggctcgggcccatccagcttataactattccgggccaaaggacgtgacccgagtttctcctcggggtatctttctcgcattcatcttgacatacttgtgttcgcattcctcttgacttatcgtaggatggttctcgattaacaggtctgagcggcgaaaccgtggagcgtcgcgtcggccaagtgatgatcagcgacccgaccacggcgagtgacatccctgtgcccctttgtgaaaagggggcagcagaacgtgatgaagccatcaacgtaagtatattcgatgaatatcccgcattctcctttcgaaatcactttatgacttgattgagcgtaggcccttcctttgactgatatcatcggaccgctcacggaccatcaggtggcgtcatctctgaaagtgaaggtcgtcaaggaggtatctgatgctgccaccactagcggtggcaatgttccaacaaagccgaggaaattctcgtctgtaagcggacaatgtcgcaaggtgtcgaccccctcggtaatttattttgttgttaaatcatgcagcaagaaggatttttccttactttgcgttgattgtattccaggcctcagatgcgtctcccccacctccacgacgacaacgcattgtgacgatcggcgagaagtaagtagatgaattcttgaatccccgcgcttcttatttgattgttgtctgactcgtggtcgtcctgtagggaggcgcgggcaaaggctgcgcaagccaagtccggaggagcttccagtgcgtcgcccgtcgtggcctcgacggatgtcgtgcccgcagccgggagccgggaggcgacgcctagtggccccgtcagcgaccccgcggcaggtcgtgatctaccagttgcagtcctcacctgggaggagctccaagtcgagatggggcgcctcctcgaagccggtgctcgcagcatcggccgcgaaattgcggaggcgaggtcggaagcggcgacggtgaacgtgcgtgctgacagactggtgcgcgagttggctgaagcccgtgaagacctcacgaagatgagggagttggcggctggcaacgagcgacaacggaaggggcttgaggaccgaatgtcggaactcgggaacaacctatctgagatctggggctcgttgagggtcacctacaccggccttcaccagctcgctggggaatgcggcgtcacgtccacgatcccggcgaatcccgatgagttttcgctgacctcctctctcgcggaactggcgacggcaatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacacgcgtaaggaggtgatggaagaagtcggtgatctgggggagtctgttctccccctttttgaagagtaggacttcttgtatttcctagataatgtgtaaaactcgaactctgaccgcctttgtgagtgcgattactatcccggcttactttggtatgctgacctcgggaacttttgtcctcttgtagagatattgatgacgaggatgtccagcagcgcgggcagcccgagtcactggcagtaattccggtactcgagtttgaaccacacgtctcgcctgaccatgtggatcaaccccttgatatagagggaaggatggcgacgacttcctcaggttagtagtcccttcaccccttaatgcccatctgactaggtcagccatgttcccgaaagagatgtacagctcgacttagtgattatcacgtttagcagatctcgagggtgcccttgctagccaagatcgtcgtatccaatactggaagcgaagtttgaagtggcggagctcgagagaaccatgctggccgtgaagaaagagcaggctgtggaaacgctccgaggccgtgaggtatggtttaactcgtacttgaagagttgctgcacatccatggccagagtatgcagggagcttcgagtagtccgcggagatcccgatgagtcggcggccaggtacatctcgtggcttaatggggcctgtgcccaactcgatggaatcggtaagcgtatcgacgaggccttgaagcaggagtgtcgtcgatcgagccgatatgccggggggcatgtgttggcttgcctacgagatcatcgcccgcacctggacctcgaacatcttcgtgagggttttgctcgttctcggagggctccggcggagatagaccatctggcaaggtcaatgtcgttctcccatcttagcgacgaatctgcttagtgctgccatgcatccggttagcttttgtacctccttgagtcttgtaggcgacttcatgttctcgattgccttgatcttctcggggtttgcttctatccctctgccagagacaaggaatctgagcagcttgcccgacggtactccgaacatgcacttctcaggattgagcatgaggcgatatcgtcggaggttgtcgaacgtttcccgcatatcgtcaatcaatgagttgcctgtcttggttttgacaacgatgtcgtcgacgtaagcctcgacattgttgccaagctggttgctaagtgcgccctggaccgtgcgctggaaagtattcccagctgttatcagtccgaacggcatcttaacatagcaaaataccccaaatggcgtgatgaatgctgtcttctcttcgtcctcttttgccatgctgatttggtggtagccagagtaagcgtcgatgaagctcaataactcgcaaccggctgttgaatccaccagttggtctattcgaggaagtggaaagtgatccttggggcacgccttgttgaggtcggtgaagtcgacactcattctccattttccgttggccttccgcaccatgactggattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgggctcaatcacctccctggggacccccggcatgtcggacggccgccaagcgaacacgtcggcattgtcgcggaggaaggtgatgagtgcgagttcctatttctcgtttagtgtcgccctgatcttgacggtcttatcggggttggcactggagagtggaacaatcttgatggcgccgtctggtttcggcgtcttgtttgtcttggtcactttcttgggtggctcagtcgtggcgggtggactgggcgtttgctcgaccatgtcgaggctccgcttgtcacattgcaccgccagctttgcgttcccctgaatagtgattgttcccttcggtcccggcatcttaagcacttgatatgcataatgagatgcggccatgaacttcgcaagtgtagttctcccgatgatggtgttgtaagctgtatcgaattcagcaacatcaaaggtgatctgttctgtttggaagttgttggcttggccgaaagtcacgggcaacgtaatcttgcccaaaggtctggacgatgattggggagtaattccatggaagggttgatcagttggtgtcaactcgttttgtggaattcccatcgcgtccaaagtgctggcgaaaagaagattgattgagctgccaccgtcaatgagaactcgcgctaccttgatgttccgaatagtaggttcgaccacgatcggatatcgtcctgggataacggcggtcttggggtggtcttcttccgagaactctatcttctgctcagaccacttcatcttgggtgtagccccctgtcatgtcgaacagacttcatgttccactttcttgtattctcgcttggaggagtacgttgtggaaccgctgaagatgtgtgagacgtggaggtcggagtctggatacgctaagtccggttcgtgaggagccgtctcttcgttcgtctcgacaacgcgtactcgcttgcctttttcaaatgccatgtgcttctcgagcgactttttgaaaacaaggcaatcttccagagaatgtctgtccgtcttgtgtatggggcaccatgatttcgttgtgtcactgctttgtgggtctgggcgtttgggagggttcgcgtattctgctgcgaggacttccgcttgagctttccttttcccgtttttgcgatttttcttcttgcttgactcagatgtgtccatggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcatcgatgatttcaggaattgtgtttctgcactcgttgaaacatcgaacgtattccctcaatgattcactctagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacatggtcggtaaatagtttgctaacgcgttgtcgtctgcttcggcagcatagagtactgtggagtagacttgaagaaactcctctgggtcggtgctcccatcatacttttctattgctccgggtcagaatctctcaggccatcggacatcacgtaaggaacgaccgaaagccctacaccccagcgttgggggcggtgggttgccggcggtcgtgtgtccttcgtggatgtctgtctgacgatgaggaggaggcggatgatgacgatgacgatgggtcgcttggttccggtgtacgattacgaggatgacggcctggatctcgacaatcctgtcgtcgtcttccgctgttgtctcggcgccgatctccatcgtcgtcgtcgatacggcggcgaccatgaccagtattgtctggcacccgtcgttcgcgatcgttgtgatcgtggtggttgtcgtgg

SEQ ID NO: 39815 - DNA, 1986 bp, Oryza sativa
actttgattttttttatttttaatatatttttgaaaataaactatttgaaaacttaaaattttttcagctctgaacctttttagcttgccattttaactgacatggtaggacaacgttttggcactttcaacagtggcgtatggtaatggcagtgaagggagaaaataaatcgcggatggcaatggccaaaagatttatttttaaaagtaagattttcatagggtttgttttaaaatttttagttaataatggttagaaaaaagatcgagctacttagccaagcctcataaattctgctctgttttctccctttagtgaatatactagtagcagctagcagagctcctgtttgtcttatgaaaaagaaaaaagaacagagaaacatccgcaaatgtaacatggcaagtttcggtgtgaaacgagttcaataggttaataaaaggaccaattggataaatttgacataagaacggttatggtcgtatactaaaccaagtgctagcccgttaattaatttggtcaaacgcatgcgtgtaagtactatgggaagatgctctctcaaaaaaaaagtacaacgagaagataagtttggtgataagccagctcaatgcatgcatacgaactttgatgccgaaaaaaaccttatcaaattgtcaaaattttggtatagtgactggcaggatttcttatatagtcacttttttgacaactttaccaaaatttgataaggttgaaaatggcatcaaagttaacaggcccgaaaattcccattagtggctctttactgaaccagtgtttttctaatgttgacttcttttcctcgactcaaaacgataacttcctcatttcttattactacatattctcgaactgctaaaatatacatcttatataaaaatcgttgtacataaaattttttaataaataaataaataatatttctaatatataatatttaatatgtaaacaatcatgcgctaatgatatgttccgtttgggagccacaaatagctctagccaaactacattcgaattaggactaacaaactttatatagcgaggttcacataggtcgactcaatctgtacgaatacaaacaggagctcatgcattcctacagaagagtgtcctagtctcttctctgatctctcttgtacatctgatcctctacatttttttaaaaaaaaaaagcagtgtaacttccggctcgaaaggagctccctagccgttgttgccgctgccttcccaaacatcttctccgccgatgccgctaatgttgttgtcaagctacggtggcggtggcggtggctctctctctctctctctctctctctctctctctctctctctctgccgcccaacaacatcacgaagcagataaggtcaaaactcggccatcaaaatacaaattggattggactacgttggcttcgctgccatgtccaacattacttgtcatggttgcctaaagccctcatcactaggtgtgatgcaaaattgattcaatctggtcgtgcttgccatggccgttggaggatggttgttggctttgtttaaaactgagcatttgatgcttccttcctccatgtttcaaatagaaagtgtttcttccattcacctgatagaggcaaataaaggaggccaaagctccatcctgatggctacactttgatactatttggtctttgtcgttggtgaccatatgaggatgcatgctactcaggtggtgtcgtggcaacctccattttgatcgggaagattggtcagcgattgttgaaatcggtttagaagatccatctttgattttttttatggtagcagttaatttcttgtccatggtgcactcgctttaactagaaggtggtacagagtgcaagcaacaatgactccagggtgaaaaccttagatgtaatctaaattcagcagtgtcagctcttgtttgtcatctcatcgttgaaggtgtcgtttgaagtgttggataaaaa

SEQ ID NO: 39816 - DNA, 769 bp, Oryza sativa
ggcgctgctgatgatgcgtctcctccggtggctttcagtgtcctgttgctgctgctagatgctccggtggcgcgtatctgaggcgaagccgtccatgttggcatccaatgggatcgcgcatcctgcggtactgctactagtctcctcctgatgcgtcagattcggcggcattcgccttctcgatcagctagcgccagtctcgcgagagaatgggcgagcattgtgatctgtgcccatccatgaccaaattgaccatatgccttccctagcttgcagtacctctctccctccctctcgccattggctcttctctgacatgtctcgccaaaagtgagctcgctttgtgcgcgcgggggcgggggggcggcgattggataagattggaccattcaccgcgccacggagccagcgaggcatgtgtttgactgctgggtggtgtgtgacccgttcttgtctgtgaaatgtgaatactggcatactgcacgcacggtgagcgccatgtaaatgctctctgctcgcgtacacggttttcttctcgcgcacacggaattcttctcgaggtgtaaaccccgtttggtaacttttgggggtatcaatcaaagcggcgaaaccgtgcaccgctatgtgccacatgggcgcaagcattctttccgagctccgaattgataagttggatctggtacggcgtacgtacgcattggatgttgcgatcgatcgatcgatcgaagtcccggcctgggcaaatattccctgctgcacatccacacac

SEQ ID NO: 39817 - DNA, 18186 bp, Oryza sativa
catgcgccggcacatggcgaacatgctgagggccgccgacggcgcggacgtggtggtgctggtgcgcgaccagccgttccgcgcccaccgctgcgtgctcgccgcgcggtcgccggtgttcagggcggagctcttcggcggcggccacatgagggagaggcggacgagctgcgtcgtcgtcgacgacatggagccctccatcttctcggcattcctccacttcatctacacggattccttgccagaaaacccggacacacctggcgatgatcaagattgcatggcgatgcagcatttgatggtggcagccgatcggtatggcctggacaggctcgtgctgatctgcgaggagaagctgtgccgcggcattgacgtgcagacggtggcgacgacgctggctttggcagagcagcatcagcgtgtagcgctcaaggatgcttgccttggtttcatagtctctcggggtgttcttggcgctgtcgctaggactgatgggtttaagcatctgctcacgacctgcccgtcgattatggtggacattttagacaaggttgccagcgtcatgagcaagtaataatagattcatagtctagtctttctgatcttatgagtaacttttattagtgactagcaaagtagtactgtagtagtaataaagttcgagactgagtttgcgacgcgacatgatttgcagtatcacagtagttctattttttgttggtttcatgcttgcctggaaacatatcgaaaaagaactgaagattagagtcacattgttgtttcggtactcaaattgcattcctctgaactctgaagcagtcactctgttcttctctggtctcccctgtgtgttgctgttctatttccaggtgtgattattgttctgtttggcgccattattatctaagtttttgtttctgttacacattttggtcgagtttaactcgagatgagcaaattctttaactttgttcccggttgtaacttgtgagcctgtggcggagcaggttcagattcgtcagaaaccaaaaaaaaaaaaagttcagattcgttagtggcacaggctctctcagccctgaccaaaaatgggctaatctagttggtcaggcctgtggcgggcatgttcagattctgcagttttgggccggaatcaccaatttctctctcagccctgaccaaaaatgggctaatctagttgggccgcctagtcagacgcatgaacggccacgtggcacgtgcttcgtccgtgcgcacccgtggatcacaggcctcgtggcgggggtttcggtcgtgcgcactgtggagtacaggtcggcagggagccagggtcaatcgaatcgagtcgaggagaggagagagagagagagagagagagagagagagagagagagagagactcagggagggtttcgtttccgtttcttgcgcctcctccaaccgcggcggccgtcagtggggagcctcgtcggcgtccgcctccgccattcgcgagaggaattcaggtgatccctctccctaccagagccgcgctcccctccgatcctccccgaatctggatgatctcccccgattccgctcggcttcgctgatcccccctccgccgccgccgccgccgccgcggcgggtgggctatcccgcttgtcggaatcgatcgatttctgaggccttggattgtgatgaagtcatggatatcgggccgcatagcatccagctgatcgcgccgccgtccctctatcacgccgcctccgctgccgccatgggtgatcaccgcgacccggctttccccgcggcggcgggcggctgccggctgcccaagacgtcgtcggtgagcgtcacggagtccgtcaccgcggtgcacgatttcaaggtgacgggttactcgctgatcgaggggctgggcatcggcaggtacgtcagctcatccaccttcaccgtcggcggcgtcgactgggccgtcaggttctaccccgacggctccaccgtcacctgcctcgggaacgcgtcggcgttcctctactactgcggcagggagaaggaggtcaggaccaggttcaccctgaatctgctcggcaaggacggcaaattgtcgcaggtgaccaattcctacatgaagcacaccttctccccggcgagtgacaattggggattcatcaaattcgccgagaaatcgaagctgcagagctcgccgttcctccacaacgactgcctgaccatcaggtgcttgctgaccgtcgtcagggaatcccacaccaaggatgttgaggtcaattctgttgttgtcccaccgtccaacctgcataccgattttgagaacatgctccaggatggtgaaggttcagatgtgacattcaccgtgggtggccaagagttccgtgctcataaatgtgttcttgccttccggtccccggtgttcaaggccgagcttttcggtccgatgaaagaaaatggcacgcaatgtatcaagatcgacgacatggagcctgaggtttttgaggctcttcttcacttcatttacaaacccccgataggctgccagatagctgcagagatggcaaggctgcagcaatgcagcacttgctagttgccgcggatcggtacggagtggacaggctgaggctgatttgtgagaggcggctcagcgaaaccattgatgtggaaacagtggcaaccactcttgttttagcagaacaacatcactgctcgcagctgagacaggcttgcattgggtttgtggcatctccaaacatgcttgggccagtcatagaaagcgatggatttaagcatctggtagaaagctgcccgttgattatgaaggagatcttgagtaaggtttcacatatttggattgacaagtcttgctgagaagtttattaagctatcacttttgtagtagtacatcttagtagttatgaaagtcatgatcagttatctacatctctatatgcgactttgatctttttaagttgtgtgatccttccaacgcctaatatgtatgaacagtagaaatcttatgtatatggatgactccttagcaccatggtgtaagtttgggcattcttccccttttcatcttttttgaaatgttggatttactctatactcacatgctttcctgaatgtataatgactagttttttgagtggaatatatacggactaataatcattaattcaactctgtcttggtgatataaatcatcatttcaactctgaacatctcacattctttggtccaacccatacctcagagcatgcccaacaatcacccaatatttgattcccaaaaaatctgaattaggaataccaaaataaaaattgggcccaacaatgaacccctcctccaagagatgcccaaaaatcaattccctatcatttgttagtttgccacgtaagcaaggtggggcccagttcggtacttgtgcacgtcttctccctcccgcaccagcgccgatcgacttcttcctccccggacctgcgccgccgtgacctagcgccgtcatcaccagccagtcaaccagtgtcctgactgctgcgatttgttaaaaaacggaacaccaaggagatgccgtagcaattcgtgtcatcaaggaggtaatcgttagcaaatcccattgatctcttgtgtcgtagtcaatctctatgtctatattttgatatgtggatatatattattggaaaatattaagtttgatctgataattaattttgcagattgattattgttctattcctgccatcagttccctccattgcacttcatccctgtggtaaacgctccaaccccgtggcaaacaaaaagaggagatgagtcgtcgaagcaccctccttcaaatgctattggatgagttttcatcggatggtgacgaagaatttatttcttcggcggttgatatagtgcacgaagagttcgacgatgatgaagttccaaagcatggtgaatctgttataggtcatgcagtaattaatcagtgacagtgaaccttgttagtatgtatgtcagtggcacatacatactgaaattgaatctttcagacactattttcaatctttggcataagcatgtggttgttcatctgctaatctaaaaagtgaggcatactaaatgcagatgatcacttcaattaagcagttgttgtacttagagctaagaactgtacaagttattataatcctactgaacctatgctgttgtacttagaattctgcagctgcagctttcatgaaactaaaagtctaattggcaaaagcaggtggttcttttatcttgaaaaatagactatggattgcatcttgttgcattatctgtcaaattatctaacaacattatcttaatgcaaaaattcagagcatatttcaaagatgctgtgatgagagaaaaatatttcagactttcagagcatatttcagactttgggagtacatttgacatagcaaaaatatttgacacagcatatttcagactttcagagcataccacacatttagagcatatccttcattactaaatgttctgaaacctgatttcctctaagtgttcagactttcaaatttagagcatatcctacatatttcagactttcattcaatacagtacaaatttcagactttctgatattttcctctaagtgttctgaatcctgaattcctgaatttctagcaggggaagtcagtcacagaatagacatcagatcaggctacaacactctgaaaattaatctaaacatcgaacgaatcagggacagccttaccgaaattgctcctatggaggaattcttcatcactcacagaataagctgtggagaaatcgacgccaggagcttcgtgtgagaggggattcagtgtctcccatggagcatgtccctccatggactctgtcgcctgcacaccggagtagggaggttgaggatgaggcagaccgagacgacggcgaggcggcggtgtggggcgcagagggccgtcagccccaaatcgaggaggcagtggtcgacgtgcgggcgccccctggaacagcgccgccgccgacgcctgcgaggaagaggacggcggctgcatcgccgcttggagcaacgccggcgcctgcgcctgagaggaagggcatggccgctgcatcgctgcctggagcaacaccgacgccgacccctgtgaccaagaggaaggggacgaccgctgcatctccgcgtggaactcagtcaacgacgcctgcgaggaaggggttggccgttgcttcgccgcctggaaagccgctgccgacgcctgggaggaagaggaattttgttgctggcgactggcgaggagggcgagaaaaggagcgcgggaacaattttccccctacgcgcgcgaggcagcgacgaccgcgattgggaagaaaaaatggttccctgcaaatgagtaacgacatatacggatatgggaacatggattattgggatgttggttagggaatttgttggatgagaattttggttaaaatttctttaatttaaggatagggaatagaataagtaatctgttgggcatgctctcagccctgaaacttaacctgaacagatatttgcagtcagggccgttctagactgctcctagttggcttagctacttccttgtacttcgtgagcacacgctatcaaaatgttctttttttcaaatgttttctatatataactttcttaaataaataaataaataaatctatttttaaaatttgtaatagctactccctccgtccctaaatatttgacgcagatgacttttttaaacatgtttgaccgtccatcttattcaaaaaaatttaagtaattattaattcttttcctatcatttgattcatcattaaatataatgatgagatgtgagggaggaaggaactccctcttttttaatacctgggtagggtggctttactttgcctacgtaaatcccaaccatctgtcttcatttaagatctaatctccaattaaatttcctatcaattcccaccacctctaccaatcaacgtaaatctcaaccatctctttttatttaagatataatctcccattaaacttcctatcaattcccaccacctctaccaatcaagagattgagagtaaaaaatcaaattcttatgttaatctcataatcaattctctcatctaaacctccaatcctttctcttaaattgccaaacagaattctctcatctaaccctccaatcttttctcttaaattgccaaacagaccgtcaactcctccgaacggagactaaatattgttttttttcttccgaacaagatgtacaccttttatgtccccttttttctcgatggtgcatccagatggcaataaatagcgtcccatgctgttcaaaacttcagaggatgcaacctgaaccacaccccattttttctctgaacattcagactgcctctgttcgtacccctgtactactgagcaggctaggctgtatgaaaggcatcgacatggactcatggtcaccaccatagcgttcgcggagcagcagtgtagcaccggagctcgtgtctctgggcagcctgcgacacaagagtggcgccatgatcagttggattaagctcagattgtcaccttgtcacacgtatcgtctcgttcgcatgatcaggacttcttttgactcccgagttgtgatttggaggttgaaacggatcaggactatagtatccaataccataaattatctcttcttggatcaactcgtcgagagagattaaacggcaacgcgtggtatccaataccataaaagcatcttgcagtctatcgacgaggctctctcttcggcagggtaccggtggctgcatcgtctggtatgcggtatttcaaactctcgttgctcttaattgaatttgttataaatattagtcgatatagcggaacgataactaatcttcccgatcgcttcagtcattgaccacacaagacatgctaggtgacgacataggaacacacaatatttgttaacaaactttagctaaagtctacatctctagggttctgattatgggcaatcctccacaaccaatatagcacctagccgctacgagttcatggcctcgccgccatcctctccctgtgtgtctacactacattgcagtcctcataattacattatggtacccctctctatttaagagagttgccggttacagagccagagtccgactttaactctacccctaccatctattataactctaagtccaactataaccatatacacctattctaacataatcgatttgatttaaacatgcgcttgtttcatccaataaaagaagtgtctttgttgctagattagatttgacaaacaaaatagcacaattgcatcctctttttgtcaattcttgcagtggcagacatgttgacttcatcggctgcccgtacgtcctcacggagcgtgtgggagggcatcaccgggacgcacgacttcgaggtggtcggctactcgttgatggacggcttcggcgccggaaggcacgtctgctccggcgacttcagcgtcgccggccatgactggtatgtcgcgttctaccccgatggcctcgaccaggattccgccggctacgcgtcggcctgcctcgcctaccgcggcaaggagaggctcgtgagagccaagtacagcctgagcttggtggccagggacggcagggcgtcgccgctcgccggcgacacgctgcggtcgcactacttcacgccgacgagccgcagcgccgacgtcctcaagttcgtcgagaaatccaacctgtcgtcgtcgccgtcgtcgtcgtcgtactcgtgcctcgacgacgacaccctgaccatacggtgcgtggtcaccgtggtcaccggcccgcgcgtggtgagcgtcgcgccggccaaggagaggggcccccgcgtcacggtgccgccgccgagcctccacgagcacctggcgcggatgctgcgcgacgggcggggctcggacgtggcgttccgcgtgggcggcagggtgctccgcgcgcaccggtgcgtgctcgccgcgcggtcgccggtgttcgacgcggagctcctgggcccgatgatggagaccaccgctccgtgcatcgagatccacggcgtcgagcccgccgccttcgaggcgctcctccgcttcgtctacacggacagctggccgctcgccggcgtcgacgtcgcggcgacggtgcgcctgctctccgcggcggacaggtacgggctggagaggctgcggctgatgtgcgaggagaagctgcacgagggcatcgacgtggacaacgccgccgacgtcctcgccatggcggagctccaccattgctcgcagctcagagacgcctgcgtcgcgttcattgcctcgccgagcacgctgggtcccgtcctggcgtcgagcggcttcgaggatctcatcatggcgaccggcgcttcggtgaccaaggagattttgcacaaggtgtccgaatcgtggagcggtcctggtaacagaaataattcaagcaaaagaaagtgagaaaaatggcaattatattgaatacgactgaactactctattcgttagtatttttagtttccccagcaaagattatcgagggtacacttttcaaactacttcttcttaaaaaaaaccaatctaagtgattcattatcctagttagtgtcaaagccttttcaaggacggaggaagtacacggtagtttcgtgcataagttttctataacaagtttattttttcaaaaaaaaatcaattataagcttataacaattaatacttaataacttatctcattttgcgtgttgcaataagctaaacccaaacatctattcgaaagtaacctaaactacttagattcctcttgtaaacacttgattacttgaaaatgcatagattcctaagtacagggatcaatgtccttaaattgcttatactgcatataaattttaaaaatataattacttatatttgaaaacaaataaaatatacgacacacttatacttacactcaattttctggtgaaaacaaaacaaaaaaagccaatcaagcagaaaacaataaaaaaaagccaatcaagcagcaaaggagcatttttccccaagctgacaaaaaaaaaaggaattttccggcaacgagcaaatcacgggctcttcccacggcccacgggaagtggtctctctcggtctcggccatatttgaaccctgcatccccccacgtctcctccccctctctcagtctctctctctctctctctcccgttcgtgcgtgctagctagggcatctcgtcgcattgatgcagcagccgccgtcgcagccgcagcccggcatgggcggcccgcctccgccgccacagggcgcggcggggcagccgccgcagtggggcgcgatcccgccgccgatgccgccgcaccagtacggcgcgccgccgccccagcagccgccggcgatgtggggccagcccccgccgcaggcgcactacgggcaggtgcccccgccccagccgtactacgccgcgccccgccgcaggcgatgcccgcccccgcggccgcggacgaggtgaagacgctctggatcggcgacctgcagccctggatggacgagagctacatctacaactgcttcgcggccaccggggaggtacgggtcctgatctgctgtgagatttggttgcccgtaattttttgtttgtgtggcttgttgctgatggagttgtactgtggtgtattgcgactaatttagttcctgatgctgtatgttgtgacttgcgactgacttagttctgacttctcaaaagctctaggctatgagttgtgggtctacaataaaaccaaaatttcatgcttcggctgatttatcagtgattgttgaatgtatctttttggtttattgagattttatgaacatgctactttctttagtgaatcgatttcggaaggttttgtttggttttttacttactgttttcacatggatgctaagtttgcagactatataacatttgcgtacattctaaatgctatttatgtgattcggttttgctatcaatatacataagccattgctcagatgataatggatgaaatgcaacatctaatatacccagattgtgtccgcccattcatgatttacctaccgtatctaacgttttgcatttacttgcaggttcaatctgtgaagcttatccgggacaaacaaagtggacagcttcagggttatggctttgttgagtttacaagtcgtgcagctgctgatcgaattcttcagacttataatggacagatgatgccgaatgttgagatggtcttccgattgaattgggccagtgctggcgagaagcgtgatgatacccctgactacaccatttttgtcggggatttggctgcagatgttacagactacctactacaagagacattcagggtccattacccttcggttaagggtgcaaaagttgtaactgacaaaatgacaatgcgttcaaagggttatgggtttgtgaaatttggtgatcctacagagcaagctcgtgcaatgactgaaatgaatggaatgctttgctcttccagaccgatgcgtattggtccagcggcaaataagaaaacaacaggggttcaggagagaggtaaatgctgctgatcgtatttcccattgacaccttttacttattagctattattatgggcagttatctttatttctatctatatgtatggctggctactctgcttgatgataccttttccttttgatgttccgcttttaccttttccggttttacttacttttacggaataaaccaaagcttgtgtgaccctttttcttcaagaagtcattattccttagtacaacattccctgtgaatttggatcatttcatgcactagaactagaaaaatagtagacttatgaaactcgtgttatctggaagcaggaggtcaacaggctctctccgtattggagttttggaactgatttgagctgtgatgcatttcttgtgtaatgcatggcctcatttaggtcagtgtaaaacatttatgttctaaatttgaagtctgtttctttcgatttctgccctccgaatacttcagtcatttattcttcttgctatttcagattctacttcatttgtgcacgcatacgtttactatacattttctttgtttaaaaagttttatgactcatgcttgatgtgatatgcacatagttaaattagcatgttggctcgagcttgcttttatttgctaggcttgactattgagggtcatatccgtgcttcatgtattgaggcttgatatttttaacattttctatttccttctttttgaaaaatagatttttgaatgacaaaatgttagtaccttctgtgaataaattcttgtctttttcatgccttctagtttttgtttttgtgatattttacacttcgagttgccacactgtttatctgttcttttaaacatctggagaatattctgcttcttttctcaacatacattatgataggcttgcaatgtatctctcattttatctgcctctaacttgacatggaatcgattgttggggctgtatttcattctgtattgtgttgtgtattcagcttgtttgagattctatgtatacaatacttaaaaaacagtgttctgcttgcccttttccttgattgggtagtcttattagcatttttggccacttaactccattataagtctgttaagtgaaatcttgtctacatgtgtactattagcttggtggtttcgcctccataatcttatcaaactttagcatggttctgatgaacatgttcctgaattgctgagctatcctagttactctattctaaattgtcttcagtgatgcttgatattctgcttaatgcatatggcttgacatggctggatctatatgaatatcactgcttatgcttgtaataatctatttactactataagaacatcagtgaacgagacatttgcatgataagcattcatgtttaccagcatttgacaaatcttacattgtattttcttcacttttttgctttcatttacagtaccaaatgctcaaggagctcagtctgagaatgatcctaacaataccaccgtgcgttcttagttctatttttcctgtacaacagtaatttcttttcagttcatttagtgactatgtttgttgttgagctcagatattcgttggtggtcttgaccccaacgtcactgaagatgtcttgaaacaagttttcgctccttatggagaagttgtccatgttaagattcctgttgggaaaagatgtggttttgttcaatatgttaacaggttgactctttgttcgtttgttctatttccacagatgtcttactgccttgtattttttttttttgatgaggtacttgcaaattactcttgtcattgcatattcaggccttctgctgagcaagcactggcagtgctacaagggaccttgattggtgggcagaatgttagactttcgtggggtcgaagcctttcaaacaaacaggtccagatcaaactcaacatagtaattttcttatctataaagctgtataatggagctaaagttgataacattgtggtttttgaatgtcttcagcctcagcacgactcgaatcagtggggtgctggtgctggtgctggtggttactatggtggctatggacaaggttatgaggcttatggtgggtatgcacaacctcaggatcctaacatgtatggttatggagcctatgctggttatcccaattaccaacagcaacaagtagcacagcagcagccgccgcagcaggtgagactcccccttcttgtttccgatgtcatctaacattggaaatttacacactttacaaatattgtaactttcttgaaagttatcatgaattctgccatgtcaatcagcgtttgcatagctatatcctctagcgattaatttgaagcattattttttctttcttccagtgagccctgtttgatcgatcgcgtctttgggctgtgaggcacacaacccatttcaagctacagctttagctatgttattgctattctcaatagagagacggtttctgaagactccagatttcgattgaggttttaatgtatgaactgtattatgattatgaacaacggatgctgccatatcgtggttcctatattgagtcatgtattttgaaaacatatcctctgtttccatctcacccttatcatcgattattattattgctatgtaccgtttgtttcccgttggtttttgcgtgttggattctcctttttcgtgaaggacaagtgagttttctggttgcctgattggccacgtgggcggacattgcatcagggcatcagtgtatgctctgcacaatggaatctcgccaacttttgcttcgacactttaccccggttaaaatctttgctcgtgttttttttcaccgtgaaaatggctgttaaaatttctctacttgttttcaccgtgaatggctgttaaaatgtgtatatctatctgatcgtgtgccatggaagacgaaatgataatcgttttcactcgggctatttacgaggttagaaagtagaaactagaaagacttcaggaaagatctgttaaatgccatggtaaatttgacacagacaacgtaaaagctcccattaatctagtgctacactgacaccgacagcgtaaaagcacccgtaaatctagttgtattattcgcttattaacccagttaaagttaattaatctggttccaccatcttatcctagctaatgtgctttaagattagcgcgcgatcgaatcggccgcccttgaaatcgagagagctccgaacttaaccttcccgtttgcacggccgcatcggtggccttttccccttccgctttcgtctcgtctcgcctcgtcgcctcgcctcgcctcccctcccaccaccctctctctcttttccctcccttcctccctcccatggcccgccccaagaggacgaagccgccgccgccgtcgcgcaaggcggaggcggcggcggcggcggcgcagcggccgtcgtcttcgtcgtcgtcgccgtcgccgtccctccccgaggcgctgctgctcgcgacggtgtgcatggtcggcctccccgtggaggtgcaggtccgcgacggatccgcgtacgcgggcgtcctccacaccgcctccgtcgaaggcggatacggtgggtgctcctccctctctcctcctcctcctcctcctccccgtcgttgtttctgtggttgggtggctcgcttagggttcggagatcgcggggatgtggttgtgagcgtgatccagctgtgtgcgcgtgtgtgcgtagtgggtggcgatttttaatagggttggtgctccggctttttttttttttcgtttcgaagttaactggttcgtgatccgcttgttggttgggttgggtggcggtggacgctggacgcttgcgttgtttgttttttggatagtgccatggtgggatggatttgggggtggttgctggttagagatcgctggatgagtttcccccatttgtggcgtggctgtagatgtacttttgtgtttgcggttaagatcttggctgtttggtctttgatcgtcgtgattgcggtggggatttggatgagagtcccgtaaatcgttcctgggttcgtggtctagagaggatctcgcactgggttccaggatcataggcaatgatcctggtctctataatgtaatcgggtatcatggttatgctataaaccaactgcctggttgattgcaaatatatgttgtttttcttctctagaattgagatgccaatttgccatgaagaaatttatgattcatttagtgcattctagcattctggcagcagtcacatttttgggtttgattcgtactccttttggatttgtaatatcctagggatgcattttttttcttgccagatcatgtttataatgttgttctttctggtttcaacaatcaatttagttttctttttctgtgtggagaaaaaatgatactgatgtatttatgttgaacaggtgttgtgctaaagaaagcgcgaaagatcgctaacgggaatgataatgccaatattcctctgggagcttttgtagatagtcttgttattcacccagatgatctcgttcaagtcattgcaaaggtagctttgatgtgcttaaacatgctaacaaattttcccgccaaaagaaaaggtatactaacagattgccttctcgtggacgcttctacttttcaggatttttcactccatacaaaagatgtgtgcagaactcctgtttgtgataccgtcgcagccagtgcatatgtgaagcctcaaacttcacatgtgaatgtgtttccactaaagtatattcttgattcaccaataataggataaaactctttcaattgtttctttaatgatgctggttaataatgtagatttctagcaatctattctgtatatatatttcaatgtctattcattcttgaggttaattcatgctatttctttaacagagaggttaagaagtgcagcacgccaggtgaggagactaacatctccattgggagaagttctcctggtattatgtctaacctctttactattttactccgataattctttttccacttttcttccttgtacttaaacccgtccaactgttatgctagcctctccaactggatatgtagggccacgcctctcctgtaacgagataatgagttctgcggttgttggatcaaaagatggaaatactaagagtgcagttttgactacacccacaatgtcttcagatgtgaaaatctctcctccagccacagttgctaaaactgccacgccgagcaaaaccattgctaaggtgagctctctcggacccttgatacgtaagcatagggaaaactgtgtctagagaattagagatctagaaaaatgttttgctaatatattttaccttttaaggagcccagtactatttggaaagcattatcagttatttcgtccatgtacataacaatctgtgcaaggcttgccaactatgttatcaatgttatcagtgtgttattttcttattttgtattatcaagcacagttctctttccttcctatgtcatggatttctatgcatcctgagggaatgaagccgtgccaattctgtttttatgtttactgctgtcctagatgttctacctttgtaaccttcctgtgcttcatcattgtcatcagtccattcactattgcaggaatccaaactcaacccttgtgctagggtcttctctccttcgtttgcaagttccagaccagtacttgcagctgcaccctctgttaacccaatctacatctcaaactctgtagctggagttccaaccgggttacctgtatttgaaactaactcagtgccaggcggttcatccctgtccagcaaggctgttcattataataacctggctgctgcaaactatgctatttcacctcaatatactcagtcagtaagttctttgattaattcttttataatatcattgttgcttcaatagttcatcactttcttcagattgctgtcatatagtcatgaagtgataaacaaggaaaatattgcaatatggtgccaactcctattcagcaccgacattcctttaagctgataatttgctttatgtgaccactactactatctctacatattttaactattatctttactctggtgtaattttccatttatcttgagattaactattgaactactaatagctatcgtcaggggcggaatcaggcatggggcagctagggcttgagccccatgcctagctccataatccccattataatcttgaaaaatgctatgtaatttatgaaaatatttgagatcccattagctcagccttaggcgtggaaattttctggctccgccactggctatcgtttatcgttatgttatattctgtgcattgaattttcagattctacttcactttgatcttattgctgcataactctggcatgtacgttttgttcggatatgatcctgcctcctgaatccttatacatggttttttgaatgacagaccatggggcataatgtgagcaggctggatcctgctagaattggcacaccttatcatcccatgcaagttggacctgcttacattagccctagtcctcagcctgtaagttctaatcagttgtatatatataaatatatatatatatatatatatatatatatatatactgatattaatttcaaaatgctgttcatttgtacctattggttacatgatatactatcatttgctcctgtactgatctaatttatttttatgttatgacatcataggttactggtgggaaatttaatcatgttgtttatgtacacccattttctcaggtgagtaatgcaacagtgttatttctattaatagctcaagtggaactctgcgagagtaagatgatgaattaatgatgcaagtacaatttgtgttgtttcatacaatacttttaactgattaaatagtgctgattcattggagatatcatggttgtcttttgtatcgctcaaccagtagatagtgcaagtgaggcactgttatccaaattgaacttggatattcgtctgttttaaaaaataaaaactactcagctacatttcacacattagataatgtgaagcttcatttcgtggcatgcatctttgttggcaaccctatacattgcgtagtcatttaggcatatgaagctctcctgttaaccgtaatgattaatatttgacattatcatccctctaaaaaactcatcctagttatatttactgcaaatacaaattgccctaactgcttttagctgatctactatttgctttccgctgaaggatgtaatgcatggagcacctgttatgccccaaggatggtctcttcctgcaccattgaactcacatcaagctagcctccagaagttccaaggtaaaaatcgtactcattgtcgactgcttcctttattttaatggaaggtattaaaatgtttattttatttattcattacactaatcaaaacattttacttcgaaactcttccaggcacagcccctgtatatgtagccccacctatcatggcaactgggaacctgccattggtggtaccaagccttgcaccgcttgtgcagccattccaggccgttcgtcccatcatggtacctgctgcaagcagcatggttccaggca

SEQ ID NO: 39818 - DNA, 8604 bp, Oryza sativa
aagagttagatagtaaattgattgttttcacagggctaatgtacattgatcttgtgaactgttctcatataatgacggacaatcccgctatgaattagttttacctttttggagcatgtgctgacgattgatccagtgtttatttgcgccaagtagcgtttgttgtagcagctgctatatatagaggttacagatttctactgtccgctactgctataagatagtggatccaacatagtgtattggaaatggaacttggcgaccgatattacaataggctttgttggcctgctattacgcttaaacacgaatacacgatgttctctgtgtatgaataggatataagttaacgtcgtgtgctttctttctctcatttatttatgttgctttgtagtttttataccttgaaatgtatgagtaattaagtctatacttctaaattgcaagtgaaactagatgttagtgttactacataatctaaatttactgtttattttttgaatcccgttattggacagtagcacccgcgatcttcaatcggctacaaaaatttcaagcccgaaaccttcacaccaggtctttcacaagctacttgagaaatcactggatttgcctctcagactggccaggcacgccaatgtccatgagtaataagaagctagttcttgtagaaagagtgcctaaagtagctcttctagtttgcatattttatattgcatactccctccggttctatattaattgacgttttggacatgattgaggtcaaacttttatgactttgactatcaataactttaaaaatatttagtttaaagaaactagaaaacatatatagatttgtcttttaaaacactataataaaagtaaacatgcatttatttattatatatattatgatataaaaataagatcaaagatatatcttgtagagcgtgtcattgtccaaagcgtcaattaaaatgaaaccggagggagtatgttattttcatactgtcgactggaatgccctacgataatcggattgtccggttctatagttgttttctaccgttgttgcattgaccagactgtcctatagctgtaagataatccaactccagtataggctgtgtttagtttctgaaattggggagaagtttagggaaagttggtagtttggaaaaaaagtttagagtttatgtgagtaggaaagttttggatgtgatgtggtgtgatggaaagttgggagtttggaggaagtttggtgtgaactaaacaagaccatagttggactgtccggttagttctaattctgctaaaagtttcttgaaatttcaggaaacatctattctaccctctaggcgacaacaacaatactcaaggcccttttcgtgaatagtctgtcctttttttttcttttttttgcaatggtaactgatactatagccgttgagctataaaagggcaagataatacgattggcaacaccacactccatatccccgcgaatgcgtccacataacacatgctctaaacaatagaaaccagcggcacctcctgatctcactaaattcctattgaaacctacgtgtgcgtaatatttgtggacaccaagatttaaatattggtggatggagtcatcacccatatataacttcaccatcataccgccgctggtgcttccctaatcagcttaccatctgattgtccggctagggcaactcccaaggcaaactttgaatcacaaaaacgaataaccctggttggctccacatgtatccactgagcactttagcgatttagatgttacaccatctaacgtgcatcacaccgagatgattagtaccttaatacctcaaactacaagtttcatcccgctagctatatatagtacggtctttgaatgtaaaaacaacctatttgtaagcacgttcaccccaagtccctaactccttgaacgtgtttttaccttgaagagggttgtagccaacttccgatctcttgatgaccgtaagctatctccaaatggacaaaacggtgtagcattgtttgtatcatcaaaatcctttttttttcaaacttagcaaaagtaaatagttccgatgatcatattgtcatcaaccaccaaaacaaccagaggggctagatgctttcacgtggcataccgcatttgctgaagattttgtggcaaagtgtgaataccatccaagtattctcagactgcaccatgatagacttcaattgactttttttttaaaaaaaaaaaactacttcatctgtcccaaaataagtccagccctgagtagaattcaattgatttaatattaacttctgccagattccgcaaggacaacaataccggatgcacatgtcagtaatgaaaaagcaaagtcgaaagatacatcttccggtttctgagatactgtaatagattttgacaataacagcttgccttctgttacttaattatcacaagggccatggtacaaatgctttcgattcagatatgccattttcctatatggggcctagtccttccaagttttttctcatttctttttgttccaagtatgaagtaacttttttgtatggctttacatcattattaaaaggttcaagtatccttaaatggaagacgaatgaaaatgaaagatagctcaagtatccttataaggaagacaaataaaagcgaaagacaagtatatatcctagagtacgagtctacgcctttggcatccagccatttatagtaagacttggcagaaacaatctggatttgaagctttcacctaacattaagaatcattttgtctttctcaagcgctgctttcatttgttgtcaaccttcatttcatgactgtcatctggaattttgattttcaatgtaacagcaagtttgttagttcttgcagtaaataatagataataataaaatgttcccaagaggtgtagaaggttaccttggggattatgtactgcggttgaagcctctaccggaggtgcagttcctgaaataaaagaggggtttatgtttagaacacaatccaaggaaaatggttattgttagcatcactgcttatgtaaggcacacaacaaagaactagcagaaaatcaatggttacacacgactaaggagaaggatttatgttagcaacacaatctagcttatgtatggggaacacaacatagtactagcagcaaatcaatggttacacacgaggaaaaggatttatgttagcaacacaatctagcttatgtatggcacacaacaaagtactaacagcaaatcaatggttacacacaaggaaaaaaaagcttgtgcaggcaaaggattatctttgagccaataaacaaacatatttgctcagaacatatgcccatagaatcaaagcttttaacgttactctaggtgccaataaaaacattaaaagtagagggtatcacatttttacctcctgaggcttctgactttgagtcatcagctcctttggaaatgtctctctctgtgtccagctgcacagcttgttctgtgctttctaaatattcatatcaacagcattaactagagggttaatactaagcatgtcaaataatggaattatgtattacccggtggttccataaaagtttgttgcttgctatttgtagcattaggctgctctttgggacctaaagatacaaatccatttagtgattgttcttgatagaaaataagtcatcgagggcagaaggggcatatatagtgttgtacagatgctatcttgacaacgagcgtgctgaatttgtcatgccccaaaataaaataactgaatctacttgtgtgtgacacacatgaatcgagcatacaacatctaaatcttacccaaagattcctttatagcatccattactggaacattaagcagatgcctttcccctataatgacacaaaaaatgtgatctattatttaagctttatttctatccagaggtaatatattattcaaagtagatcaaattgcattcctccaacgaacatacctgatgactcttcagtgtgctttgaagattcagagactgtttgaatctcattgacagttttccctccagcgacttccttgcatgatgccaatacaggttgacctgatttaataggtaccacagcagataacggttgtggattcacatgttcagtaccctgctcggagaaaatccttgattcagcattactgggtgaaactgagataggtactgctgcaacaaccccagaacccatgtgaggtcttggaacggaagggaccgtgtgcttagtgaaggatttctctacaggcctcctcatctgtagaggctttgcaaatgtaacatccttcaaggggactggaatatgaccagaagcttgtctgtaaacagtaaatggcctctttcgaacttgacttggtcgaagcatagggagatctggggcaagatcatcttttggtgttattgggcggaggttattttcatcttgaatccaacctttgagaacctgattggcttcactttcaccgcaatcagagaaaacccacgaaaatttttcgcatcttaccaacaaaatacttgccaacaatatcatctttgactgaattaccttgcaaaggagcactagtataaatggaggcttggctgagagaagtcttaaccagattgacagaatctctaggtccactggatctattagctgggccttgctttgtaggcaaagcctgaattgtgcctatattagggccaaagctaccacctgatgtatggttgatctgtatcccatcctgtcggatgtttgagctatcttgtgtgctgtgaagaggtgggacgctctgaatgtgctgcacactatatggtaattcatgcatgccgtactcatacttccgtggacgaccacgcttacgcttagcaccagagcttaatgtctgctccatgggtagtggttcattatgtgcaacagctttattctcttcagatgtcatctttggcaatttgctttaactttttgcagctgaacctaggaacgatgataatgccccgtaaaagtgtattcaccaccttcaattacttgatgagtttttctccccttgaacatgcaaagtgagcgcaatgagcaacctcaatagcgaaaggatggcaaaatatggcaagtaatcacaagaagattagaagatgatagagcaagtcgacaatcaggaagatagaagcctactttccatatccgctaagaatgaaattaattaagtctgctaagaacgtaactaaaaaggaagctctcatggaattattttcaaaagagacatagcacagtttgcaataaataaagtacccacagggtcatatctaggggagaaaatggtcggaaaacagcttcaaccatttctgtaaccgtacttttctcgaaaatataattgaaagcagtagagccggaaatggaaatggaaatgatattgaaaaatcaaaaagggaataatccgggcggaaatgtgttggaatcattaggaaaccaacaattcatgtcggaaacatcaaatagtaacaacatatgttttcacacacttgaccaacacacatatacacgtaatataactcaatttatttaatatgatggcatgtttacatatagccattgacaattgtactaaaaacatttatgaactaataaaatagttgtatacgaggtgcataatgaagtttaaatatttaatatggtggttggtgcatgtcttttctaacttataggtcagctgtttgaatcccctagctggaaccatttttgtgaaagaagtgggcagggtagcttggtcaagtcctgattgacgtagtggctctctacacggtgatgtggcctgaagtggtcctctacttggcgtggatcatgggcctctacgcgttgctatagtcagcctctagttggagctgtatatgctaattaccgatttccccaaaatgataatttctggaacaatatgataaaccaagaaaatggtcgattgaacagcaaaaccatttctgccaccgtttcgaatggctcttaccgtttccgtaaccgtttcaaggggcagacacaacaggggggcccgagcatcccctgctgcggtccaaccattcttccattcgtacaagtggcagggttgtagcgtgtgagtgcaagccgactctggtgtgcatgccgcttagttgagttcagctgctcaggtgttggtgcctctgctgtgggctgtggctgtgataaatgaaggcaatttgtgttcagtttccaaatttacatttataaaattatgaagtagcacttcaaaatcaccattaattatgatgatattagtacacaaatagatatttaagcacatttatcagttctcaggacttcgctgtgcattgccgaattactatcttcaattttcttttgcacgattggtttgtttacatgcggttcatgtataaatttggatccaaaaaaatgattcctttcacttcagtcgttactaatgtgttttttatttcactggcaacccctacattttaatcctgtgtgcgtcggttaccattcctagtgaccaaatccattggaaacagtaattgccaaaaacgagcattggaggaggaatttccacgaagccctagtcatatctaatgtttatataataaataacagtaaatatccatgaagcaatgaaaatgaaatttgtcagatgcatacgaggcaaaaggaacataaataccttcctggctataaatgttctatagcaactattactagcatcaacatgtaataaattaaactgggttatattcttggattacaaatgcagaaaccaacttattacggcgttgagctcttgtagatctgtaacacatgccctgagcacaaacactcaagctttgtaaaatatgtgtcaaacagatgaactagagggaccaactaatatcaccaaacttgttcgttggaacttgtaataatccctaaatgttgcaccaaaattgcaagcctgggctcaagcaacaaaaagaatcgtataaagatgagttggaggtgaagttcattaccactagcaatcttatccaattcctacccaacctaccacactaaaacctaaaaaaaatgcagcaatgcattttttaagtaaaattaaaggccgaggcacagctttgttgaaagcaataaccaaatgaaatgatttcccctcctcctgtaccattgattaccatattacatcaacacataacatcgattaactgagctcctaaattccgggaaaaaaactggatgagctaatcagagggcaaaaaaaaaaaaatccatctaatcccgaatgggtcacaaatccaatcaacgccgtctcatgaaatgacgcagatgcccaagagagaaaaaaatggatacctccaatccgatccgaccccgatacgatcgccgttcccgcgcgcgcgaggaggccgcgcaccaagggtgatagttgatacggccactaaggggggtgaggcaatccgcgccgtgtctccggcgcccgttcggcttctcccccgcggcgcgaggagaggagaggtggcgcgccgaggcggcggaggagagctcgccggggcaccaccggcggagacacggaggaggaggaggaggagagatggggaggaaaacgcgagagggagggggggaggcgatgcgaggcgtggatggaaatcgtttgccgtttcgatcgtgaaggcgaagccgtgccgtccgtcgatcccagccgatggatttagtttggacggtttggatttgttggtattggttttcttttcccttttttttttctgagaggttgtctgttttgatgatgatggatggctaccaactcgaggtttcgaagggggccgagccatcgggccagcgttggcattaacgtgtgggccgacccataagctacatatgggtccacgaggcccatcattggcgtgtttgagtaggggaaaggagaatgttgaaaagatgctcaaaacgagatgaaccattttcacataattaattaagtattaattattttaaattaaaaattaatatgattttttaaaataatttttatagattttttccaaaatacacaccattcaggaaatgtgcgcataaaaaactgagggactttttctctttatcctctccaaacgttttgagttttcatttttctctcttgtttgttgtgcataagtcaatctcaataaaaaaactgagagattttttctctttatcctctcttccaaagcagtttgtagtacatctaaagtaaggtttctagatgctaaacggttcattataataaatcttataatttgggtaaagttttcctctgataccccacgcaagagtagtacatctaaagtaagggtttctgaatgctaaacggttcatccattttttctataaaactaatgtccactaaatatctaaaactcaacatgcaaacataatatttattaacactcctaaaatctacatgcaaacatgtcacatcaactcatttaacacacaaagttcaacatgcaaacatatattaattatatctataatttatttcattctaaaagtaagcatacacatgctaaatcatcattctcaaattattttcataatattttaatccaaat

SEQ ID NO: 39819 - DNA, 9916 bp, Oryza sativa
cggtgtcaaacattttgaaacggagagagtatttcattatttctcccatatctatcatatattcgcagcaaagcgtggagcatcttataataagagaaactacaaactaaattttcttcaaccgcaacacaaatttttcttcaaccacaacatatcatgtgtagctaacactaaactaaattttcttcaaccgcaacatcatgtggagcgaacacaaattttcttcaatcacaacatatcatgtggagctaacactaaactaaaatttcttcaaccgcaacatcatgtggagcgaacacaaacatcaaactatgtggagcgaacacaaacatcaaactaaattttcttcaaccgcaacattatgtgagcgaacacaaattttcttcaaccgcaacatatcatgtggagcgaacactaaactaaattttcttcaatcgcaacatcatgtggagcgaacacaaacatcatgtgaaatttttttcaaccgcaacatcatgtggagcgaacacaaatcatgtggagcgaacactgaacatcatagttcacaaaatatggagtttactttaagtacagttctacaaagcttctacaaggtgccatacacacttgtaaatgcaactagtgcatccagcttcagatccggcaaccgattcgtcaaagcctcagacataaatgctgacacctcagtatttaagaaaagagattacagcaacagtgattacatcaatcaattccaaccgtccaatgccatatggagcagtacagagaaatcacaaccgcaggttctgttcccttaatctaaactagcctttgccttctttgaacttctccagacttcagaatttctacagaagttcaggttctctcacttagcgacagatttctcaacaggcttcctcatctgtagaggctttgcaaatgtaacatcctccaaggggactggaattggaccagcagcttgcttgtaaatagtagatggcctctttcgaacttgacttggccgaagcatgggaagatctggggcgaggtcatcctttggtgttattgggcggaggtcactttcatctggaatccaacctttgaggaccagattgtccttcactttcaccgtaatgagagaaaacccaggaactttgttggacatcttaccaacaaaatacttgccaacaataccatctttgactgaattactttgcaaggaagcactagtataagtggaggcttggctgagagaagtcttaaccagattggcagacggaccaacactaccacctgatttatgattgatctgtatcccatcctgttggatatttgagctatcttctgtgctgtgaagaggtgggacgctctgaatgggctgtacactatatggtttttcatgcatgccatactcagacttccgtggacgaccacgcttacgcttagaaccagagcttgatgcctctatgggttcattaggtgtaacagctttattctcttcagatgtcatctttggtactttgcttcaaccttttgtagctgaacctaggaacgatgagaataccagcaaaagtgtattcacaatttttctccccctgaacatgcaaagtgaaaataatgagtaacctcaacattaaaaggatgacaaaatgtggcaagtaatcagaagaaattagaagacgatagagcaagttgacacaatatgttattgaaaaggaagctctcatgaaactattttcaaaataaacatgacacagtttgcaatcagtaatgtaaataaagtacccacacggtcatatctaggggtgaaaacggtttgaaaacagcttcaaccattttctgaatcacacttttcctggaaatagaattttaaatggtagagccggaaacagaaacatgctttgcatcataaggaaatcggcaattcatgttggaaacatgcggtatcatttggaaactgtgacaccgtatgttttcacacactcgaccaacatacatatacacgtaatataactcaaacatgtttttacatatagtcatttactattgaactaaaaatatatgtcaaataataaaatagttgtatatatggtgcatatcaaagtttacatactttacagaattggctatccatcaacatcagcaacaaggatggtggttggagcatgtcttttctaacctacagttagctgtttgaatctccctaaccggcgcctatttttgtgaaaaagtgggctgggtggctgggccatgtcctggttgctatggtggccctctacttggagaggatcatgatgggcctctagttggcgtggtatatagtaattactgatttccccaaaacaatgatttccagaacaaaatggtaaaccgagaaaacggtcggtagaacagcaaaaccatttctgcctccgtttttgaatggctcttaccatttctaggggtggacacagcatgggttcctgagcattccctgctgcgaccatagttattaggatcgaatcggtggtctgaccggaaaaaatcggaaccagggccttagccggtccacctaaaagatcgagtgtgcaattgaaccggaataaacaggttgaactgctggtttttacattgaaactggttgaatacaggacaataaaccggctaaatgggccggtgcacgacgctgactcagcttgaatggcacaagatgggtatgtgggagtggaagtgggagggaggagaaattaagccaaaaaggcagggcctgtgcatggggaggtgcgcatccatgttgaggaggtgcgcatctaccactaggctatatatagactagtgatttgatacatatcttttttccatttgaaccaggttggactagtggttcaaccggctggaccaaacaaaccatgaactgaggccttgactggttcgatgtctagtccggtcctaataactatggctgcgaccaaacccactggtccaccattcatacaggtaggtggcagggttgcagcgtgtgtgtgcaagccggctctggtgtgcatgccgcttacttaagctcagttgcgcaggcgttggtgcctcttgtgtggttgtgaggatgaaggcaacttgtgcttagtttaaatatttcatctatcattgcttccaattttctaatttatttttatacaattacaaagtaattaaatagatatttaagcatatttatcagtttgtaggactatgctttccattgctgaattactttcttcagttgttcttttgcatgatttgatatgtttatatgcaattcatgtataaatctggatccataaaatggattactttcacttcgttagccttgtgttttttatttctctcgcgcccccctaaatttcaattgtgcattcaccagtgaccatttccgattcctagcgagcgaatccatcggaaatggtaattgccagaattgagcgtcagtgtgggaatttccgcgactgttttcacccatagtcatatatatagtgtttatgtaataaataatagcagtaaatatccttgaagcaatgaaaactaaatttatcatatgcatacgaggcaaaaggaacataaacaccttactagctataaatgttttatagcaactattaccagcaccaacaagtaataaattaaactgagttacattcttggattactaatgcagaaaaacaacttattagcacgctgagctcttgtaggtctgtaacacatgccctgagcagtactcatgctttgtaaaatatgtgtcaaataaatgaactaaagaattcattcatagtgccagagggaccaaataatttcaccaatcttcttggttagaacttgtaacaatccttaatgtcgcaccaaaattgcaaccccggggatactcagatactgtaactgtgataaaacaatcttgtaaaaacgtgttttgaccttttggaagtgaagttcatcacccctagcaatcttatccatcccccaacccaacctaccaaactaacacctcaaaaagaattgaagcaacatccaaacgaaatgatttccccccttctgtaccatcgattaccaccatatcacatcgattcacttaacccctaaattcgggacaaaactggatgaaacaaaaaaaaatcaatcggaggcaaataaatccatccaaagcccgaacaagctcaccaacctaatccacgacgcctcatcaagcgatccgcggaggatatgagattgaatacctgcaatccgattcgaaccgagatgatcgattgatcgccgtccttgcgccgcaccaagggggataagagcagggcagggttcaggtaagaggacgaggcagtccgcaccgtgcctcccgggccggttcgccggcggcgagagcgcgcgcggaggcgaggcgaggcggcgcggaggagaagggctcgccgtgtgccaccggcgaggtagagagagatgggggaggagtagacgagacgagtagtgcgatggatatcgtttgccgtttcgattgtgaaggctcaagccggtgacgtgcgcagatcacggacgttgatttactttcgacggtcaggatctctcggccgtatgccagatcaaggctttgtacatggggccggccctcgagatagatggggcccataaggcccatctccatgttggcttggcctgcagctaaacgccgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggaggcccccttgccaccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgccccggggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagagaaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaataaaaatgaactaatatctgggctgaactgtaccgtgcgaaaccggtgttgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgtaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctacaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataacaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggccccccgcacagtgcaaaatcgccctcgcggagggcggcaagggggccgcctgcaaatttccatgccccccctcgccgcccatttgcaggcgg

SEQ ID NO: 39820 - DNA, 18739 bp, Oryza sativa
gggcccccgcacagtacaaaatcgccctcgcgaaggcggcaaaggggccgcctgcaattttgttgacgcccgtcgccgaagagcgaacgcccgtctgccacgtcattttcgccgccctctggaagagcgatttttaaaaatcgccctcccagagggcggtaggcgactatttccgtcaattttcaaaatggaaaattatttttgtaaaacttttaataagaaaaattataaataaaaaaaattcgctaaacgcctatatcagcggctttctagggttccactcagatcacggccgttgatttactttcgacggtcgggatttctcggccgtatactaactcaagctttgtacatgggcccggccctcgagataggtggggcccaaggcccatcaccatgtgggcttggcctgcagctaaaacgcctatatcagcggctttctagggttccactcggcgccgccgtgtgggtagacacgcgggcgaggttggttggcttgttctttcgttgatgtgttcttggttttgagttctcttctcggttttctctttagcgttcttgctgggatttgatgcaggcattgagacattgatgaactcatgagtcttagcgtatgatgtttttgtcctgttggaacatggatttccaagcttggatgccgcgagactcgcacagaaaaaagtgttgccatcacctccctctctctgcttgagcacacgagaatggagtcgaataacagcacaacatgtcccataatgccctgaatctgtctcattgtgcgttctgcttaccagccacagtgttcttggtcactgtttaagagctgactcttcataagctaatctctatttagttagtacatactgatatgaactaaggtttccagatgctaaacagttcattttatattttatgatttttgctaaactcttcctctgataaggcgcatgaaaaaacataaatcactagagacatctgtgtgtgagaattttattcaactgcatcttcatgtggagggaacattgatcacaagttttacaatatggagtttacttgaagtacagttctacaagtttcttcagggtgtcaaacacacttgtgaatgggttgaatgcaacaggtgcactcagcttcaggtctgggaactgattcgtcaaagcctcagtcatcccaggcattgacatcatcagaccaagctggtccgtggacatcacctcgcaatcctgtggggtgtccttgatcttgctcggatcataaccgaagttggcagcgtaggacttgtacttctcgatgaattctggtccaggattaggtgttcttgagtatatctgatgcattgccgagagacgacacaatgttatgatatttcagtttacaaaatgcgtcagaataggcatatgaaggtaaggaatattggcttgatttctcagtgttcaagtccttgcttaaccctatgttgtctctatttgacactatatttggttcatggaacagcttacgtaactagattgatctttcaatatgcagaataagcatgcagagggctaagaaatagtggtcatttgcagttcagagatcagtttctgacctggataaagcttgtgtctttagcaccagacacaacggcgtaattgtcataatcggttgcaagcacatcataaggttccttgggtatgaatggtagtgtggggaaacggagaaagcatttccccttgatcatctcctgcctttcaagatctgtctcagcactcgccatgtcctcttcggacaggcattgcacccttccccgaataccggtgatgtaaccatcaggtccaccatgaacacagaatgtgtccacctggattgagcgtgatttctcatcaaatgaatacaccccctgcagtaccaacaaatttctgtaacaatcttcttacacattatatggtgcaaatggcatagaaaaaatagcatgcctgtgataacctattccaaatcagtttgatacaaagatgtcagatatcggtgttttcaggaatcaggattcagaggtacatattgctggggcatcatacagattaagatctactagtatttgtgtgtgaggattctggcactacaatacctgagtacagtgacagtcctcttgtccctgaccagcaaagccacgtttcagcgatgctacttcgaaccatctaccagagtagcgaattgggtcaaagttcttggcagtcatacccttcatcatcaaacctgtgccgccatcatcagaagggctatcgaatttcagaggaaccgcagccttgtcgatggctgctaccacagcaacctggcacaattttggctgtacaaaggtctctgcagggatagcctggtcaactatgagagattaagagtacatcgataccatgttacaagcctgaactggtaatctcactccattttccctcttctcttaattgaaattaacaagttttatgtatccaatcaaaattgcagcagtaaaattctctcaatcctcaacagtaaaaatatcttttcttaaaaaaaactgttcttgcttagtgatcccgaggttatctctttgaattacgccgtgtttagttccaaagtttttcttcaaactaccaacttttccatcacatcaaaactttcctacacacacaaacttccaacttttccgtcacatcgttccaatttcaaccaaacttccaattttggtgtgaactaaacacagccttagtgtatatacatctgacaataagttaacatttataggtacctgacaaggtggagagatgaaaacaagcgaagcagcaaggcatgagagcaattttgtggataatactccatgagcattcagtggcaccttgtcatgcagagagcatctgaaattatttcgtccagcgggtctgcattttctcctaccaataagaagattacttatcagcattttcatccaggtactgtactaacctgactcctcctacgtgccatcactgaatgtggaatatgactttgacatcaagaatgttacccaaaatacatgcctgcttcgaacagtgaatacaatagaacagcacctgatctagccttatacaactttgatccaagaaaaatcaactgcgtgttgctgccactggcgcttgttacctggaagagcaagcagggtgtggcgccgcaagagaagaagaggaggagcccaacagcagagcgagaaccatggcttcctcccgccgccgccgtcgccgtcgtctcccactgtcttaggccgagtaaaccgttttctcgagattacgcggttgcagcttcttgagtggtttttggctttcgatgtctgcaggtgcgggagagagagagaggagccgaattgctggagaccgatgattctgggcagaggcagaagcgcatccagtgccgtccaatgggaggcgcccacgtgggcaatctccctgtatcacctgcgggccgttagctgggccagggccttgcacaaagggaaaaagtacaccgaaggtccctcaacttgtcattgagttacaaaatcgtcccccagctgcaaaaacagatatagaacatccttcaacttacaaaaccgttcactttaggtctttcggttgttttgaccccggttttgtctgacgtggcggctgagtcagcgtgggacgcatgtgggccccacatgtcagggtgtccgccttagcaccctttctctttccccaattctctacctttctcctctctctctcctctcctctctgcagggcaacggcgggtggggaggaggtcattagggtgaggtgggagaggctcgcggcggtggttgcgacactggagaagggaggcggctcgcggcggctgccgacgacatggcggtggcaggagaagggagagcatcatcgcgcgtgcgacctcagggttgcaccgtcgaaaaggctcgagaggcgggcgcggccgatgggggaggagcttggcgcaactagcaggggaggagttgcaattcctgggcgtggtagggatctacggggaggcggcgtccatcctccgcacccaccgcccgcatcgccgccgccttcgtcctcccgctcttcctcctcttcctcgtccacatcgccatctcccacgccctcttctcccacatcgactccgacgactccgccttcgactccgccgccccctgcacccacgcccaacgccatctcctccaccgcctcgccaacgactggttcgccctcctcctcttcaaggctgccaacctcttcgccatcctcttcaaggccgaccatgcaactcgcagaagggtaccgtcgggtttgcatttgaataggataccttttctcttttggatacacaacgagatcggccgcgctggcgaggagctcgccagagcgccactaccgccgccgccgccgatgccttgctcccctgctcccgtgtcgtcgccggccaccggacctcctctcccgcctcgccccatcggtctcctccctacctggtggtcggcctgcccagagcccaagagagaagagtgagagagagagagagaggaggaagggagagaagaggggaaagagagagagagagagagatgaggctaatgtggacgcgctgacatgtggtcaaagcgccacataggataaaaccgggatcaaaactaccgagggacctattgtaaccgattttgattagttaagggacgtcggatatctggttttgcggtttgaggacgatttttaactcgatgacaagttgagggaccttcggtgtactttttccttgcacaaagcatgagctactctgcgcccatagagcccgggctatttcaaaagggaacaaatttactctagattttattttcaaacaaaaataataattctattttcaacaaacttttttaaaaaaactccattttcaacaattttcatatcaaacttatttcttgggtttgtattcttttttttaagaatcactagaattgaaattggaagtgcttgctttaaagttgttttttttaaaaaaaaataaagtgtcaaaaattacctattcttacttaaaaccgacgagcactcgtgaatgcaatgttaattttagtgcatatgcatactagagttaacttctccatctcaaaataaatgtagtttcttttaaaaaaaaaaataatctccttctccaaatcgaaccaactcaaggaagggtgaattcaggggctgtcgttgacagaagtggctatctccgtggtgtcatagtgtgctatccatgatgtacctttgatccgttgcatgataatccttttacacagaactcttggataactattgtcgacttttccattgataaaaattgttgggcatcgtgaagcagggtttctagctgcttcaccggccaaaaaaatggattagatatcgcagctttttttctgctagaaaaataatttccggtagccaatatccaaccccttccattttaataccatcaatatattaaatggtatgatgttagtctattaaacctacatactcattaagcatattgtgcaggttataaaattgtaagcgtgccaatagtcacgctcttctagtaattatatattgcattgttgaagtgtggagttttttttttccaagtgtaccttaaaaaagttctatactgcattgttgttagtatctctgcacgggacctcttcttgagatctgccagcgaggagcgcgcggagagctcatttctgtgggtcaagagctcatttatgtgggtcgaatctgtttccaacctggtaacgtttataaaatctacgtacaaggacactttgtttggactaatgcgtccacgcaggtgaacactttttcggtttgatcgctgcaacctataaatatgaatatgactcctttccggatccatgctaggtttatttttttcataaactaggacggagagagtaaattgacgtgtggtatccacgtgaagacggtctcaatctcacatgttatctgtcctttttttttaacttgacatgttatctcacatgttatctgcaggtgaacacggaggtttattttttatttgatattttaaagcaacttcttaccagaaatttagcactttataaaaatgtggtaacagaaatcgaggtgaaatctgcatcttaattagaaaaaaaaaggacctagattttttttattaagattcagatttttacctcggttttcgttagcacatttttcaaactactaaacggtggtgttccgtgcgaaagtttcaaacaagctgggcaaacccgccgacgaaggaagcgagctcaatgttgtttttcatcctgttaatgtgatgtacctttgttccgcttgtcatctaaatagctactccttccgttccacaaaatgacattttagcttctttatctcttttctaaatttactaaaaactcatatataaatctaaacacatatatagagcatatacatatgtctatgtataaatttatttaaaagcaaaacatctagcattgtgaaaaccgaggaaatatatttttttagaaaaaaagaaaaacagacaaggttagtggagtaatttagcagcctccatccagcatcttccctccggactcccgtctccaaagcaagcgccacaactcgaccctctttgcacggttctctcaagcattcacccccaatacctgagcgctccaccttcgtgcccccgactgccgacgccgcagaagcacgtacggccttgggtaagtcgtaacgtacgtatccactctcctctaacagcagccacgaatcaacaatagctgaataccactgtcatattactgttcattcgattgcatttgagtgagaattaatggttcgtcttctcgattttgcatgcagcatcttggactgaagcgcaaccgcgcgcatcggatcgatggattccgccgtgagcgcggcgcggtgggtggtgggcaaggccctcggccccgtctcggacggcttggtggaggcgtgggcggccagccgggagctcggacccaacgtggacgccctcaagatggagctgctctacgcgcagggggtgctcgacaacgcgcagggcaaagacatacgcagccctgcgctcaaggagctcctccagaagctgcgagacctggcgttcgacgctgacgacgtgctggacgagctcgactacttccgcatccaggacgagctcgacggcacctaccacgccgccgatgagcacgccggcggttgcgcccgcaacctcttcctcaatgtcacccacactgccaaagctgccagcaaacggctgggattctctaaatgctcctgtgctgctgctgctgataatggtagtcacacctatccaagatcagaacaaggtgcgcaaggacgtggcctctgctgtggttggtcatacaacgaccatgacagtgaggaggaggaggaggccaccggcggcggcatccgcaagcttgcttccggtgctcgcaacaccatccatgctgtcggtaaacgcctccattgctcatcttttccagctgttgttgatgatgattctagcgtttcaatctgttgtggtgcttgcatgcacaagccaccacaacagagaaaggatgtgatcaaagaaacgccaaagttgaagattgacagagtgggtctgtctataagaatgaaggatgttgtcgaccaactgcagctcgtgtgtgcaaaggtcaccactattcttaatctagagatacaccattctatccgtagcactgattccagtactgcgagcaatcgtcccatcaccacacctacaagtatagagcctaaactgtatgggagggatgatacagcgaagagcataatagattatataacccaaggtacagactgcggcaaggacttgactgtcttgccgattgttggcccaggaggcatagggaagacaactctcatacaatacatatataaaagccttgaagtgcaaaaccatttccaggtcaaggtctggatatgtgtttctcaaaatttcagtgttgataagctcatagaagagatcaaacaatatgtccctaaagtggatggtgaaaaagatggtagaccagaagagctaattgaacaaagattgaagtctaaaagatttttattgatattggatgatatttggaagtgtcaaagtgatgattggaaaaagcttttacttccactaacaaaaggacagacaaagggtaacataattctagtcacaactcggtttccggttgtagcagaaatggttaaaacaatggataactcagtagatttggaaggtttggaccctggagcgtttagggatttattcctagcatatgtatttggtgataagctaccaagagacgtccataaagacttacttgtgatcggagataagattgcaggaaaactaaaaggttcccctcttgcagcaaaaacagtaggtcgactattgaggaaccactttgatcaatatcattggaacagagtcctagaaagtagagaatgggaaatggaaaccagcaatcatgacattatgcctgcattgcagcttagttatgattatctaccttttcatctgcaacaatgttttttctattgtgctttgtttcctgaagattacaagtttgacacaaaagaacttacttgcttttggataggactagatattttacattctgaatatcagaataaaacaaatgatgatatagctttgaacaatttaaatgatttggtcagccatggatttttcaaaaaagatgaaaccgatgggcatccatgctatattattcatgacctgctacataatttagcagcgaaggttgcatctcgtgagtgtgttagtttacattattctaatgtgagatcagtggaaatttggccttccattcgtcacttgtctatcaatacagatggtgtggatgatagtgatggaatgaacaatgaaagctttaggaacatattacaaaaactaaagacaagagtaaaggttgaaaacttgcaaactgtgatgatatttggggaactagatgaaagttttgctgaaagttttcatgatttgttcaaggaagcaagtgctctccgtgttctacatttgcccaaaatgtcatttcctgtggggttcatttttaataaattctcgacactagtccatctacgctacataaggctaggggcaccacgtcgaagtaaaactcatttaacaagtgccctttctagattttatcatttgaggattctagatctagaagcatgggatggttgtctcgatttgcctagagactttagcaatctttcaaagttatgccattttcttacgaaacatgataagcttcactttgctatttgcgatgtgggaaaactacagtttttacaagagttagaaagatttgaagtcaataaagaggaaaaaagttttgaactaaagcaactaggtcatttgatggagctaagaagacttggtatttataaccttgagagaatagacacaaaagaagcagcggcagaagcaaaactttttgataagaaccacttactgaagttggcattaagttgggacaaatgccaagcaagtaggtatcctgacaaagaagatcaagtacttgagaaccttcgaccatgtaacaacctcaaagagctattcatcattgaacatggaggatctacttgcccatcatggctaggtgcagagctctctgtgaaatccttggagactcttcatctttccaatgtaacatggaaaaacttaccgccgataggggaggtgtgtttggtaaacggacttggtgaagatcaatttgttagctgcaacacaggacaaagctttcagaacttgaaaaggctagaacttgtcgggttgcctaatttgagaaagtggacggcaaaagaagtcccgatgttctcacttatagaagtgctcatcgtaaagaattgcaatgaggtaatagaattaccattttcatattgtacttattgcccatcagaaggatatgagaatttgtttcctaggctaagagaggttgaaattgagaattgtccacaactaagaatgcctcctatgccttacacgcaaaccttgtgctttgtatacataaaggatgtagggacaaggttgaaaaaattacactacatgagcacatacagcttgaggattgtaggaaagacagatctaaatggcttagatgacaagattctggctttctataatttaacccaactacaagagttgatgatcaataattgcccacctttggcggggtgttaccttcaaatgttgacttcactgaagatactcagacttgatagttcaagtgtcgtgttccatctgtcagaaagtttgagtgactataagtggcaagttccagttgagtacctatctatttctagctaccatggaagtgggaaagcattgtcacagcttctctctcatctcccaaagctctcagagttgtatcttatgaactgcaacaagattacacggatgtgtatagctgtagaacagcagcaaacaactgctgttgagctggaggatacacaagcagtcgaatctattcagcagcagcaagtagcagaggatctggtggaggaagagggagtggtaccccagctagccatggatcaagaagatgacgatgggatgctgatcttcccagcacacctctccaactctctacaacaactaattctctacagatgcccggagcttatcttagatgttgctcgtcctgctcttcccaccagccacgaggatgagacaggaggatgggggctccaatccctgcgctccctccagagactacgggcttgtttggttggtgacctgactgacttgtctgagaaaaatccatgcctgtgtggtagaaaagctgtgttttattgtgcctgattaggcatgtgtgatgttttgttgtttggttgaaaacctacgcctgagtgaatatattatatataaacattttgtttacttgagtaagatgttgacaagtgttgataacagtcatatcaatgaagaatcaatgggggaggattagacacatacccacgcctgactcaggcgttcatttttggtggcctgagtccggcacccttgccggagcatagacaccgttcagggaagcaaccaaacactactacttactgctctggctagctccaggccaggcaaatactcgccagggcagcaaccaaacacgccctacaaatcacaaaatgccccaagtttctctccgcctacgaggccccaggctgccctttcccgtcctccctgcaatgcctcaagattgctggctgtaaggagggcgtgcagaccctggatttcatctcaaacctcaacttcctcacagaactacacatcgatgattgtggggaggatttgagatgcgagggtctgtggcctctcctcacccagggtcagctcagcgaattagatgtctttggaacacccagattctttgctggtttggatcccatactcggggggctgcaggacggacaagagcagcagcttcctcctcctcttcagtgttcctccaagctgcaggagctcaggacggatgacttcgcaggtgtcctcgtgaagcccatctgcttgctcctctcttcctccctcaccgaactacgccttggatggaacgacgaggtggagcgcttcatgaaggagcaagaggaggcccttcagctcctcacctctctccgggacctccaatttttgagatgcagtaagttgcagtgcctccctgcggggctacatagacttaccagcctcaagagattaaagatcatcggctgtccatccatccggtcgctgcccaagggtggcctccccagttcactgcaagaactagatgtcggatactgcaacaacgagaagctcaaacagcggtgcaggaagctaaagggaaccatcccaaaaatcatactagactaacaaaggtacaaatgcttccttgttccctctacctagtaagtcccatggcatcatctgttggggttttgatgtagtacttactacacaatctgattaaatgtttgttttttgcaatctgtcatgcagggcactgccttcaagttgtacattcctgtagccttgtagaacttcacaatctatccatgcactgttccccaacatgtggatctcatgtgatatcctctacctgtacatagatcttgtaagtaaacgttgaatggaacttgactcctgatgtaccatatccttgcctagatattcccagaaaactttttaaaacccatatataagaaacagctgtcatataggtctgatccctgtcatgaacaagttgctgcttgttgtaagcttgtctttgattaaacatgaatatatcttatgcttcaaggtagcatagtgtttttcttacgggctgtgtatttagggaatggttatggttaattagttgatgcaaactatttccattatctaaaaaatggtattacatagttgcataatcttgtaaatttacttaagcagtgagatgtcccaaatattttaattcctatcaaacagatgcactaagacgacctgtttctaatttttcctctttagtaatggatgtttccaatttttcctccgtagtaatggaagtaataagaatagatatttaaaatcatttttgagattttcttataagttgcaaatactaatttaatccacagttaatgccatttcagagttatgtggcaatcagattactcaccggtgttttggggtttgttgcgcaggtgttcttatgtgagttccagtagacttcttaatactttgggtgcatatttctggtcgtcactcctgaagactttagtggtgtttagctagttgaattggcatacattatggatcaaaataccatcatggcttattggcttaataactgtggaaaatgataagtttgcagtgttctgcaactgatattaaggtttgcatttatttttgctccagctctatatttgctaccataaaatgtgttctagcagcatttaagttcttacttaccatttcttagagaaatttaatggcatcacaataatagcatcaaatcacattagtccatcatggagtcccttcagactcaggctaatattctgctcaacatgttcctatgaagattaatatgaactgatgtacggttccaaactttcagatttagatctgattattggattgcaagacagatgtggcagaaacacatctttggaaaccaacaatgtggcagttacatgcttgaaggtataactcccatagtctcatctcgaatggtacgcagtcttgaacatttgcatttcaaatgatggcaatgcttcgatgctactgctttgagttgaccagagcattccagagcacaacataacatatgtcaggagatcttatttttcatgtttggactataaatagactaccatttgatccccctgtgttgctaattttataccattcctggaaaatgtgtatatcattttctttgctcgatctagtaaacaccgttggaaaatgttcttctcctcatctccattttctgaacattgagttatgtgattacttaatggccttctcattgctttccatgtaaaagtaatttgatttttgttctgtccactaaataaggatgccagtattcaacaagctgcccacttgcaacctcagtgttttgattacgatgaatttccagcgttttgatatttgcttttggctttaatttttgccacccatacaaggttttgagcattagtcatagctattgttgcttaacataatttaatggtgaacagggccttcacaagaataaccatcttatcatgtcagtgtatcatggagtcccttcagatttcagtctattattatgctcaataggttcttatggaaggtacttttgtaattgttttatgttccatttgcagagaagtagaaatatgaactgatatgtggttcccaaactttcagattcataagtatgacttttgaattgcttgctagttgtgcgctgtagtacgctagcacagctttgaaagtgaatagcgtggcaataaacaggcctgatagctgccatagactcaatgtgtgttcaagtgccaagtagtcctggacactatttgcacttcaaattatatgaatgctttcatgttattgaacagaccataattttccgctgcagcgttgtacaggttaggaggactacttattcatgttacaagtatcattgtattattcttatctttatatcgggttatgtggctacttaattgtttctcattgctttgcatcacaacgttcaattttgtattaggagtctttggaacacccagattctttgctggtttggatcccatactcggggggctgcaggacggacaagagcagcagctttctcctcttcagtgttcctccaagctgcaggagcttcatacggatgacttcgcaggtgtccacgtgaagcccatctgcagactcctctcttcctccctcaccaagctagtccttggatggaacgacgaggtggagcgtttcacgaaggagcaagaggaggcacttcagcttctcatctccctccaggacctccatttttggggatgcactaatctgcagtgcctccctgcggggctacatagacttaccagcctcaagagattagagatcatcggctgtccatccatccggtcgctgcccaagggtggcctccccagttcactgcaagaactagatgtcagagctagctggaacgagaagttcaaacagcggtgcaggaagctaaagggaaccatcccagaaatcatactagactaataaaggtaacaaatgcttccctgttccccatacctaagttccatggcatcatctgttgatcttgtgcaatatcctcttcctgtacatatattatgtaagtagatgtagaatggaacttcactcctgatgtaccatttccatgcatgcacaacaaacatttttaaaatccatactgaagaaagagatgccaatatgccatataggtatcccacctgtcatgaattgttgctgttgttgtacacttgcctttgattaaaaacgaatatatcttaatcttatgctttaaggttgcatggtttttcagtaccatcagtgtatttagggaatcgttatggttagttgatgtaaaccatttctgttatgtgaaaaaatgttcatggttagttgcataatcctgtaaattcacttgtgctgtaagatgttccaaacactatatcaaacagatgcactaagttgaccagtttccaatttttactctttagtagtggaattagtgagaacaggtaacttaaatcattttggagatttttttctcataagattcaaatactaatttaatccatagttaatgccatttcagagttatgttgcaatcagattactcaccattgttttgggagtttgttgtgcaggtgttcttttgtgagttccagtaggcttcttaatacttcggttgtattatattttggtcatcactcctgaagaaccagtggtgttcagctagttgcactgacatacattatggatcaaaatatcatcacggcataataatggtggaacatggtaaattccagtgctctgcaactgatattgtttttcactccagtggtacgtttgctactataaaaggtgttctaacattgtttaatttattagttaccatttcttagtgaaatttaatggcgtaccggaccgtcacaagaaaacccaatcaaatcatatcagtgcatcatggagtcccttcagactctggctagtattatgctcaacatgttctcatgaaacagtagttgtataactatttttatgttctccttgtgaaaaagtagtaatatgaactgacgtatggttccaaactttcagattcagaactacgattattggattgctagatagtgcggcagcggcacagctttggaaaccaacagtgtggcaaactggcagttacatgcttgaaggttttagttcccatactctcagtgttctcaaatggtatgcagtcttgaacatttgcatttcggaagatgggtatgcttctgtgttactgcttaggtatttagctaaccagatattccagcaaagcagaacagatttcaggagtatttatttttcatgtttgagctataaatagactactatttgatccacctgtgacgctaatttataccattcctgggagttgttaagtatgtcattttgtttccttgatggtcgatctagtaaacaccgttggaaaatgttttcctcctttagttcatgttgttttatcttaaaacttcagaacatctccaatttctgaacatgtacagtactgatatttgaagtaaaattgtgtattttttatctattttttggaaacattccaccctcttatcactggatgaatattacaaacaagggaacaaactgtacaatggcaagacaagtgaacgacacgatggtcaaaagaagagaagaaaaactagtgtgcctagcacactcttgaagcgcaattgaacctctgtaactccggtctgtcggcttcttcatattgagttgtacggttacttaattgccttctcactgatgtccatgtcaaagtaattcattttttttgttatgtccactaaatcaggatgcacagtatttaacgtgctgcccaacttcatacttgcaatctcgcttaactagtgacagaatggtaacattgtaagtgcctcactactattaatcttcttcctttacaattagatgcatactgttggaagttaatgtcaaattatattattacaatgatacttcagttctgtatatcatctccttggaatccccatgtcctcacaaaaagtgtgattggttcaggcagtcttcttctactgacagaggcatgaaaatggtactttctggtggatgcaactttatctgttcaaaatgctaatgtgtcaatggtagacgtaatttttggaccacaggttgtaaaatcagttctgaatctcctaggaccttgatgtcttggttgcagcctctgcaagctacaaatctcttcccttgtgctatcctcaatgacttgctcttcattttgttcatccatttatgcagtgaaccaaagcgccttagattagactgtttgcactctattaccgggaattgttgcagcgaacttccaaacaggtatcctaaatcattatttgacattttttctcaaagtttgcaaatactaatttgatccacagttattgtcatttcatagtaacttctcattgagattacacactattgttttggggttttttcggcaggttgtcacttatgaggaattagtagtgtttggctagtcatggcataacaactgtggaaaacaatgagtgttcagtgttttgctacttggattaaggtttgcagttctcttgctccagtgctatatttctgacacatacaaggtgtactagaatccttcattcttatagttatgttgcttaacgaaatttactggtgtacagaacactcacaagaatagccattacatcatattagttcattgtggagtcccttcagatctcaggttaatattatatggaacgcgttaatatgagaggtacgtctttagctgttttatgttctactcacgaaaaagtagtaatatgaagatatgtatggtttttaactcgagattcataactatgattgttggattgcttgatatgtatcgatatatgacccagcttttggaaccaacaatgcagtagtaatatgcttgaaggtatagctttccataatctccaaatattttaaactattttgccatcttgactcctgaacacgatttgcactttaatggatgtgaatgcttccatgtatataaaagaagaaatcgcgatgtggagggtagctgggatcttctcccaattcggcgagtaatcgttgttgtattgtctctttctccttcgtttgttcacgatgtgtctgggatctctcccggactagcgcgacattgtaatgtcgctgtaacattcctttgttttcctccccaatcttaatgaaattggtcggccaacctttggccgacccggcaaaaaagaatgcttccatgttactgcttagttattcaactgacctgcactccatagcacaccagtacaagtttgcaggagaacttatattttcattgtttgagctacaaatagattaccatttgattctcatgtgtcagttctttgtgctattcatgaaaacttccttattaagtatgccatgttctttccttcaatctagtattggaattaccattgggaaatatttttctttcccaatccaactttgttgatcttaaggcttcagaacttctacgttttctaaacatttaaattgataatgtttgaagggcattgttttttattcttcatatcaagttgtgctgttatgtatttttcttctcattgctttccatgataaactggttagatttttgaaatgtccatctcttccgaatatttacatcctgcccaactacatggaatcctcatatgagctgacaaaaggtgtattggtttaggtaaatcttctattgacaccaactacatgaaatcggtactgtccaagggatgcagcttaatctgttcaaggcgctaatgtgccaatgccagatgtaatttttgaaccacatgttgcataatatgtagtgagttcccttgttccctatgaacttaaagtcttgtttgcatcctctgcaccccaaaatcccttgcttgtggtatcgtcaatgacttgatgtgcattctgttcatcccttatgcaggga

SEQ ID NO: 39821 - DNA, 9590 bp, Oryza sativa
agcagtgctacttatccggctcgaatgttataaaaccagccccgaaatcgacatcggtagctaaacgcggaagaaaacgccatagaagatccaaaacgatgacgacaccgagacatgatatttggtaacggagttcagccgtagcctacatctccggggcactgattacgggcgctcctccccgatccagcatatacaacgtatcagagttacaacgactcacggccggtcgacgtcggcaaccgctccctctcgctatgctaagtcgccatgcggttacaacaggcacgcccctctatttatgagagatcctaggataaaatccgactcatactctagtcctacacttagtacaactccaagtcctaaactgtaaccgactacgtacacatattcgacacaaactctaacaaactccaccttggcgaatatgccacgccaacctgaattcattacttgctcgaacctccatgtaccaagacttgagttgatcctttttcgccgctcacaccgagctaccccaataagcctccaccaggctcaccgtaacaagagactctgctatccctgtaacttcctcctcttgactccacctgcaacagtgctccaccttctctcatatcaccacagtcgtcttgccaagcgaaattgaattccttcctagctgtcatatcatagactccccgaaaaccaagttcaacttcatctaccgtcttaaatttgacttgatctaatccatggcccgttaactgacgtcatcaccaaatagataaatcaaactcaccagacttgaatagaaccttttcttccttatcgtcttatgaacaaagctagcaaatccaacatccacgctttaccgcatctgtagactgaattcctgataatctgagaaaattcacggttgccttgaatcacccgaagaaattaccaccatagcgattgctcttctccttcagtgacgcagtttccatatatcgccatcatgcaatccacgcagatcctggatatatcctgtcacgccccgaactagtcccgaccggaactagcccgtgacgctccaaattaacctgttgatcgataccagtcccaggaaacagtgctggtatcacaggaagacagaatatcacagcaacagaggtctctttattatagagtagaagtacagtcatgttgggctgcggacagatcccgagctcacaactgcattacaaaagggaaacggaagccaagacttggaccaaacaacacaggcgcgacttgggaactaggccgaaaccctaaaactcatcgtagctggcttgctcctggaagaactcctcatcagcaggatccgcttcatcttcttcagcaactgagggggggattatttatatagagcaagggtgagtacgggagtactcagcaagccatgggaaataagtgtttaatgctggcttcaaggaaaggctgttgttttgcaattgattttatttgaactcttttctgaaacaactaagtgagtgcttctcaaacgacacggttgagacagtgcgtttcgtccggtcggagtatgtgcaatgtatcaatctttaaaatagatcaagattggcacccggccaacagctttcaaacggccacccgggccaacaactttcaaacggtcacccgggcctagctgatcccatcagctgcagatttttcaaacatcgatctcctttccacaacagcaatttcacaagcagtagtcaaacaaaactacactaggaatcacctcacatccgcccatgaccgtgggcacggctgttcgaacagttagttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccaacaccaccccggcgaatccacatgtctctcggcatcaaggctcccctgataagctagttactcagccaggggtgtcccattccacccatgtggtcgtacttgtcttatgttcggatgaaattccaagggaacggtccttaagtgcaagagcgggaaaccgtacacccggtacgttccccggtccgcggttttggaaattcatttagttcgcaagcaccgaccccaggtgtcgggttttccaagccttttgtaaaacccaagttttacccaagatgtttatcatattttaagtttgaaggcgaccgtcgatactcgcacagagtgcacgaataccgaagcgtgactgggtggctataagggaacatggtataacaattaacaaaggaaggatcagatgcaacaaattaggtaggtctgccaatctgccttgcagacgggacaagcagatcaagtgcgatcctatcaatgcataatatttttcaagcaacataattaaattcaaatataggctcaagatgttcaaaggtggcttgccttgctcgagatcttgagcttgatcctcgaaatcctcgcactgcgggtcttcgggctccaaaactacgcgcaaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggagggaaattagacttccctcgggcggctagggcgcggcccgagagaaaaggggcggcttggccgagctaaatgggccggccggcccaaggcggcccaaggcacgcgcgcgcgggaggggaggagagagagggccggtggaccgggtccatcccgcgtggtcccgggtgggacccgcttgtcaacgactcggctcaccgtgcggagggagcacgcggcgtggcgctaggatgggggaaagacgcggtgcacgcgtgcggttcgcggaggacgcggatgcggcgggcccacgcgcagcctcacggctcgcggtggaccatgcgcacgggggaaaacggagggagcggctgccggtcgcggccgaggtggcgccgacgtggcgcctacgtggcagccatgcgggccggcgggaggtagacgacgacgccggccggaacggacggcggacgacagcggcgagcggcggagcgaaccacggcgatacaggcaaaagcgagcacaccgggtggttgcacgagacgaggggagacgagccaacggctcggattcgccggagggagcttgacggcggcgaattgcggcggcggcaaccggcggcgagggaaggggaaacggcgacgaggtcacgaggggccgattcctggcggcgagagcatctacggggctacgggaatccgtcccttgcgccggattgggcggagctgcgccgagcgaggccggcgacgagcggcgcttccgagctcgggcggcgacggcggtgagcacacggcgagcggcggcaacggtcggggcggcgccggctagctacggggaggctactcgtgctactacccgagtctaaggggaggagatggagcgaggaggagaacggggagatgcactaccatgcgggacgaggcgcagtgacgagaggccaacggcgcgggagtaatctctccggcctcgggccggggaagagaaaggagagggcgcgcccgaagtccccttctgcgtccacgaacgcaccggctctcccggtgcttggcgatgaacggcggaggcgggacagagcacggaaggcggcggcaaaggcgcggtggcggcaagcgaaacggggggggggaatcgatgggagggcgccttggtttataggacgacgatgtcggtttggaaaccgaccttgggcggtcaaggcgcgagctggagctcagcgctcgcggccaaaacggtgacagaggcggatgacgccggcggggaggggaaaaggaaaagagggagagaaaagagggcttgcctccttgccgcttcgggaaaaggaggagggagcggaagcgacgcggcagatggaggaggagctttgcctccgtcccttggcagcttgcgcgcggagtggcgggggccgggcgatgacgacggcgatgacggcggggcggtttggagcggcgcgacgacacgggcgacatgcgcgggcaggcgcggcagagcgtgacggcggcggcgaccaggcggtcggccaccacggcacgcgcgcgcgggaagcaacgggcggcgcgacgatttgagcggcgcggctcgggcacgcgtgctggctcgcggggccgagcggctgcgcggctgcaggcgcggcagggcagcggggccgggtgacgcggacggcgcaggcgcggcatgggcggcaaccacgcgggcgcgcgcgcgaacaacgccgcgcggggccgatttcgcgggcagggagctcgccagggatggaggcggggagaaggagagcgaggggaagggagggcgctcggcgcgagcggctcacgcgcacgcgcgcgggcagagcggagggggagagcgcgagagagagagagggcgccggggagggagggggagatgagccgagaaagattcggcccatcgaccccgggggaggcaaaatagacttttgcggagggatcgatttgggaaggattgggttcgggattgaactcgacgatagatcagggattgagatctgagatggcacggacactaggcaacaagcaaagaaacagatttcgcaaatagagtttttaagagatagttttcctgctaggcgccacgacagaacgggcgctacatatcctgtactgccaaacagcccgttgacgccctcaacgattttcacccgctgttgcccgggagttttcaccagctcaagactgtctttactaagtcataccaaaacttaacacgtcactttcttgctgcatgcatcaatttccttctttgcatatgccattgctcacaagatccaagcatgtgcactggacatacacgtgtccatccctcacatgtccaccaatcttgtaccgaccaaatcaatgcacgaatgaattaacgttccatgcagctcatagcctcttcacgtgcaaagccacagcagactcaaccatcaacagcctaaccagcggaccgaccggtctttttcttaaaaaaaatcgttttttttttctctcgattaagacccagtcaacacacaaggaccagaacgatcccggcccttgtcgctccttctgctcgcctcatcctcggctcaagcgcgccgccacccagcgcctaaagacgcttcgctaccgccgctcctccctgctgactgcgagcaccagagccgccgcgcctcacctctcctccgcgccgccaccaaagatgccgcttcggttcccgacgccgctgcccgtctagaagatgctgccacgcacaggagctggtctccccttgcgccacctccctgggaccaccgccgatgaaaacgccgctaccgctgccgccgtgggtttcccgctggtgaggatgccgacgcccacggagccgccccccgacgcaggagcagcccaccccttccgccggtatccgccacctcctcctggagctggcccgcgtcgaactcgccggcacctgcacgacaactacaccaagccgtgctcctaccgctcgcagttcgtcgcctaaaccaccactgcccaagaaatcatgtccgatctcttcattgctttggttggtttgatcccgtggctctcctttgctgattttgcttggaaaatatgagtccgatccgtgtccagtacggaatcctcttcgttttcccttcctgtgtccgacatggtgtcctccttgactcttctccgctgccacaatcacgaccaaaatagaaacagactacgtgcccgagtccatgtcctatgttgcagcccttccagatctgagtcctgcacgaacacggcttttcccaagccagctaccaacaacaccgctctagtctgcacctccggctcggcctcaacgtgaaatcacgcacaccgccgtggtcctgatctccacgagcttcacgtactcccaccacaaatttcactgttgtccaacacctccagtcaattccatcgacaacaaacgacatcgatctgacttgtgcctataacagtaccaaggatccacccgctctgacttccgattgaacaccatcaatctagtcgagagccgaagccgacaagtcgcataccgtcttcccaaccaccgaacgacccgagtgccacgtctagccatctccccgtcgaacgcagctcatcgaaaggcccgagccaccctgcccagagtgtttgattccgccgatcgagaacgccgatcgcctccagcttcaatcaacccccgtgaggcctcacatctccctgttgaaagtagctcaccagaaagttcgagccacccgcctgaagtgtccgacccaccgattgaatcgccaatcgcttccgccgccatcaacctgagcaccacgtctggtcatctccctgttgattgcagccatcaaacggttcagaccgccgcctgaagtgtccgattccaccgatcaaatttcgttgatcgccgccgtgctccaccttgcgtccatgtccgtccctggacatcctgtgtagttgtcgcggcgtggagcacctccctcgcacctctaccatggatctcctgcaggctctgataccacttgttataaaaccagccccaaaatcgacatcggtagctaaacgcggaagaaaacgccatagaagatccaaaacgatgacgacactgagacatgatatttggtaacggagttcagccgtagcctacatctccggggcactgattacgggcgctcctccccgatccagcatatacaacgtatcagagttacaacgactcacggccggtcgacgtcggcaaccgctccctctcgctatgctaagtcgccatgcagttacaacaggcacgtccctctatttatgagagatcctaggataaagtccgactcatactctagtcctacacctagtacaactccaagtcctaaactcatattcgacacaaactctaacataggaagtttttcatgccagttagattcatgtcgagttcatactgaagttgaagccatccttaagaatccatggcatgattcctgtacactgaagtgatcagtctcagatgaaccatgggttcttgttttgcttcttgccattcttcttctcacatttccttttgtaatagttttccaagatttttctctcaaaaagtagaacagagtataatgacttctcacttgagcacccattttcactgcattcaaacatgtacaagtattctttatgttctttcgataatgggaaaagttatctgtcagccgttctaagtattcttttctgtaataaagtaatatctgaatcagctcttgaatgtaactaaacattattagttgcttgtgcttcatatatgaataaaaaggttccaaacgttgattaactacctcttgaaataatcatccttgtcttcaaaacttagcagtctcattgactatatctgatctgattccagcataacttagcagtcccatttcatcgttggaggtagttttgcattatttaggctttagaaatttggaccgttaacaataatcgcgatcccagattcccagcctccatctacacttgtactgatagcatctccatgacaatcattttcataagaggaaaggccaaatggccctacttttctttctttacatactacttcaaccgctggggaaaccagcttgacatatacttcatccccagtacagcaaggaaaaaactactgactaacagtaacaccacctaccaaaaggaaagctgaaaacagagccaagatgataatcatatgtggactactgattcaacttggagctttcgcacagtcaaaaatgtcagtaataagaattacattccctgcagggctcctgaaccttcaacttaacggatgagggggcctcttcctcaatgcatcttctaacagcctcatgagctttatgggcttctatgagagcttctttgctcatacgcagacatttgccaattttcagaaggtaaccaccataaaatttggctgtatccagtgcaatgcactcaagtgacagtaggtaaaagtctggcttgtgacacaatgctaataaactgtggcaggcggcagtagtggagcgtttagcaatgacatggtaaacttatacatgaacggatgaaccaaacaactgaaacaagtgcgggtttctgttatattatacatttatactccatacaactctggccacaaatttatgttatattatacatttataattacaaactatataaagttaaattacttgtcttggcacttaaacacatccttttcacagaaagtagcgaaatcactaaatttcggcgatatactgctacacaaccaattttatctcacagtttctccttcccaaaaagacggtatcttgagatctaccgttttgtttcaatacccaatatgacatttcctgcagggttccagaaacttatactcaacatgcgccggtactttccccgcgatgtatcttttggctgcatcaaaagctttccgtgcttccaagattcctcctttcctcataggcaagcattcacccatcgtcaaaaggttcttatcatagaagttggctgtatccagcgtaatgcacttaagcgatggtgcattctcaagaatgtgacttgttagctcaatcatgctctttgtagagttaaagccagtgattgtcacattctggaggttggcatgtctggggtgcagaatttgcctcaaatttgtatgttctccatcaagaatcgaatcacgcctttcacatcgctgctttacctgcaaaggataatagttgctcagtaaaccttggtcatatcctcctcagcaagtgcgatcactagtgatgaatatataagcttaaaacaatttatcatgataagcccacactgaattggtgctgttggcttctagtgcaataatacccatgaagcaccacagggcttttctaattggttgccttagtgcgtatttaagtgctaaactgctgattcagcccctatctataatctgttgagagaaaccatatgaagaataactacagcaaactaaaccaatttatcctgccaaatttgcagaagtccccaaactacaagcatcaactgaatttttatgccaaagtgacatacatgcaagatgaaagtctccaaggcaggggaaccatccaagaaagaaaccagagaaaagaaatcatagttgggaggaaaagccagtaattcagcaagataaatttccaataacttgaggtggaggaacttgatgggcaccattggtgtactgatcatctgaaagaaaagaagagatgacttaagattaatcatatgtttcatgtgcacctatgacatgcatatgaccagcctgtaattaat

SEQ ID NO: 39822 - DNA, 13670 bp, Oryza sativa
catctatcgaatcacctctagcatttcacaatttgtcacctggaggtacgggagctgctgcatcaggcaaggacctaaactggattatgtcattgcaatcagaaattaccaatctctccaaagcgaatgaattggaaaggaactgccctatctcctccccagaaatatgaacttcatataaatgtaagcttgtcaagcttatgttgcaacctagagccactgtaggatgaaaagaacaagaggagaggaaaagtgactgaattgtccctccacctgccttacttgatagaatggaacatgggaagttgtattctgtcctttttttgcataaagacatctccaaggagagttctttgatcccagctttgataacatgtacaaaccatttgtcaagaacagctgcatctatgttcggacaggcaaacagttgaagtttaaacactttgaccccaatgccagagtggttattaataatatggtcaattttactgatggcatagctttccatgtcatccactttaagcgctggctcatacaatggcacatcttccgcatacaaactaagttttctcttagccaaacctattgttttgctatttaatacaaggattggatagcgtctccagcaacgtagaaatccatgcgacacacaagcagcacgagcggcatctttcaatggcattagagaatatacatgatgcaagatatcctggaaaaaaacatgtttgaataattcagcattcagagagtactagcaatgcacacttcacttagaacaaacagaaggaccagctgcttagtaaaatatacttaaattgttactagtggacagtggccaacaggtcaagtgctttttcttaaatttccctatatgcggtaccaaaagacttataagtggatatacatttttctcattgggacatttaaccaaacttcataacacacggtactccttagtccttatatgtcatcaatccacaaaaaatagcatcacaggtcatcttcatgataggtaaagctcatatcgggagataacaaattagctaatgctacagaagtaatctggtaatagttaattgttctgctagtagttttgaaaagaccacaacaatgataattttggagcatggagtagtagacaatgtgcagagaaagccaaacattaaaaagtaacagtgcattcgaattcaatttatgcacaacattctgaaacctcattgagatagtttgctaaaacattgttgtttaacaccgattcctacaatctaccccttgagaaaaaaaatattacaatccaagcacaccaaaacatagcagtttcaatgatactgtagtagttaacagactatgacattattagcaatccatacctccggaagtttatcgagcgggagttctggcattatgcccgcataaatatcatcttgctgccgtggagcgtaaattatctttgaagatgtgtccaatttgtctagagatagagatagaaacaaaaggttagagaatgaatttgctaatgcaattcaaggcttacagacaagaaccactaatttgcataaaccaaaataaggtgaagatttgagcactagaccagataagagttaaaaattcccctgtctaaattgcactttattataagctagctgaagaaccaatcaggttaaggaggagcctaagagcagtttttcttctaaaacataatccctccgtattttttaatgtatgacgctgttaactttttgaccaacgtttgaccattcgttttattcaaaatttttgtacaaatataaaaatatttatgtcatgcttaaagaacatttgatgatgaatcaagtcacaataaaataaataataattacataatttttttaaataagacgaatggtcaaacgttggataaaaagtcaactgcgtcatacattaaaatattaaaatatggaggtagtaataagtatgcaataaacgatagcggtagaatccaacgacgatctctgtataggaaggtggatcgaaagctgagggggcgggggaagcatatacttgtttgaagctcacggaggagctgcatcgtcctgcactcggtggcacgggtctccatggctccgcccggccgcttccgattcccccttgcagtctacatactccagacgccagccaggaaaggcgatccggacgtcgccggcgcgcgagattacctcaaacggcggcgaatccggccgcctcttgtactgctgagaatgaaaatcccggggggcgctccacacggcggcaaccgagatcggcggcgctgcctgcctgcctgcctcgagagccgtcggcggcggagctcgtgtgggaactcgagagggcgcgggcgcgggccggggtggactgtggagctccccggcgctacatgcggcgcagtccaccgcagtggagcgtggagaaccgcggcgatgggaaggggatgatgaaggaagttggtgaggacacctcagactcacagttcgatggctactttctcagttactcccccgtttcaaaacgtaagtcatttatttttcatatttatagtaatactaataaatctaaataaaattaatatttttttatctagattaattagtatcaatataaatatggaaaatgctagaatggcttacattgtgaaacagagaaagtacatttgttacaaaataaatttatttttattttctttacttaatgtttggttcttcgttttatttgaaaattttattaaaaaaatagttacagaagtatttatatgttatcatccaataaaaataaaataataataatattttagaacgaaagtaataatagaataaaagaatgaaataacatcacaattctcgactaccaaaataactttgaatacttattggacgagtttaaactttactttcaaactataactttcttgttttaaagtttccaacagcacattttcaaaccgttatataatatgttctgtgcaaaaattttctatttaaaatctatgatataaccagaatgcaatgtgggccttgcttttcaatgggctctctattcggcccagtaactcactcgtcagagacgaactcagcgatacgacggtcgacggccatggctttgtcgaagctttgcgattgcaaccagcgatgagcgatggcagctactctgtaatctgtatgacctttagtcactaatttcatttcttttatgttatactaataaaaccagataaagctactgcttttgacactaaactaaaaacaattctagcacaaaaatattgctcttggcttctgaatgcaagaatgtcccccaaaataccatacttgttctttacttggttgtgctgtactgctgtgcatttttacatttctacattcgatttttcttttttgcgaacaagcaaaaaggattgagcgtcaatatagatttctacacttgaatttctcctctgaagaaacgctatctggacttcttgagatgtattgtgtcagtacccaaaatgacaatgcctgcagggttccagaaacttatactcgacaaaggagggtattttccccgcgatgtgtcttctggctgcctcgaaagctcttcgtgcttccaagatccctcctctcatcataggagagcattcgcccatcgccaaatggttcttgccagagaagttggctgtatccagcgtaatgcacttgagcgatggtgcattctcaagaatgtgagttgttagctcaatcatgctctttgtagaattgaagccggtgatcgtcacattctggaggttggcatgtccgtcgtgcagaattcgcctcaaatccgtaggttctccatcaagaatcgaatcatgcctttcgaactgctgctctacctgcataggaatagtagtagttactcattaaaacttggtcacatactcctcatcaagtacagtcactaataatgattatagaagcttaaaatattttatcatgagaaaagcccaaactgaattgctgctgttggcttgtgaagcaccacagatgttctctatttggttgtcttactagtgcgtatttaagtactaaactatttctactatctattatatattgtgagaaactatattaaaaatatctacaacgaactataccgaattaattatcctgccaaatttgctaagagtagaagcccccaaaggcccaaactgcaagcattaactgaacttttatgatttgcggtatgcaacattgagaaagtggcatacgtgcaagatgaaagtctccaaggcaggggaagcatccaagaaagaaaccagagaaaagaaatcatagctgggaagtgaggcaaataattctttaagataaatctccaagaacttgaggtggaggaacttgctgggcaccactggcgtactggtcatctgaaagagaagaagaagagatgcctcaggaattttagtcgtgtttcatgtgcacgtgtgacatgcatatcaccagcatgtaattaattgtagttataaagcaactggatggcacaaagaaaacaataatgcatacctcattaggagatgacacgacaagtgattcaatatttggcaaaatggatggaagcttggtacgagcataacagacggtgtcggcttcattgtaacccatcagacgtatgtccttgacctgcagtggatctccaagagagattttaactccaacatccccatagataaaagtggagagtttgggagcatctatctctatcacttgtagcatttgacattttgtaacctcgaggtacttgagctgttgcatcaggcaaggtaccttaaactggactatatcactgcattcagaaattaccaatcgctccaaagagaatgaattggaaaggaactgccctaactcctccccacaaatatcgactttacatagatgcaagcttgtcaagcttatgttgcaaccaagagtcaccgtaggatgaaaagcacaggaggagaggaaaagtgactgaattgtccatccctctgccttattggatagaacggaacatgggaagttgtattctgtccgttttttcaatgaaagacatctccaaggagagttcttcgatcccaggtttgataacggttacaaaccatttgtcaagaacagctgcacttatattcggacaggcgaacagttgaagtttaagcactttcaccccaatgccagaatggctcttaataatatggtcaattttactgacagcatagctttccatgtcatccaaactgagttttctcttaatcaaacctatcgttttgttatttaatataaggattggatagcgtctccagcaacgtagaaatccatgtgacacacaagcagcacgagcagcatctttcaatggcataagagaatatacatgatgcaagatgtcctggaaaaaaacatgtttgagatacaaaatcaacactcatcaggacatttaaccaaacttggaacagatagaagaaccagctgcttagtatctatatttaaactgtactagtggatagtggccactactaaatacgaaccaaatggttaattgccatttggctactaaacaccaactctggtgattttatataaagagtactagaatccactatcaacatcgggcattattgtgatcattttgtgctatatgctacaactagggccctttgaatcactgcacctaaccataccagctaggtggacacctagtgctccttaaattgcattgttatgatcaaaaggagaatccataagtttctgtgccaagaacaagcgagacaaagaaattgtatttaatcaaacaaaaaaaatttgtgtatgtcaataacttggacacacttctcacatacacaactaacttttacaatctcttatccattaccatgtgtgaatttgccccaaaaagccatgcacttgttacttgttagtggcaaatatgagaggttgcaaaaattatggtacatatgaaaagtgtgcattcactaatctctactattgggtagtggcataagcatttttttctccttttcattatgatatcctagtgagtgtagttttgtgatttttcctctagaagcttcacttcatttcctttctcatctactatacatatacattggtggaatgggccctattggcgtgaaatacacacgcctacactcaacactccccctcaagatgggcgataaatatctatcatgcccatcttgctacacgaagaagtgcactctctagcacctaatgccttcgttaaactatcagctacttgttcaccagagtttacaaagcctaagtttaaggttccctcatccattctctctttaataaagaagcgatctatttccacatgcttcgttcgatcatgctggactggattgttagcaatatttatggctgatttgttgtcacaccacaacttcatggaagtgcttgtcgacagcttcaattcagccaaaagatttttcaaccataacaattcactcaagctcatcgacattgacctgtattccgcctcagcagtcgagcgagacacaactgattgtttcttgctcctccaagataccaaattgccaccaataaatacacagtagcctgatgttgacctcatatcatcaagacaactgccccaatctgcatcacaatatccctccacatctaggtgtccattcttcttgaaccatatgcctttacctgggcttgccttcaaatatctcaaaattctatacacaacatccatgtgaccacttctaggatcatgcatgtatcggctcaccacactcacagcataagttatatcaggtcttgtgtgacacaaatatatcaaccttcccacaagtctttgatatctctctttattaactggatctccagattcagcacataacttatgattttgttcaattggtgtagaagctggccgacatccaagcatacctgtatcactgagcagatccaatacatactttcgctgtgaaagaactattcctcaaggagatcttgcaatttcaatacccaaaaaatattttaattggcccagatctttgacctcaaactccttgcttagattttgtttcaacctagatatctccaagcaatcatctccagtgataatcatgtcatcaacatacacaacaagaatagttttaagacctctattatggcgatagaaaactgtgtggtctccattgcactgtttataacccataccacacattgcacgtctaaagcgatcaaaccatgctcttggtgattgtttaaggccatataaagattttttcagtctcaacactttaccttcagtttgtgaggtagcaaatccaggtggaatttccatatacacctcctcttgaagatctccatgtaagaatgcattcttgacatctaactgatgcaatggccaatcaaaattagctgcacaagagataagagttcttaccgtgctcatctttgctactggtgcaaaagtttcatcataatcaattccatatgtttgactatatcccttagccacaagccttgccttgtatctttccacatttccatcaggattttgctttactgtataaacccatttacagttaaccactttcttccctttagggaatggtacaaggtcccatgttttgttcttttcaagagcctctagctcctctagcatagcttgatgccaccttgggtcttgctttttttccctccaatcatttggaatttccactgaatttagtgatgtcacaaaggccttatatgtggatgacaaagaagcataagagacataattggctatgttattctcatcatcattcacaccttgagcttcaaaaccatacttttggggagggttacctgcattcttcttaccccctttcttatagcaataggaagattagtttcttctccccctgtttcaaactcctctccttccgtatccgatgaaatctgtatagtatcacactgatcagatggtttatcacctacttcagcaacaattgaagattgttgctgctcctcccatccataggagactcatgttgccctattgtttgcgcctccaaagaccttgttttcctcctagtataaacttgtagattttcttcttcacatgggcttctccaattttgctcatgaatgggttcactaacaggatatgggattgagccaaccacaaatttcatgcttcttgattatgtgtcttcttcagtacctgatgatccattctccccctcttgtccatcctcatcaataattggattgtcaagatcaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcattcttcccaaacaccatttcatatggagtcttcatcccaagtattcgtgatggcatgcgattgatgagatatgttgctgtcatgactgcctcactccatagaaactttggtacattcatcgtatacatgagtgaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatccagataccacaacccattatgcctaacgccggttccaagctttcttccagttcttctctcctcaattagacaattctctcggtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtacacagtttcttccccaaatcagaacaacagcaacagcaaaccaagcttccacttcacctccaaatcctcaccttctcaagtagcagcagcaccagcaacagcaccaccaaagtcaccaccactggaacggacaacaatagccaatagcaccaaatccttctctgttgatcctacatccaacagctgcgcgtctctcagccgctgtgctccctacagcttgtgctgcaccaaatccttgcgcagctcaaccagcgagcgtgcgccctgctcctccttcacgctgctcgcgtcgagaacctctgcagcagccgtcgccgcctccgccgtcgacactgccgctccgcctccgctgtccgacgtcgccgctccgcctcagctgtcgacgtcgccgcagaaccgctctggtcacagcgccgccgccgactagggttcgcgtcggcgaggtcgccggtgacccagctctgataccatgtagttttgtgatttttcctctagaagcttcacttcatttcctttctcatctactatacatatacattggtggaatgggccctattgggctgaaatacacacgcctacactcaacagtgagtattaatgaatcaacatgagcaaaccacatggctgcacaggaagatcagtaatagttcacccaactcagataagacgatgactagtttaaatcaaccggataaaaggatgtgtggtgcaaagaaatgcagtttgttctgctagtagtactgtaaaggttgtaacaatgataattcaggatcattgagtggtagatagtttgcccaaacattgttgatttgttgtttaaatatgtgttcaccaccaaattcctacaatcaatccctcgaggaaaaataaatcctacgatccaagcacacgaagacatagaagtttcaacgatagtaatcaaaacattcttagcaatccatacctctggaagtttatcgagcgggagttctcgcattatgccagtagaaatatcacctcgtcgcggtggtgcgtcaattatttttgcagatgtgcccaattcgtctggagataaaaaccaactattagattccgaatttgataatgtaattcagacaagaactgctaatttgaacaaaccaaaataaaggttaatttttccacgaacgcacaaaaggattgcacgtcaatatattagaagaatagagtttttgttacacgacgcactcagccagatcggcctatgccaaggaaggaagaaaaacaaagataaaaaaaacaaggaaggaaaggaaaaaagaactcgatacaacggtaactctactccaaacagcgggagagggcagagccactctacgctcccaacaattccccaaaggaagcgacggccgctaacgaccacagccggccctccgaaaggatggactctagaaccactaagaccgaagagagcacagagtcaaagaccctggagttacgttaaaataaagagtaaatttcacaaaactacacgttttgtggtccaagttgcagaaaactacacacactttgacatttggcacttaagtacatatattttgatagtgtagtttcacaaaactacactatcaatgaatgaattcacacgcgagatgatgtggctgttccacctaggacaaggacgtggcatcgtgggacaagctggacttctatgcgcatggcccactaaaactgctgcaactaaatatacgcacatatgtgccttccaatctgtcacgccccgaactagccccgaccggaactagcccgtgacgctccaaattaacctgttaatcgataccagtcccaggatacagtgctggtatcacaggaagacagaatatcacagcaacagaggtctctttattatagagtagaggtacagtcatgttgggctgcgaacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcaggatccgcttagctgatcccatcagctgcagatttttcaaacatcgaactcctttccccaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagccggtggggatcagccacgtcgggagacctccaagctttcatgacaaggtatttccaaagctgacacaggtttcccatatgccgtcgagaggggtcccagaccaccaacaggttaggtcccagaccatactgtgccagaaagcccaggggtcctccccgacaccaccccggcgaatccacatgtctctcggcatcaaggcacccctgataagctagttactcagccaggggtgtcccattccacccatatggtcgtacttgtcttatgtttggatgaaattccaaggaaacggtccttaagtgcaagaacgggaaaccgtacacccggtatgttccccggtccgcggttttggaaattcatttagttcgcaagcaccgacccaggtgtcgggttttccaagtcttttgcaaaacccaagtttttacccaagttgttactcagattttaagtttgaaggcgtccgtcgatactcgcgcagggtgcacgaatatcgagacgcaactagatggttacaaggggacatggtatcgcaattaacaaagggaggatcaaatgcaacaaaattaggtaggtccgccaatctgccttgcagacgggacaagcagatcaagtgcgatcctatcaatgcataatattttgcaagcaatataattaaatttcaaatataggctcaagatgttcaaaggtggcttgccttgctcgagatctgaagcttgatcctcgaaatcctcgcactgcgggtcttcgggctccgaaactacacgcgaaacgggacaactcaacaaacggcgaaaataaagccctattaatgacctctaagcgtgccattagatagatctcgagttttgaggaattttggaagttgaacggtgtcaaacggatttacggatgggaagatattgaatttctaagattattggatttttggtctaaaggaaaaggatttaattaaatcctttttggaaaagaaaaagaaaagaaaagaaaagagggagggattatagacttttctcgggcggctagggcgcggcccgagagaaaaggggcggctcggccgagcttaacgggccggccggcccaagaaggcggcccagaacggcccaagacgcgcgcgcgcgggagggaggagagagagagccggtggaccgggctcaccacgcgcggtctcaggtgggacccgcttgtcagcggcttggctcaccgtgcggagggagcacgcgacgcggcgctagggtggggggaaggactcggtgcacgcgcgcggttcgcggtggacgcgggtgcgggggggcccacgcgcagcctcacggctcgcggtggaacgcgcgcacgggaaggggctgaccggggtcggcccgtcccgacctcggctgagctggtgccgacgtggcgcctacgtggctcccacgcgggccggcgggaggtagacgacgacgccggccggaacggacggtggtcgacagcggcgagccgccgagcgaaccacggggataccagcaaagcgagcacaccgggtggttgcacgagacgaggggaga

SEQ ID NO: 39823 - DNA, 18409 bp, Oryza sativa
agaggaagggagggcgcctgggtttaaagggggcggcaatgtcggtttggaaaccgactttgggcggtcaaggcgcgagctggcgctcggcgcttgcggccaaaacggcgacagaggcggatgacgccggcgaggaagaggaaaaggaaaaagagggagagaaagggggcttgccccttgccgctttgggaaaaagggaggagggagcgggagcgtcgcggcagagggaggagggctcggcctccgtcccttggcggcttgcgcgcggagtggcggggccgaggcgatgacgacggcgatgacggcggggcggtttggagcggcgcgacgacacgggcgacaggcgcgggctggcgcggtagagggtgacggcggcggcgaccaggcggtcggccactcggcacgcgcgcgcgggatacaacgggcggcgcggctgggcacgcgcgctggctcgccgggccgagcggctgcgcggctgtgggcgcggcagggtagcgggaccgggcgacgcggacggcgcagacgacacggctcgggcggggaaccacgcgggcgcgcgcgcgaacaacggcgcgcgggggccgtcttcgcgagcggggagctcgccagggatggggagaaggagagcaaggagaaggggcgctcggcgcgggcgactcacgcgcacgcgcgcgcggcgcgcgggcggagcggagggggagcggggagagggagagagagagggagagccggggagggagggagagatgggccgagcgggattcggcccatcgaccccgggggaggcaaattagacttttgcggaggaatttgatttggagggatttggatttggaattgaactcgacgatagatcggggattgagatcttgagatggcacggacactagacaacaagcgaagaaacaaatttcgcaattagggtttttcagagataattttcccgctaggcgccacgacggaacgggcgctacacaatcccagcacgatatgttaccaaggattttattctgtgacttgttttctggtcagtgatcacctttctatatggttgttttgagtttattgttcttgcactatttgttgagctggttattaagaatacttgttgatcaaactagatgtgtgaacatgtctaatggagcattataccatttttatttcatttcaaagttccatgagtttaggtctgtattgtgcttaccacaactgaaggttgtgcttggtttaggagcactttcctgcagacatgaaaggagccacctactactatctacagccaaactactgtgcttctcttgtcaagttccagtactacaagctgaatggaacaatcaattaactcaaggggttatagccacaaacttcagactcagtgatcctttccactgaagcgtaatttatctacctgaaattaagtacaatagtggactgactgtaaaatttagaatactagttccctgtcctccccttatagctcccatgttttgtactactttcatttcagaggcattagaaacctccatatttgatgaattaactgttttttttaacaaaatcaatcaacagtgaggcaaaaaactacaaacctatgtgaaatttcagttggaacttgctcattcacactagattttttagaaaactcactatgaaatgggcacctgattgattccttggaccaaaaaaaaagaaccaaactatacctgttagtagcagaatggcagagccaccatagtactggaatgagacacaaggggccgcagtactcgaagaggcatgtagccagcgagttgcctgctaactccagatctcgagcatagcatgtattggagagagatgaccagaggatggtgaggggccgccgggagagatgatgaggcctagcgaggaacctcgtggcgcggcggcgaggggatagcagtgagaggaaaggcgctggcttgtggctgacatgacgacgagatgcaggccgaaggcggtgagagctacacgatattgttcggtggtcgtcgatgggcggaaatatggaacggccgtccgcgccggcgctgacaagcataggaggtcatgcaaaaaattaatagcataggatgccacgtcctcgtttaggtggaacagccatgtcatctcacggtggatttattcattgatagtgtggttttataaaacaacactaccgaaatatatgtacttaaatgccaagtatcaaagtgtgtagttttctgcaacatagaccacaaaacgtatagttttgtgaaatttactctaaaataaagttaatatttgagcttagaccagacgagagttaacaattgccttctgtttagatagcaccttaagaaaaaaaaagtgtagtttaggtgaagaaccaaccaggttattaaaaaaaaagagttgtttttttttcaaccgccgcccctccattaaaaaggcgtctcacccagaaaaaaaaaggaacagattttttttcttcagacatatgaaatgaaccctagaaacagcggaatcaacaatctctgtataggaattagatcaaagacttgaggacggggaagcatacttatttgaagttcatggagaagctgcatcgtcctgcacttgatggcacgagtctccatggttccacccgatctcttccgcttgccgttcatatactccaccggcaaaaaaaaaaatgcctcttgtagtgttgagaatcaaaatccagaggcgctctgtttgattctcttcttctcttgcctcccgagttcagattttgaaggagttagcggttaatttggcatcctgcgttcgaatcggaaaccgactcgagagacggagcaatcgggagaggcaaaactgaaaaaaaagaaggcgaaaaatatcaacatggaaaacgaataagaaactataggccgaaataattaaatcgaaaaaaaactgattagggaacaaaaagaaaatcacctacctgtagcccgccttggcatccgagatcggcggcgccggagctcggttctgcgctcgtcaggggatgctcgttgtccggtggataacgacggcgagcggcggcgaggcaatgaggggaggtgggagtgggactgtgggagggacagacacctctccctgctgaatttttcacattttgatccttttagaaaaaaatattttataaatagatctcaaaaagttttttaaagatgaaaaagtttttttaaggaccaaaaagagaataagggtatgtttggtttcctaccatactaaaatattggtactaccaaattttttgtgctattggtatattttgatagtaaatcaaacattaataaaggcctgttcactttgataccaaaaaaaccttaccaaattttggcaatgccaaaaatttggtatagttgctaaaattttggcatgatttcttatatagttacaaaaatttggcagcaaactaaatgtagccacttttttgacaattttatcaaaacttggtaatattgaaaatgtcatcaaagtgaagaggcctaaaaatatactattcaaagtgccaaacaatttgatagcacatattttagcttcaaaccaaaatggccttaagtttttctaaaagaccaaaagtttttctaaacttattcagacacctctcactgcgtgaataataagtttttttaaaggaccaaaaggtgaaaaatcagcagtgagaccgactcagattaatttttttttttttagaagccgactcagattaaataggagttacatttcgtacgtgttatccaacggcccagagtgcaacgtgggcctagtttaatgggctctaattcggctgaggcccatcatacgtccccatctgtaaactcactcgttcgtcggaggcgacggccatggcttcgccggagctcgccgccggcgatggcagctacaacttccacctccgctccctctccgccgcatccagggactccgccgcggccgccgaccccgcctccgaccccaacctcctcgaatccgtaagcgcatctctctgcaaccctggccccttccatggtcttcgaatcagggggggtgggatgtgctcacgttttggcttgttgactcgtgtgggctttgcggcgtgaaggtgaggagggtgtgcgagatgtgcaaggaggccaagggggccagcgacgagatggtggcccgggcgttccctgtgatgagcaagctgttccagcgctgcgccgccgcgccgacccaatccgtggcctccagcggcgtgctgctactcgtaagctgtgcttcgattcactgatgtgaagtttttcccccatcttggctgcaaatggttgttattcttacatgttaggttggaggacgatatcgttgcaatgttttggtagttttgtgaaatgtttgcatctttaggggcgagcttgctctaatgttaatggttaaccttatgatccccatttgaccccatataatcattctctgtggacaattgttggtgaatagaatcatttagatttgattagtaatgtacacacatttttagtcatcatatatttgaagaaaaacctgtctaataatacatactgtattactgctccctacccagaccattctgcagttcttcctggactttggggaggcagtcctgcatgatgctgatggtagcttgaggaccttcttccgctcttgcctaagtaggtaataatttttcttgatgtattgggtatgcgattgtttatttttattttcctgcttaccctcaatcacttggctattctttcttgatgatagggagttcgctgatcctattgtcgcagaacgtacacttgaattcctgatagcgaataagacaaagatcctgagctcttttcccacattaattccacaggtgccataccatataatgttatacagcactagaattatcaaaatatctacatcttatgtcaactaccattctttatattgtcagttagaattttttttgcataaatgtagctctaggcttctactggcaagggccaatgaatcaagcatacttcttgaaaagatctcaatccaatttcctcctttcttttttgacttttctgttttgtctctttccaaattactatttaatgatgttaatatttggcaatgctttcgtgatgctgtctatgtgcagttttttccattgttgctgaagctaattgcatcaaatggtgagaggtatgccatcttaattgctcatgaactcctcacatatttgctgatattttactgtgtaaatatgaagaagttcattctacctctttccagcaatgatttgacctatctaacttgggtttcctttgttttagattggagaggaagttctcagaagtgcttccgttaatgatgtcagcaggatcttttcttcctctcttcctgtcccttatggatcttccaagtaagccttctgattccagacttccagaattttcctctagcttctttagattgtgcaaggctgtaaacttcatgattttagaagctaattagccaagtttattatgatagtgttattaaactgttgcatgtgctgactgctgacatctggggcacatctcttccaacatgcgagatgcatgtaatgtgtataacatgctgctactgaggatgcttatcctgtactattatgctttttttactaattggtgtcatttgttctattgcttactcatggaacaaaacagtgttagtggtagcattggaaaaggtggaaagaagttctggaactctcatcggtagtagtatagctactatacagaagagtgctgctcctgaggttgatttccgtaatgatttgacctaaaagctgtaaatgaaatgtcacctatcaaaactaataagcttgctaatctttttctatcgtacagatgctacttgcactaatggatgaagcatacactggttctgctatagaagatgccattggcaatgcaggttcggatgatagtggtcctctagaccttgctgacccgatgttccttgatcttctaaaagatgagaatgatggtattgctgtaagtagttccttgaagtatgtgttccatgttcttcagtgaatgccttgatctagtcttctcattttctgatgttttcctcaggcaaaacattggacatctcctacgatatcttcaaccttacaggcagcagttaatagcccacaatcggacagattgaaacagtcactgaaaatggcacctcgttttcttacattatattttgctacagcattgcgggacgttaacgactgtatgttgcctatctttgttaattgctatacatactgatgagtgatgaccaacatattgttgatttgaccctctactatttgtcacttcagcactcctatgcgctctgattcctgtagttatgtcaagatatgcagcaatgttccctgacaaagtatactccttcgaggtaggcaagtgggtgtccttttcccattgcgtctaatactgcgtctaatactggagtagtaactacagtactacggtaagatcattgaagtgcttacttgatgattgaaccgaagtgcttacttgcataggaaactaaattttagtcagcaattaagaatcaattcctcaagaaaacaattgatgatacacccatctatttagatatacggcttatatagttttttttaagtaaaattgttaattgctaaagctatcctaaaagttgaaatttgtggaacgtatacattacattggagtgtctaacgaacaaaatggaagaagtaaatcatgttttcgaattttcttcacatcatatgtaccttcagtacaaaaggatggtatatgttcgtatggggatttatgtttggttatttccacaattctatatcacccttcaaacaagttccttgcaataaaattgctgtaggtgaggaaaagactttcagatttcatattggctgcattccagcgctcccctgacatcattgcactgctaaaggtactgggtatacatataactagacatgcatatacatgtcaattctctgaaccaatataccatgtttgtagcatttctttttctgagagtgaatgttgtagcatatttaagcaacaaagtaaatatctcctttttctggttccactaaaaattttgcactataatttcaaaccattctacagaagcccattacagacagacttggggaggctcatgataatcctgcaaaggcaagtatatgttttaagtacattttgattttataagttcaccaaactgctaattttcacctgctctcttatcctagttctgattatcttaaatgattaatactcttctccacatcaactgagttttctgatcgaatgtgatttatttacacagactgaattagcattgcatttgtgttgggccattggtgagcatggagctggaggaaaaaatcgcaaagatgtagctcgtgaactgtttgaaaatttggagttgctgttatatgaaaatctggctaccaggtgggccctgttaaaccagtcttttttttctaaacttgcatggcatctcttttgactgacctcttatctcttgttgtgaagtcgtttgggattaagtcaggacacaggatttgatcctatgggtgcatcttctagaaaatcatctcaagctaggctcctctgctttgtggtgactgccatagcaaagctagcaacgttccataatgagttgcttccaagagcacgtgtatcattggccaaggtaggccctaatccttccagtttgaggaatattaaggtttgatatattactgtcaccactcattttcatcgtttgagcttgtaacttactttcgtacaggtcgctcgttcccgaacctcggacaggagagtgtggcaacgtgcttgtgactatttaggtctattgaatgaaccggccatttgtttatctgtactaggaccatccaccgcacaaggaaatggtcctggtattgtcaactggagtgaaggaggaacaaagatggtagctcacattccgttctacctgttagctgaacaaaaaggtaaaaaactcttttagcaaacttatattgttaaatgtggagtaagcatcctttcatgtttgttaccgcacaaacatgtttgctaggaacaaactccatatgtaagtgatatatttaagaatcaagttgttttgaaaaatgccatcctgagaaaactattaaaatgtgtttccgttaataagccttttgtaaaatgaacacacgagttactccagaactcaacttgttttgcaggtgcaccgatccatgatttttcgtttgacgatctcgtccccacggaatgatgtactttcatgagtgcaatggattcatacaatgattccctcgcggacatcatctgtgctgactgccgaggcttttggtggtaatgtcatgaatcatgaagatccaagtggcgtctcttatgagtttatccagttcattattcagtctaaaggcgagctaagttgctttggatgagaccgtatagtttctgggaactgaaatgtttgttcatggggtgaaggttatggcagaagcactcgagtatttccatgtagggattgtcgtatatatgtaatcttttgaagggtaatcagtgatgtaaataataagagtggcataaattttatcaaggagtattaaattgattgtgctgttttttgggggatatgcgacagttctgatagaatactgttgaaggcaatgaaatgcaagtcatcttacacaactctgcaactgctggaaactgaaattaacatcgccttcattgaagcagcaaggaagaactaataacaagcacagcacacacaattttggattgaaacagcactgatcaaacactgaagagaactaaaagtataagacagggacacagatctctattctgcaactcctactagctagctaggtactgggaagtctgaacaacagaaattacagatcaaattaaggggttttttttgtactccagaagaaccctaaattcataaggtagcagcatccgagaggcgaacatgaagaggaagtcaatacccgaaccaaccgcccttgcgtagtggtgacacattttttttgaaatttcccgaatttgcggaaaaactagcgaaaaataatccaaactatatatgggcaccacatggcaaggacagtctgaggtgcgttcttgacttcccactgatgaaagctccaaaattttgctgctcctgcacacaaacatgatcaaactcatcagaaattttacagatatacctctcattaactgatgcaattaatctcgcaagagttctgaagtaatttggtgcatttgtacctgaaattgaaagcacaagaagcttttgtttgattcaaggacgaagctactgcggattgctctcgccggagacggccgccttgatgcgctccaccgtgcaggcgatgaggctgttcaccgtcgccaccgaccccagcgagagcttcgccgtcgggacggagtccaccagtatctggaacgccaccgtcagcagcgacccgccggagccgacgccgacgccgccgtcgccgtcgccaccgtcgtgcgccggcccatcgggcaggatggcgaagcccgatggcagcagcgcgacgtagtccgggtcgccgccgtttagcacgacgttcatcgcaaccacgtccaccggcgcgtagatgacgtacgaccccgacgcgtccgtgcagctctcctgcaggatcagcatgttgctctggttcgagttcgagctctgcaatatatatttgtacatgaaacgggatcgatcaatacatcgcgcattatcgcatgctcgtatatatcttgcgttttgatcttggatgaattgctgcttacgttgacgcgaagaagtgagacgcagttgccctgatcccggccattggcgatgtgggccatttcttgaacgataccgccattggagaggatgtcccactgaaaataaatttattttcaaagtttaagattttgtaatttttttcgcgaactaagagtttgtaattgtattcttgttaaccttatcatggatttataggtattctatctgtttaatattataagtcgtattgacttctttcctagtcaaactttattaagttaaataaaattttaaaaaaattaatagcatataaaatattaaattagttttattaaatttaatattgaatatattgtgataaaatgtgtttgctttgtattaaaagcgctactatgtttttttttacaaaattcatctgaataaaaaacaaagcgactttttttttgacgtaaaagcgacttatgatataaaacagagggagtacctcactgcgagaggattcgtcgcggaggaagtcgaagacgcgcttgggagggacggggagccagaaggaggtggcggcgttgaggacgatgccggggggcctcccggggtcgtcgacgctcttcctcgtcatgacgcggacgtcctcggcgccgctgccggacagcgtcgtccactgatgcgccaccgacgccgtcacgccgccgcagaagctcaccaccatcctctccgccagcttcagcatgctcttcctcccctccgagctcgtaatcactgcaattatattcattcattcaacaaacacaattaaatccactgcgtggtttagtgattgaacatatctgaattttaatttcgttttggatcaaattaaagggtgaaattcgctgcatgctcgatcaattacttaccgccgatgtcgctggtggggatgttgctggccatgacgctggcgaggcgctcgcactggcggtccagcgtgccgacccaccgccgcgcgccgaacgccagcccggagttcaccagcagcttgtagatgttgtgcaccgacctgtcgtccacctccacatgctccacccacgtcacctgatcatacaacaatttcatcagttttccatgatttctgaacagcaatatatcttgaattcagaatttcagatttgatttgtgatgatgatgatgatgagctgatgatggtcaccttggagtagccattgggcatttcttggatgaggcagcctgacggacggcggcgacatttgaggacggggctagggcggaggctgtccagcgagacgtcgacgacggcccatgtcccgtctgcgttctgcttgcagtatctcacgaagtagctctctctcgttggcaccagtggcgatggcacctgaaactccactgacatctgcagagaaaacggccaaaaccaacacaattttgtcccatttcagtgaccaacatgtacacacttcgaattctttggtactaccgaatatgacagaagattcagaaaggagacaaaatttttaagacaagcatgaacacataccacttgcaatgcaccgttgtagttccccgcgacgccggtggacagcacctccagcgtgatggccctcgacacgatgttcgagaacactgccgcgtactgattctgcgcaattcactcaaaatttgaacgaaattcagaccccaacaatcaaacaggatcataaaaatcaccaaactaaaaaacattcagacaagaatagcgcactgactgacagaaaattaaccaagagcttaccgcgtccatgaggatctcgacgaggttggcgtgcgtcatgatgacgacggcgctgtcgcgggacgcctccgacctgagcccgtactgcttggggccgagccctcgggggaacatgcgcgcgtactcctcctcgctgagcgtctccatcgccgccgccgtggcgtcgagcggcggcgcgacgctccagagcggctcgtccagctgcgccatgcggaccagctcctccatcgccgccacggcgagctccacgatcatcggcttgtcgacctccgactgcaccccgcgcagcagctccccggcgccaccgccgccgaacatgtcgcccggcacgccgtacggcgccacggggaggtccagcggcgcccgcgacgccgccgccgccatcgggttcgacagcaccgggaacggcaccattggcttccccacgtacttcgccgcgatcgccgatatcctatcgatctgacaagcacaacgacacgatcagcgtgcgacgatccatgcaatggcggtgtcaccatgatcgatcgattgttcagatatggtgaaaactacctcttcgcggaggcgggcgttctcgatgcggaggtggtgctcgtcgaaggacatctcgccgagggcggcggggccgccgcagttggggcaggaggcgctgctcagggcctccttgtaccgcatgttctcggcccggagcttctcgttatccgaccgcagctgcgagttctcgtgcctctcatgctggttctgcactctccccaacacatcaaatcacacaccatttttactcaaatttcaagctaaaaacttcgaaaatctttgcaacggattgacgatgacactatgacagtgtgttcgttcgtgcaaactgttaattccaatcactgtacacgtatgcagctaggtcagcaaggtaggggaagggtttgactatggaggacggacggaggcgtaggcctgcaactgccacatttggcagtgtgcaatgcagaagcggacatgggggtgcgtgggcaagccttgtccagttatagtaatacgccatgaatgcgtcctgcaggagctaggtcagaggcttaaatgaagtggttgtgacgacgaggaggaagaagaagacgacgctctctctcttctctctatctcgcaagctcgccttctttccggccgaaattttctcaaccagaaatccaaagaatccgttgcatttgcactcgcttgcaggttgcaacgtcctgattaattacacgtacatgtgtttcctaaaaaaaagaattgtactgctacgaacacaggtgaaagaaaggtgaaaatgatgagcagaatcaacaactatttgggtgattaattaggttttttcaccttcatttgggtgcgcttgttctggaaccagaacttcacttggagaggctccaggccgagctcccggctcagctccttgcgctgcttatcatctgggtgtggacattccttgaagaatctgatcagatcagatagatttagaacagatgaaccgagattaatttaattctattagtcatcagtaagttaatagtacgtacgaattaatgcatccaggaaaaataaattagaaggggaaatttttgaagttcggttgaacgtgtgaacgcaaaattcgtactacgttcttgaatgcttcgtcttccgttttgtttgggggagagtgcaaaagaacaaaaacggttttgatcaacgagtcaactttatgcagttcgtccaggggaaatggacgggcaagagaaatcaatttgacttctacgcaagcttacatcagtccatgggaaattaattaaagacagtataattaaccagctgttccatttgtactcatctcctcacattgatttcagtagactaacacagcatttcatgcgtaattttctgaattagaacacccatgaataacattccaagaacaagctagctggggcaaaactgaactgaactcaaatatgtcacatttctaggacaatcaaacaaagtatatactatatggaatcaagaacacataattaattaagtaaatagctatgagttgagtgttattacgcttccatctcctggatctgatgctgggtgtggcggtggtagcgcttcttgcgcggccgctggttggggtcctggtcgtcgacggagacgccgtcgacgttctcgctgccggacttgctctcgaactcgtcgccgccgagagggtcggacgcacggctgcggatcatgttgtcgccgctctccgccgtcgtcgccgggatctggtcaaggagatgatgctgctgctgctgatgctggaacgcttgctggaactggtgattatccagcaagtttggctgcgaattttggagcagatcgaattaattgaggattagtatgcgtgtgctacataaagagcaaaacttagctaccaatttggtaccacagattacgcctttacagtagtagtacctatttattccgtgcgttttatacatggcatatgcattaaatagatactagacaaagtggagaagttcaaagttttgtggaaaagatagaagaaaaaattgtatgcatgaacaaaaacaacccatattgataactttctcatttctgcaaggaaaaatctggtgtgttcatacttcataaaaacacagaaaaaaatttggggataaaatggaagattgctttaaatcaggaagggatgaggagacaagctaagtgaagaaacttttctccttttttgattccctttggtatatgcagaagatgtgaaagcaagcttgcaaagaggaataagaaagaaagggtagctagatcgatatgtttcttcttcaagagtgccacaacacaaagacccaaaaagcttggaagaacaaggaagcaagcaacaacaaacctgttgaagatgatctacaggtttccctctcaatatgtgtgcaagatcagcaacttggaaaatctccctcctctccatagtcctatctatctatctatcagctgacctgttcatctgctccccttatataggagtagggagaggagtaggccagtcttaaagaaagggaggctctcatgtactctgaatcttatgacctaatatgtgtgaacagcaaccactaagtactggagataacctctttctctcccctctatatagccccccttctctctctctccacaaccctgaaacttctcattttccaagaaagtgtgactaattatcttcagaaacttcagaactgaatgtattgctttttttcccctcttctagcttttcatctcaagtagtaacacctcaaattaatcaaacacaagaaagagaaagaagacgcaaaaggtaaaaatctagcacagcaaaacgctcaaaagtctttggatttttcaagaaaataaaaggaaagcaggccaccccttgaaattaatttcttttcagctcaaattcctgacaaaagaaattctttacctggctgagtgacagtgccgatgaggatccgtacgctgcgccgttccggccgatcatcgacggcatatgcctcgccgggatcatcattatactcctatatctcaaaccctaattcttgcccttgcagctccttccatttccactcatgaacacgcgtatatgagtgtgtcccaaacccaaagaacacacaaagtgctagctctaaatatgtagggagatagaatgatagatagatagatatagatatatatatatatatcttgcttgccaagcaacgcaaacgcaagtagaaacagatctagcacacaagctagcccaacgaaccttgctgcagagaggagacagccagccagtgagatccaagacaagaactacatgcaaatatagaactcttatctctgctttgctgtctctcctacctgcacaaaagaagatgtttcaccgggtgcaaacaacaaactgcaaggttcagagggctagcgagagctagagatcacacggcaagagatcaaggtgagatcttctcgatcaggatcaggaggaggagaggaagaagaagaggagaagaaaaggggaacacaggtggaagagaatgtggagaggggggcgaaggagttattgccgcggagtgttgagagggtgcaatcgcatttatggagaaggcgtagtgtaattgctaggggagagaaagagatggaaggggagagagagagagagagagagagagagagactagtggtgcatggtttcaactttcaattccaatttttgtttttatattccctcaattgaggatatggagaaattagagtgtccttttttgacttattatttattaacacaatgtcaaattgacatgtaatatagtgtttgtacaacactggatttttgggagacctcatagccaagaacaataaaacattttttatacttcctgaaacatttttttaaacaaattttgtttttatatttcaacaattgaggatatggagaaattggagtgtccttttttacttattaacacaatttcaaattgacatgtaatatagtatttgtcaacattggattttttggagacttgtaagccaatacaagaaaacatttttttatacttcctctaagaatttttggttatgtacctccgagatacatgtatagtcagaaactattatatttttaatgaaagtaatacatgtcataaattaattaacatttccttattgttaccaatttgtcgcttttttttcatttatctgaccatgaaacagttgtttggcaatcctacacgcaagagcacatgaataattcactgttgccccgtaatttatacaacgaattattatagaccggcgtaataattgagtggtggagaggtagatttttcactactgtttagtatagatgcagcgtatagtgcggcccaaagataagaacaaaagaaaacaggaaggcacacacgtatcgtcgtagtctacatatattttgttgactctcgatcgatactgatcagttactactaggttaatttatttgttttatatatagtacacacaaatacacaatcatagtattgtattttttgcaactttgtgattaattacatgcatgtataggaggaatgggtcaaaaagtatcctgtggaagaccagcttgctgctgtttcactatgcatgcaaactgatgcattttgactcgagtattttacttatatttttgggagtcgatcgatcagattttaaggagacaccatgcagggtgaagagatcgatgttttcactgctgtgccctgggtacgtactgttttcatgcctccacacgcctcatgcttgtttggtgtagtctttttcactctttctgcactggagtatatagccagcctttcttgctgagaaaaaaaaatttatgtgaaaaattactagcagaagaaacgtggcatgtactcgccatgtccacgaatataaatatgtttagggattttagcgtaaattaaggttacggtgaaattatttcaagatatcctcttaaagtatgggctcgccgatcccgattcgaaactcacccctcttaacaaaatttcaatacgagagccccttctctgatatccaacatttcttttttatttcacgatgcccccggcctcccgagagttcactttatgccgtgtttagtttcaaaataattcttcaaacttccaacttttctatcacatcaaaactttcctacacacctaaacttttaatttttccgtcacatcgtttcaatttcaaccaaacttccaattttaatgtgaactaaacacatccttaataagaaatatcatgcccagcgatgcaaactagtgagaaataatttcagtggttaattaggtgggttaggaaaataatactcaagaaatgctaacaaattttaaacactaaaaatacgtaggatggagggaataatacacaattatatcatctatacatgagtattgtatctacttgaaattaaattattttaaaaactcatgcatctaatcaagtgagaaataaccacaatcaacctttcaaaacagtatgcaaatccctcaaaatcaaagttgtaaaagataaaagaaattaatggataatggtacactatatagtggattaggaaaaaaaaaagaacactactaatgagagtcatgtccgtcttcattgcttttttctatgagaaattttacggttcttaaaaaagtatatatattgaggcatctaaattttacatttaaagtaatttttataccgagatagctagtatagatatcaaatttcacactaaaaaaatagtatctcctaatatcttctcaacaatggaaaaaattacctctttttctagactctgattgattgacctatgactaacaagccattgagaaacgaacgaagcaaatataatttatgggttaaacttatgggggatgctagcgcgcgtgcgcgcaagggaaaggagccggcgcgcgcaccagctgcatccctacgcgtttcttttttttaagatctcctattttaacgtcacttttttgtttccttttttaaatcgcttcttttttccagatttttttaatcgcttctttcttttccacacgcgcgaatgatttttttttttgatattttataaattcaatccttcactgtagcgcccgttccgtcgtggcgcctagcgggaaaattatctcttaaaaaccctaattgcgaaatttgtttctttgcttgttgtctagtgtctgtgccatctcaagatctcaatccccgatctatcgtcgagttcaattccgaatccaaatccttccaatcaatttcctccgcaaaagtctagtttgcctcccccgggttcgatgggccgaatccagctcggcccatctctcccccggg

SEQ ID NO: 39824 - DNA, 798 bp, Oryza sativa
ccctcccttcttttctttttctttttcttttccaaaaaggatttaattaaatcctttttcctttagaccaaaaatccaataatcttagaaattcaatatcttcccaaccgtaactccgtttgactccgttcaacttccaaaattcatcaaatctcgagatctatctaatggcacgcttagaggtcattaatagggctttattttcgctgtttgttgagttgttccgtttcgcgtgtagtttcagagcccgaagacccgcagtgcgaggatttcgaggatcaagctccagatctcgagcaaggcaagccacctttgaacatcttgagcctataattgaaatttaattatattgcttgaaaaatattatgcattgataggaccgcacttaatcttttgccccatctgcaaggcagattggtggacctacctgacttgttgcatttgatccttccattgttaattgccataccatgtccccttgtaaccacccagttgcgcctcgatattcgtgcactcagtgcgagtatcgacggtcgccttcaaacttaaaatctgagtaacaatttgggtaaaactggagttttacaaaagacttggaaaacccgacacctgggtcggtgcttgcgaactaaatgaatttccaaaaccgcgtaccggggaacgtaccgggtgtacggtttcccactctcgcacttaaggaccgattccttggaatttcatccaaacataagacaagtacgaccacatgggtggaatgggacacccctggctgagtaactagcttatcaggggagcctt

SEQ ID NO: 39825 - DNA, 4987 bp, Oryza sativa
tcttgggccggccggcccgtaagctcggccgagccgccccttttctctcgggcggcgccctagcccgccgagggaagtctaatttccacccctctttcttttcttttcttttctttcccaataaggatttaataaatcctttttcctttagacgaaaaatccaagaatcttagaaattcaatatcctcccaaccgtagatccgtttgactccggtcaacttccaaaattccctcaaatctcggagatctatctaatagcacgcttagaggtcattaatagggctttattttcgccgtttgttgagttgtcccgtttcgcgtgtagtttccgagccctaagacccgcagtgcgaggatttcgaggatcaagcttcagctctcgagcaaggcaagccacctttgaacatcttgagcctatatttgaaatttaattatattgcttgcaaaatattatgcattgataggatcgcacttgatctgcttgtcccgtctgcaaggcagattggcagacctacctaattttgttgcatttgatcctccctttgttaattgcgataccatgtccccttgtaaccatctagttgcgtctcgatattcgtgcaccctgcgcgagtatcaacggatgccttcaaacttaaaatctgagtaacaacttgggtaaaacttgggttttgcaaaagacttggaaaacccgacacctgggtcggtgcttgcgaactaaatgaatttccaaaaccgcggaccggggaacgtaccgggtgtacggtttcccgctcttgcacttaaggactgtttccttggaatttcatccaaacataagacaagtacgaccacatgggtggaatgggagacatgtggattcaccggggtggtgtctgggaggacccctgggcttcctggcacagtatggtctgggacctaacctgttgttggtctgggacccctctcgtcggcatatggtaaacctgtgtcggctttggaaatatcttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgacgtttgaaaatctgtagctgatgggatcagctaggcccgggtggccgtttgaaaagttgttggcccgggtgaccgttgaaaagctgttggccgggtgccaaccttgttttcatttctaaagactgatacatggcacatactccgaccggacgagacgcactgtctcatccgtgtcgtttgagaagcactcacttagttgtttcagaaaagagttcaaataaaatcaattgcaaaaacaccagtctctccttgaagcctgcattaaacacttatttcccctggcttgctgagtactcccgtactcacccttgctctatataaataattcccccctagttgctgaagaagatgaagcggatcctgctgatgaggagttctttcaggagcaagccggctacgatgagttttagggtttcgggctagttcccaagtcgcgcctgtattgattggtccaagtcctgcttccggttttcttttgtaatgcagttgtgagctcggggtctgtccgcagcccaacatgactgtactactactctataataaaaagacctctgttgctgtgatattctgtctccctgtgataccagcactgtttcctgggactggtatcgattaacaggttaatttggagcgtcacgggctagttccggtcgggactatttcggggcgtgacattcaccttcaccttcaatatcagttgagagttttgaatttgagttgaaaagtttctaaaatttaagttgaatgttttgaattttgagatgaaagttttcaaattttatcaaatattttgaattttgaggtgaaagcttttaaatttgagctaaaagttttcaaacctgagttaagttttcaaatcttgacttgatttttttaaatttgaattgaaagtttcaaatctttagttgaaagttttcaagtccgagttgaaagttttcaaatccgacttgaacgttttcaaatcgagttgaaagtttttaaatccgagttgaaagttttcaagtttgaattgaaagttttcaaatctgagttgaaagtttttaaatttttacttaaaagtttccaaatctgagttaaaagtttctaaatcttgaattgaattttttcaaatattgactcctactcttagacgtgtgtggtagttaacggcaaaaaaagaagaagaaaaaaacaagaaagaaacacggcagttgtgcctaccgaaaaaaagaaaataaaaaagaaaaaagaagcgcgcagactcggtcgtaggaggacccgccacgtggcacgctcgcgacttggagaagtcgcgcatacgcgcgaattaggattcctgtaaacttatatatttgtattgttgacgttttaataggcaaggctgaacgttaagataggaaaaatctcaaagttaacttaaaactaacattcgaaatccttttttttttttgcgggcaacaagccaacaagactataaaatcagagtgccatagagtagtggccatagtgtaaaattaaagaactggtgtgcttaattagattactggttagcctctatgggcaattaagaaaaaatatgttgttttttctaagttattcattgtgtgattataatttaattctatatatatatatatatatatatatatatgatttaactaggtcatgctaagtatgtttccttaaagaataaatatgttgtttttttataagttattcattgtgtgattataatttaattcaagatatatatgatttaactaggtcaacatgaagctgttctatatattttctgactcaaattaggaacatcactgttccagtgggtgaccatatatatttattacgagaaaaagaaactaacctcttaatttaggatccagtatttgttcatgtaattaatttagtccacagatagatgttaacacatggtagcgtataagatagcacatattgatcccaaattagctgtccctgcctttcggattatttgatgttgacgagatacgacttctacaaatttaagataggattaattaattaccatcaattgtttcctggatatatatagcgtgactacatgagatggttccatattaagtggtacatgggagtatacacatcttgttcatatagcagggtcaaagtaattataacaggggtctccaaaaaataaagcttcttataacaaattaatatatagttataactgtgtaattacaaactgtctaaaattaatttcacattgtaaattatatggcagaaacattttttttttcaatttgcaacccaacagtacgtgctagctgtcccaaaaaaacaaggttgcttttcttgagctagcttagcactggctgtctctggctcatcatcagtggttcagtactatacaggaccccatattaatgaaataaataggcaacaggcaccccggccagaaaacatatttggactttagagagtgtcaaagttaacacaccagcaaagtcaatcgaacatgccaccatttatgaaacagaaaccataataataatgcatgatcaaacacataataatatacacctaccaaggtcaggaaaccattaatatttttccctttagcgtgttgtcacttatgatcttttaggtgtgttgccaacctggactcgtttgtctccttttgcatacggtttccgatccatcttacgtaggagtagtagccaaaattaaacatgtgcgtaaaaaaaaacttcaacttttgtacagaggctgcgtttagatctaaagtttgtttggatccaaacttcagtccttttccatcacatcaatatgtcatacacacgtaacttttcagtcacatcatctccaatttcaaccaaaatacaaactttgcgctgaactaaacacaaccagacatggatgaatgcttaattcggctgcttgtttcttttaacatatagtccgaccatcatatacatactggttattcgtgttctctgttctctgttctgtagtactagttaaaagttcaatagtttatgtgtacagtcttaagttaatttagtgttggcctaaactgcacgcgtaccataataattccaatatttctctgttgcatccttccaggtatcgagatgatgacggggctagtgatgacttgatcgatcccaggtttacttttgaacatatagattttacaggattctcatagaatcagtacattttattcgttaaaaggacacctgaaaattactgtttttgtttaaagggcgcgttgttcctttgttagtgatgcacgcagcacacgtatataccacaaatgttggaggagcgtggagctgatctcatgtcagcagagagatgcttcgattttcctctctttttgtcgctaccaatatactctaatcgtatgatctacggctgataaaccatgaaaatcatgaactagcaaccaataatttataaataaatcttttatatccacttattccgtcctaaaatataagaagttttggtaacatcatagtactacaaatctgtacaagctctttgtccaaattcgtattattaggatgtgtccaatccaattaaaactttttatatttgggatggatgaagtatattattagtgacttaaaaagcaattgctagaaaataaattactaacatagaaaaatatacaaagtttacataagattacaatttaaatataaattttagttaagactaatgaaccaacaatgagacgaatctatgcgaaaagaaggatgaaaatggagggagtacatgtagtagtactcctccagtagacagaagtgagcggat

SEQ ID NO: 39826 - DNA, 6322 bp, Oryza sativa
  unsure (1)..(6322): unsure at all n locations
tgtgcttgacgccgccgccgccccctcagctcgccgtcgccgccgcccccttagctagccgccgccgcacacacaagtgagagagaggtacgcacgagtgagagagagagagtcagaatagggtttggctttggagggtatttttgccattaggaactctggaaacattttcttttttaaaaaaaaattgaaccctaacggagtcagcgaaagagggtcagacggaaccttcgtactcgaaaaggagggtcaaataagcaaagttcaaaaggtagggtcaaatcggcaaaacagggtcaaataagcaattgccaaaaaaaaaaaggaaaaagtccccttagactcccttaatagttcattgaatctaatttgtgacccttaactagaaaaccgggtaggatgactccctgaattattaaaaccagtacaatttgactcctccagcggttttagagtgtggtttggcttatgtggcgctgacgtggcggtgctaacccggttttcattccacgtggcgcttatgtggcattaaaattaaaaaattatttgtgggacccatctgtcattcatacacaagaatatattatgggacccaccgacatgtgggacccacgtatcatcctttctcctccccttcttcctcctccctctctctccctcctctctcttttctctcccccttttctctgatctgatctccttcccttattcggtctccgccggatctcctccgccctctgcgccgaggtccacggccggcgtcgtcgggccccctccgccgcgttgctcccacggcgtcctcggctccgagcgcatcgcctcgtctcaacgccgccatcgacccctccgctccctgctccgccatggcctgaccaggcgaccagctcccgtgacgtccatggccggatgacgacgtgctgcgctgctgccatatatacgatcgaggaaggttggagaggggaataacaacgcgtttgtcagattgctgtacgcgtaatatcggccgtgtgcccgtgtctatgtcgtcgagctgcaaatggcgtggaatctccccggtgatacaatgttgctttctagtttgactcgatccggccatcttgtgaaaagatggtgctgattgatctgagagaaagacgccattcgccggagaccagggggatgagcgcccgtcgccgaccggcgcccgccctggagggcctcgccgccagagccgggtgtttgcgcccgttgccgaccggccgccggccatcctccgcgagccaggacggttcgggctccgccccgcttccaccaccaccagagatccacgccgcgtcgccgccgactccatctgcgccgcccggcctgctctcatggatgccgccgcccgtcggtcaccacgcacgccggtctcgccgagttgctgtcgagggaggccgaagaggcgcccccgggagcctgctctcatggatgccgccgcccgtcggtcaccacgctcgccgatctcgccgagttgctgtcgagtgaggccgaagaggcgcccccgggagatcagatcagagaagggggagagaaaagagagagaagggagacagagggaggaggaagaagggaaggagaaaggatgacatgtgggccccacatgtcggtgggtcccataatattcttgtgtgtgacaaatgggtcccacaaacaattttttaattctaatgacacgaaagcgccacgtagaatgaaaatcgggttagcaccgccacgtcagcaaaaccgtcctgtaaaaccgttggaggagtcaaattgcactagtttcaataattcggggagtcatcctatccggtgtttcagttaatggtcaccaattagatttggtaaacaattaagggagtctaagtggactttttccaaaaaaaaaaaaaagaagggaactccgggtcgtgttcaggcccaaccccgtgcgcttcttgggcccggaaggggagcagcctacaaaactcgcgcgagaggagattcatctgctagcacaagattcatctgctagcacacgcacacgtttgagatgatgggagcaccgatgccgcgcggcggcggcggcggcggagaggctcgtgtcacccccgccgtcgccggcgagcagcggcgcgcggcgttggagatgaggaaggagaggctggtgaggaaggcgagctcgctcgcgacgcggtgcgacgtccccgtcgccgtgatctgcccgggcgtcggcgccgggggcgagccgacgtggtggccgtcgaaggaggaggtctgggcgatcgccactcggtacaaatcgctgccggagaaggatcggcggaagcactccgtggacaacgcctcctactgcgagaaccaagccgccgcaaagcaaggacccggcggcggcggcggcgagttggccatggcggcggcgcaggtggacggcatcgccgccatgcccgacgtggagctactggagcttctccgatccatcgacgtctccctggccgccgcgagcgacacgatccagaaggccgccgacgaggctgaacaaagtgtctcgctcgagcgcgcgcacgcgcacgctcacgcgggcgcgctcatggtggactcccaggaggatgccgcgccgccgccggcggcgagcgggaacggcgtcgcgtacgacggcgagcacatcaacttgggcgggtacatgatcgagcacaaccgattcgaagcaatctggcgcgaacacgcgatccctcctccacaaagcctcctgccggacgacgacggcggcgaaccgctgcggctgtggtcgttcgacgacggcgaaacggtagtcttgccggacgacgacggcggcgaaccgctgcggctgtggtcgttcgacgacggcgaaacggtagtcatttgaaccgtgagtgtttttttgactaaagattttgtttttgagaatgttttgtgtatatagtagtttgatttatgcagagatggaaaaagccgctgcgaggaggggacgatcagagctcgctggacttctgtgttgatgaaatcctggataaactgatggattttcgatcgatactttgattagatagcaaacctggagagactgattagatagcaatcctggagagactggagggttatactttgattagatagcagtgtaaggattatcttttttgtgaaattgatgttcatgaattggattatcttatttgtgaaattgatgttcaacgaactagaacgagaaccagcaatcccagtactctttttttttttaccgagtttcctcttttttatcgagttttcacggaaaattatcttagattgaaaacgagataataattaggagaagatatcgtcaaacaacaagcgatgacttatggatgataattggcgctcatggataataattgggagaaggatatcgtcaaacaacgtttgacaagcgatgactcatgggaacttcttttctctttgtgcaacggaaacctgatagatcttcttttctctttgtagcaacggaaacctgcttatcgaaaccaattatttgaatgagcacgtatttggacatgacgcataagcataactttgtaagtgacgcataaacatgactttgtaaatctattatggttgagatccattttacatgcttattgattcaggctctatttgttttaacttaattgtaatctagattattgatctagattactataagctgtattataacaagctgatatagaataaactgtttgcagggtttaatttattggattgaccgactgtatcggaggtcaccgatagaccaaattttctgaaattttagtccgaaattttgaacaaatattgctgaaattcatgaaaagttaaaaaaaataaaatttgggccgaaataatatcgtatcaaagaaggtccgaaatgcctggaatttccaaacctgattgtttgtttctctttctcttgattattaactgtttgttagctgttagtcactcaataatctaagaaaaacacatttagagtggatttatagattgtaataatctatcataataagctatatgtatgtttcatccaacttctattataatatagattaatagaagtaagatgaaccaaacaaatagcttattttgatagattattataatctataagctagattactataatctagttatccactctaaaggtgtttttttagattactgggtggctaacacctaacagctagctaataattccgagaaacaaacagctatactgggtggctaacacctaacaactagctaataattcagagaaacaaacagctaacaacttattctatgtagagctaatgattcagagaaacaaacagctaacagcttattctatgtaggctttttataatccaacttataataatctgactcaataatctagattccaataattttaaactaaaacaaacagggccttagtacccttgggtatgcgaatttaacagtctttattcaatttcataaaagaataattcaatttcaataaaaataggaataagtttactgtaactctcttaacatctagtagctaaatctaatcggtatcaatgaaccataatactggatatagtggagtagcttggcggcgttgcgaccgggccgagtcacgggtcggcggtggagagcacccagcccgccagcgaatttttttcggttttagattttttttaaaatatttacagaaataatctatcggccaaaaaaattacaaaaatagaccataccgcccacctctagggcggcaagttgacgtggcaaacgggggaggaacgggcggtgacggagggagggtttttttgcaggaaaacccttgccgccctctggtggggcggcaaggggcccgaatgcaaaaaagccagtcggggccggccattttgcaggcggccccttgccgccctctagccgggcggcaggccctcgctgcctataaaaggcctgccgcctagcccccagccctcattcttccctcctcaattccagtgaaaaaaaaaagaagagaggggaggagaagagaagaaggggcgaagccctgccagattcagacgccgatttcaggtaatattcatagatcctatatgtgactattgagttaaatagtgtgtattctttaaaaatttgtttgaataaatgcattatatttttagggttttagttgcactaatctagaagtgcgtattgtaaatatcggtaactaggtagatcggctagtttggaatcaatacattaccgttgcattggcttacacaagaaaatattacgttgtagatgtttattgcatgaaagagtaatatgatctagttatttcattgacagatatgtcgaacaaacaaatattccaagtttcccatggcccagaaaacgacaaatgcggaccaaatggggtagatctgtcagattttattgtatcagaaaggggaattgatagaccggctgagagnagtgtacctctataaaagaatagttaatgaggggcttgagagttgatccacagacaagtgacataccatcaaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaatgagacttctgtggaggaggtcaacgcacgagaggacgggggcgtagtagctccagtgggcattcaaccaggtgaagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagcacaaagaaaatgaggttattcagggagcgatttatagtagagaagaagatatgaaggaagcagtaaaacattttgcagtgtcacttcatagagagttttgggttgccaagtcgaaccggtcgcaatatgaagttcggtgtgttaagaaaaaagatggttgtccctggagagtgcacgcatataaggggaaatggaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatc

SEQ ID NO: 39827 - DNA, 3602 bp, Oryza sativa
atgggccgagagggattcggcccatcgaacccgggggaggcaaacttgacttttgtggaggaatttgatttggagggatttggattcggaattgaactcgatgatagatcggggattgagatcttgagatggcacggacactagacgacaagcgaagaaacaaatttcacaattagggtttttaagagataattttcccgttaggcgccacgacggaacggccgatacagaccaaccccctaacaagaatctcgaccccgagattcagcacctaagggagcagctccgggaactcggcgtggagaagatcttctcgctcccaggtcgcctcatcttcagaatggttgctccattggactttgtagaacttgatggtcttccttcgagtttgacgttctgcctcttcaagaaccttgattggtctttccttgtaggtcagattcttttccagctcgatattacccagggggacttgctcttctggaactcgaagacatttctttaactgagatacgtggaacacgttgtgcacatctgcgagaccttcaggtaactcaagctgataagccacttcgcctcgtctggcagttatgaggtaggggccgatgtagcggggtgctaacttgccggacatcccaaacctcctcataccacggaggggtgatacccgcaggtacacatgatctcctttttcgaacttaaggtcacgcctccgattgtcagcgtaattcttctgacggttctgcgctgtctttaaatgttctcggattagcttaacttgttcttctgctgccttgagtatgtcaggaccgaataccagcgcttcgcccacctcattccagcacaagggggtgcggcactttcttccgaacattgcctcattcggcgacatctaaatactggcctggtaactgttgttgtataagaactcagcatacggcaaacaacgatcccaagtgccttcgaaatccagggcacacgcacgtagcatgtcttctaggatttggtttactctttctgtctgaccatcggtctgcggatggtaagctgtactaaagtttagatcggttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagccggtttcgtgagctggtccccgattacccaaatggagtcgtacccgctaggggttcttggcaaaccggtgatgaaatccattccgatttcttcccatttccactcgggaattggtaggggctgtagcagaccagcgggcctctgatgctctgccttgactctttggcaaatgtcacacaaggcttacgtattctgcgacgtctcgcttcattccagcccaccagaaatatgccttgatatcttggtacatcttcgtacttcctggatgaatggagtaggcggactcatgagcttcttttaggatgagatctcttaattccttcttggccggtacacagatgcgtggaccgcaccaaactgtgccttggtcgtctatggagaaattggtgtctttcttctcctgtattctttttattaactcttttatcccttcgtcgtttttctgagcttcccggatttgcgactctagggtaggctgtactgtcaagctggcagggacacctgactgcaccacggtcagcctcaacttctccaattctctgcacaggcgatcttggtcaggccgtattcgagctacattgcaataggccttgcgacttagcgcatcagcgaccacgttggctttacaggggtggtaatgaattccaagatcgtaatccttgattagttccaaccatcttctctgcctcatatttaactccgtctgtgtgaagatgtacttaaggcttttgtgatcggtgtatacttcacatctgttcccgataaatagtgcctccagatcttaagagcatgaaccacggctgccaattcgagatcatgggtgggataattgacttcatgaggtctgagctgcctggatgcataggccacaacctttcgttcttgcattaggacacattctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcatgggtctggctaacttagagaatccttcgatgaatcttcgataatatccggctaagccaaggaagctgcgaatctctgacacattcttgggcgggttccaagcaagtacagcttcaaccttgctgggatctacttcgacaccgttggaggagatcacgtgtccaaggaatgctactcggtctaaccagaattcgcatttcaaaaatttagcgaatagttgatgatccctgagcttttccattattagcctcaggtgttcagcatgttcttcctcattcttggagtatattaggatgtcatcgatgaacaccacgacaaactagtccaggtattccataaagattttgttcattaagttcatgaagaacactggagcattggtgagtccgaaggacatcactgtgaactcgtatagaccataacgcgttgagaaagcggtcttcgggatatcttcagatctgattttcaattggtggtaacctgatctcaagtcaattttagagaaaactcttgctcctttaagttgatcgagcaaatcgtcaatccgtggcaacgggtacttgttctttatagttacttcattcagggctctatagtcgattaccattctttcagagccatcctttttcttaaccagaagcactggggctccccaaggggatgagctaggtcgcacataacctttactctccaattcttcgatttgtcttttgacttctgctaactcattagctgccattcggtagggtctttttgcaattggtgcggtgcctggtgccagttctatggcgaactcaatctctcggtctggtggcatactcgttaattcttctggaaatacgtcgggatattcacagactatgggcaccgactccaaggaggtgacttgtaaacaggttaagatagaccgacttgcggtaggactgttagaggtaaagcggacttgctttcctccaggtccttgcaaagtgatggacttttcggcacaatctatctgtcctttgtgctttgccaaccaatccatccctaggatgatgtccaagctttgcgagtctaggactatcggtttggctaggaagtcaacttcctcaattctaaggttaacttccgggcatatttgagttgcccttatatccctcccaggggaatgtactatcatcggtacacgtaaattttgggttttccaaccatttcttttcacaaaagcttgtgatatgaaggagtgggaagctcctgaatcaaacagaactattgcgggtatggagttgacagagaacatacccatcacaacgtctggagcatcctgagca

SEQ ID NO: 39828 - DNA, 4190 bp, Oryza sativa
ttctgagggcactgtctagcatagtgacccatctggttgcaccggaaacactgaactgctgacggtccctgcggtgacttgaaagaggtaacactgtttggcgcagtattgccactaggggcacgctgctgtggctggggtgccggacggttcatctgaggacgaggggcgtagcctggctggcggttagcttgagtgaccgactgatggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtagggaagtcatgagcaagcaactggagtctcattccaactgcgattcccttcaagaacttcctgatcttcttcttgtctgtgtccacttcctcaggggcataccgagccaacttgttgaactgacttaggtactcattgacattgctgttgccttgcttaagtctgttgaattcctctttcttcatgtcaatggtgctttcaggtacatgagctgcacggaaagctgtagcaaactcatcccaagcaatgttagtgggttcagggtgtgcattgcagtaattctcccaccaatctgcagcaggtcctcttagctggtgagaggcgtagagcgtcttctcaacaggggtacactgcactaagttgaattttctatcaacatctttcagccaatcgtcagcctcgacgggctcgacggtctgagagaactctggcggacgagacctcagaaaatctgtcagcttggatctattgttgctcatgtgagggtggccatttccatgcgcattatgctgaaaaccggctacggctgcggctaatccttgcaagatttgtgtctgaactgccattaagtgctgcatgttgttttccacatgaggtggggaagggaggcgttcttctccagaattgtgactggcagtgtggtgagagcggtgagactgttccatctctgcatcacaggaagccgtgcgatgcgagcggttgctgcggcggggttgctcaacttctgcgttgcgggaagcagtacggtgcgaacggttgctgtggggagactgctcatgatttacttctggctcggctctaccatcttcaaaaccaaagcgggctggcgcacgagctgcacggcgggggcggctagccatctaaactcccagaagagggcggggtaagaatcagataagcacttaggagggcaaggagcaaagtaaatagcaactcagatagcacacactaggcataaactggatttttcaaatcataaaaacacctgatacaacgggtgtggacaagtcacagagctacaccgagcttgactgtgcgcacaccacctaggagaaccagactaccaaacaacacccacaacaaacacacgcacgcactacctcgccacgactccaaaagagttggcggcggaacaaaagggcctagcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtaggggagctgggtagtggaaatggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtgacaggggcggcctgagtcccaagagatagtgtcaactgaggtgacacccttctcggccagacgggcctccaaggcggcgtaacggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccaaagtgaagtggtgtgggcaaggccagctccgtgtatacctccacgggggtagaggtacacagagagctcacagtgagggggaacacggcccacggagtaccccgtgtactcgggacacgagaagccaaggaaacgggcgaggtcacgaagctgagcgacgtggtgaccctcaccaaaaccatgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacatcgggtttcgccctagggccaagcctgtgctctgataccatctcttgtcacaccccgaactagtcccgactggaactagcccgtgacgctccaaattaacctgttaatcgataccagtcccaggaaacagtgctggtatcacaggaagacagaatatcacagcaacagaggtctctttattatagagtagtagtacagtcatgttgggctgcggacagaccccgagctcacaactgcattacaaaaggaaagcggaagcccggacttggaccaatcatcacaggcgcgacttgggaactaggccgaaaccctaaaactcatcgtagccggcttgctcctggaagaactcctcatcagcaggatccgcttcatcttcgtcagcaactggggggggattatttatatagagcaagggtgagtacgtgggtactcagcaagccaggggaaataagtgtttaatgcaggcttcaaggagaggctgttgtttttgcaattgattttatttgaactcccttttttttttctaaaaacgactaaatgagtgcttctcaaacgacacggatgagacagtgcgtctcgtccggtcggagtatgtgcaatgtatcagtctttagatttgaaacaagattggcacccggccaacagcttttcaagggccaacaacttttcaaacggccacccgggccaacaacttttcaaacggccacccaggcctagctgatcccgtcagctgctgatttttcaaacatcgaacccattttctcaacagcaatttcacaagcggtagtcaaacaaaactacgctaggaatcacctcacatccgcccatgaccgtgggcacggctgttcgaacagtttattaacctctgcagagggggtacactttacccacacgacattactaacccggatcacccagcccgtggggatcaaccacgtcgggagacctccaagctttcatgacaaggcatttccaaagccgacacaggtttaccatatgccgacgagaggggtcccagaccaacaacaggttaggtcctagaccatactgtgccaggaagcctaggggtcctccctgacaccaccccggcaaatccacaagtctctcggcatcaaggctcccctgataagctagttactcagccaggggtgtcccattccacccatgtggtcgtacttgccttatgtttggatgaaattccaaggaatcggtccttaagtgcgagagtgggaaaccgtacacccggtatgttccccggtccgcggttttggaaattcatttagttcgcaagcaccgacccaggtgtcgggttttccaagtattttgtaaaacccaagttttacccaagttgttattcagatattaagtttgaaggcgtccgtcgatactcgcacagggtgcacgaatatcgagacgcaactagatggttacaagggttcatgatataacaattaacgaaggaagggtcaaatgcaacaaattaggtaggtccgccaatctgccttgcagacgagacaacagattaagtgcgatcctaacaatgcataatatttttcaagcaacataattaaatttcaaatacaggctcaagatgttcaaagg

SEQ ID NO: 39829 - DNA, 857 bp, Oryza sativa
ccggtccaagacggcccaagcgcgcgcgcgcggggggaggatagagagtccggtggaccggtctcaccacgcgtggcccgggtgggacccgcttgtcagcggctcggctcaccgtgcggagggagcacgcggcgcacgcgcgcgggcagggaggaacgcggtgcacgcgcgcggtcctcggcggacgcaggtgcggcgggcccacgcgcagcctcacggcttgtggtggaatgcgcgcacgcggagggaccgaccggggtcggcccgacccggtctgggctgagctggcgccgacgtggcgcctacgtggccgccacgcgggccggcgggaggtagacgacgatccgtccgcgaatggacggcggccggcgtcggcgaacgccggagcgaaccacggtgatacgggcaaaagcgagcacaccgggcggttacacgagacgaggggagacgaaccaacggcttggatttgccgggggttgctcgacggcggcggattgcggcggcggcaaccggcggcgggagaagagggaaacggcaacgaggccacgagaggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacgggaaggctactcaagctactaccgaaagctaggggaaggagatggagcgaggaggaagaacggagagaaacatcaccgagaagaggaggggcgctgtgatgagaggccgacggcgcgggagtaaact

SEQ ID NO: 39830 - DNA, 1233 bp, Oryza sativa
tgaagtcgggggtcgatggacattctccagggcaaatgaaggctacacgagctgcggcccggtagtcgagatgtcatatggcagagggttggtgccctgctgctaggggctcagtcctgcctgcctgtcccgggtgttccggccgtaggcgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggattgtcttataaaatggctttggggcaactaagtgacttttaaatgctgtttactgcaaaacttaacccctatattattatccccttgtactcccttgcattaattatgcatctccggtgtggcttgctgagtactgtggttgtacttattcttgctcaatctttcccctcttcagtaagagaagctttggagaagatgtcttaggtggagtcctggcttataccccagttgagcgcctgtgaagattgagccgtaggcccgctagtccgctgctgtttatttttgattgtcaggccttaagtgcctttgtaataatgtaaatattatcgatataataaagatgtgtcttttataccatgtttgtgtggtgtaccccggcttttcctgggacggggattaatacactagcgttcgggaaaaggcaattttcccggtcgcgacacaaacactaataaattccacataacagcagaaacaaagcacaaaaatgggttcttcacttcttaaggaaaaattagagacttgaacggtccaattccgagttcaaatggccaagttatggccatttgaagtttatatgctctttaaatggatatttgcgaatttcttcatttaaattttaatttaaaaatcgaattattgcgtcagccgagagagagggcgcgcggaccgggtccacgggagtggggccc

SEQ ID NO: 39831 - DNA, 8850 bp, Oryza sativa
aagccgatggaagtgaccccgagacgggaggaagtccggagtgacgacgcggcgaaccggaggtcgacggcgacggcggagagacaggtggacgtcgcgagcacgtatccgatggcgagagcaagcggcgaacggcggaaacggaggagggaggcacggggagcaaatatatagcgccgagagggggagagcgcggccggagagggaggaaacggccgcggagatctcggctccattgaagacgccggcgacgattgcgggattcaaatcggacgaatccgagggagagagagagggaaaagagggggaaacgggagagggaatcgcggggaatgattcccccctcattatggcgcgcggggacggcgggatgcggcggaatccgcggcggcggcggcgctagggcacgggcgagcggcggacgcggcgcgaggagggagatgacaggtgggtcccacccgtcagcgagagtggcgggcgggcccgcctgtcagcggcgcgcgcgcgcgggggagccgatgggccggaggggaagagagagagagggaggggctgggccgagccggcccaagaaggaagagggggggaaaaaagacttttagggatttttctttttataaaccttttcaactttgtttatttcttctcaattattatttgtgctctgaaaattccactaaaatttatttacacattttaggcttttaggaaatatacaaaaatcctccaagcctcatttgacttttatctttgcacattttaattgttggaggctttcacatgaattttaattattctcggcacaattttgaggatgaattttagagtcgttttgggacgcgacaacggtcccaggatatcgagcccccagacagcaaatggccatgaaagtggtatgatctgcagggcctgggccggttgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcactcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcgaactgcatcacccagcgggcggtgtgaggcagctgcgaggggcccgagctggcctcggggagtgagacgggttcgggagccggggtccactctgccacaaaatcggcgagagcttggctcttgatagcgtgacgtggttcaaagtgcaaatcgaactcagaaagttcaattgcccatttcaccacccgtcctataccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggtgccgtcctgggggtcgggggctcctggcatcgtcggacaagcgggcaaagggccaactccggtcgtcgggggccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcagagaccaagaacccgagaagcttgcccgcaggtacaccgaacacgcacttatcagggttcagctttatgcgggcggagcggagactctcgaaagtttccgccagatctgaaagtaaagtttcttggtcgcgcgtcttcacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgtagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagtttgccattcgccttgggaacgaccaccgggttcgccagccactccggatggatgacctcgcggatgaatccggcctccagaagtcgcgccacctcctcgcggatgaaggcttgacgttccggggcctgccgccgcactttctgccggatcggccttgcgcccggccgtacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtagtcttggacgggccgtcacccagggcaacctccttgaccgggacctcgtcgcatgtgatcatcctctgcctcggggcggcgggaacggaggtgccaagcctctcgtcgccaccctcgggcttggacgcagcggcgaggtgatccgcgcgctgctccatacaagcaagcgcgactttgaggtcgccatggacagagatggggccaccggggcccggcatcttcatctgaaggtaagcgtaatggaccgccgccatgaacttcaccaacgcgggcctccctaggaccgcgttgtagggcagacttaggtccgccacatcgaagtttacccgctccgtgcggaagttgacggatccaccgaaggtgaccggtaggtcgatatgacctaacggccatgtgtgccccggggtcacaccgataatcggctgggacggccagagcaccatccccggggccttgatggcgtcaaaggccacgggggaaaggatgttgagggctgcccccccccccccccccgtctatgaggacacgccccaacttcacgttgcaaacggtgggggaaaccaccatcgcgatctgtcctccccgggcaacacacggtgggtggtcggtctggtcgaaggtgagggcaacctccgaccaccgcgcccgacgcgtcgcctcatgagtgggggccgcggccagaagctctcgcttcatggccttgaggctccggcgagaaacgtgagcacacgctcccccatcgacagtggcaatggtggccccaggctcctgaaagcctaggtcatcatcgccgccatcgatgtcctcgacgggggccttctgcttggcctcacttcgccgattgccggagggtaccgccggggacttaccctctcggcgctcctgcctcctctcctcctcccactttctcgtccgctcagccaaacttttgactgcgcggcagtccgcgaggtcgtggagggaggtgttgtggacgatgcaccacttgccggttgggcgctccctgctgggagcgccggcctccttctttttgtcgctcgcaggcctcccctttcgggtggcccgcgaagcgccctcgacagtgaggacatgaccctcgtcgtcggaatgggctgacctcttcttcctcctcctgtcacgtcgccctgtctgagcagcggacccgggggcggccgaagttgccacaccggaaccggaggggttccaggtccaggcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtctcttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatcaaggccgtgaacccacacgaacctgccttaacccaaggcctatgatgattcagaccgaactggcaacccgaccctgggtcccagctcgtcccaagtcaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaccgacggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggctcgggcggctgacggccgggtcccacctggcagccgcgagggcgcgcccgaaggcggcctcgccggcacggccgaaggtagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggacgacggtgctccggcggtcggcgagcgaaacggaggcgcggacgaggtcgacgggaacgcggcgaagccgatggaggtgacgccgagtggggaggaagtccggagcgacggcggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcccgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttat

SEQ ID NO: 39832 - DNA, 4535 bp, Oryza sativa
tttagccattgggctgaacaggaaaagcttggcgcacacgaaagagtatgagagcttagaaaaacacacgcagaaccccctacatggcgcgtcagatgacggagcgtggggctcctcaccgggagaccgcgcaggtccccctttgccggttcggccgggggccctgggtgaggttctaagctcctagtctgtggaatgttcgcgaaagtggaaacacacaagacacgggtgatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctggcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacatcatgcttcccgaagaaaccatgatgaatttatcatggttacaacagaaacatccacatctacataatggtagtactagtattgttctattctgcacgtattacattctgtgtgcggaactcaacacgtactgctcgagtacaatttctgagcagaggacagggaaatgaaaagaatgcctaccaggtatagttaagttaagggtgtgtttagttcacgtcaaaattggaagtttggttgaaattgaaacgatatgacggaaaagttgtaagtttgtgtgtgtaggaacgttttgatgtgatgaaaaagttgaaagtttgaagaaaaagtttagaactaaacaagggttaagaagaaataaaataaaactatgaatatatctgctagtattgtacagttatgctacgagatgttgaattcaaatctcacatactattatttttttttacttagtatgcatctttactacatgttgtttcaattggtactaattaaacatcaaaaagtttagtctcgattactagtctcgaacaggtattaaagatcgtttctcgtgcatgagcaataaaaactgatataacaagaggaagctccacgagaaaagcaaagaagacggaaagagaatctcatatcacctgtgccatggattgatgtcacaaaatcgccgttgttcgctctgaatcgcccgttgacaacctgatttatcgatcagggctgtcgagagggatttatatgcgagctcaacattgtttcgattttccgattaccgcggacggaaatttgtccaccgcgtgtggatccggtaacgggcttcatcggggcttgcttcgatggacggtcaataggagcgggagtatgtactccctaggagtacccattttcatatatatactgtactcgaaaaattggctttgagttgaacctgactcttattttgttcttctggattttaatattttgtaaactattttctcaaagataatttaccaagttgagctatcattcatagcaagatctctcgctgcaacacccagggtccttttagagaaaattgcaatattgggacaacaaacattagggcttcgctgtcttgacactccgagtggatgacaaatgggtccatatgtgtctatgaaatatgtgtccagtatcattatagcaaaggtcaatgtttgcagtgtcattattgcaaatctcccgtcatttttaccccgtttcatagaaaaatattatatcttatgaaattaaatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccgacctatatatgagtccggaggaaacacgtcaagaaagcagagctccgtagcagcacaaaacgcagcgcgccaagcaggccattgcggtgcacgaaccctcgagattcgccaagcagatagatggaggccactgcgacggcggcgcagggactacgggactggtcgtctctcccgttggacatgctcgtgctcgtcctggatcggctcgggtggtcgacccacccgagcttcgcattgacgtgccggcactggcgctccgccgtgtcgcccttctacccggcgtggatcacgcctctcctcctgagcgccgccgacatcggcgtcacgaacgtcaggtactacagcccctactaccacaggtgtttcgagatcgccgacacgctcctcaaggtgcccaaaattgcggctaggatctgctgctccagtggacaacacctcacgctgtgtctacctagattgatcctccaagccgatctcgtagccggcaccatgtatgagctgccaga

SEQ ID NO: 39833 - DNA, 1560 bp, Oryza sativa
gtggtttgttgtatgttcttggtgaagacgggaagatggcggtgtatgatccatgcaaccacgacaataattttacagttcccgataaacctaagggctttggaatcaaacaccaagttgatagccacctgtttgagtccgaccaaggcgcgctcatggctgtcctcgtcggctacagtggtgcgcctatccatgtcgtcaagctcaacgaagagacgatggagtgggagaagatgcggtcattggaaggacatgcgttgttcaccgggacatacacgacaatgttgaggaagactaagcttagattgatgcaaaacaaggtgttcctcccgaggctgtatgactggcctgagactatccatgtcgacattgttacacgtgatggcgaaacagcatttgtaccaaagtcatccagttcgtctaacaccaaggagatcacctcggacataaatatttggttctacgagtttgggcagcaagacgcaagagagttttggggatcggagagagtagattatagtatttgggttgattttagtactaattgacacaaattgacgttgttagctcttatattttcatatagtgaatcatctcacaatgaagttactcttctttcaggccaaaatcaaaatcgacgcaaatgaaatttgatataatatttctttgttggttgaaacatggcgctattaatattatgcactcagccaatgcaatttttgcatgaattgatattgatatttgtgcacagtaatttatgaggatttaagggaataataaaattataggcttggatgattttctcggaaaatttgaatttttttgggagggaaggatttagggtttgggtgattcacaaggatttaggcaagttttgaatttcaaaattcgaaccttgggatttgtaatggaactttgggatgaagtttttgggatatcaaggagagacccaccgagatcttttggcacacttaagtccttgaggatacagaaagatctaaaatttttgcaattaggatttcgttttatacaaaataagttagaaaaataattcattcgactgtgagttgctgaagatatggtggtgttatcggaagacttgaccgaatagccatcactgctaaatggtggcatggatctacttaatccacaaatagactttcccattaaaccaaccatatgactgattactcccttcatttcaccaacatccattatccaatgcatgaatcgatttaaaaccaaaacgtatcacatagagctagaagaatgaggaaaacttcaccaaaagcaaagtagttaacgtacaggtgcaagtagttaacgtacagtatcaatgatactggttggtgacgttggctttcatcatatacttggttatcttcttcttcgccttcttgtcttccgactcacacgtcttagcgtgagccagaagtgggtttctcgccctggccgaagaaggttcaagaagaatcttcttgtagccttttccgcagatccaacacttctttgggtcgaattcctcctgctgacgcacggccacctgatggcccgttgcag

SEQ ID NO: 39834 - DNA, 2316 bp, Oryza sativa
tcgcttgtacagaggagtggttcctggagcaagatctatccggaactcaatctctcgcttgggcggcataccaggtagttcttccggaaacacgtctccgaactccctgactatggggatttctgacagtcctatctgatgaagttctgaacttctgacagaggctgggggtgcaaagaaaacaaccggttgttccggccctcggtacagagtgacagtgcgtctcgcgcaaaccactactccttggaattgagccaaccaattcatcccaaggatcacatccaacttcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaacgaggaacgtaccaacgatgacgtctggagttgtcagcacgtcctcggccgtcacgtgattcacacgaccccgaatgacgtccttgccaccgttgttggagcggggaggcgcttggccttgctgacgccttggcttcgggcatttatccgcaaagtgcccgggctcaaagcagttgaagcacagacgctgctgaccttgagcgtccctgtggccttgaccaggctgcacggctggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccagagactagacggacggacagctcggggtccattcctgccaggaacttctcttgcttctcctcatcttcccgcacatcctccggagcgtaacgggccaggttgttgaactcatgcaaatactccatcacggagcggttgccttgcttcaactctcggaattcccttttcttgagggccacgactccggcgagcacatgggttctccggaaagcggcggtgaagcgagcccatgtaataggctgtccctctggctgcgtagcttggaagtggtcccaccatagagatgcgggtccctgcagctggtgggcggcgaagatgactttctcttcatcactgcactgcacagtgtccagcttcttccccacggcatgcaaccaatccaacgcatccacggggttgttggagctagagaaggtaggtgggcggatgcggaggaactcggcgagtttagagtgttggggaggtggaggtggagcattctgttgtggcggattttggaggtggtggaggaaagtagtcatcatgttggcttgctgggcgaggatttgggtgagaatggcgttggtgtctggtggtggtggcggaggcggaggaggaggtggaggtgggttgccctggtggttgtggttgctgccttcaggttgattgccatcaccggtaacagcatttctcctggtcgtcaccatctgaaaaccccacacagaaccagcaaacagagagagagaagctaacaattaaaactaaccacccacgactaccataattcttaaatttattactgctattaaattggttcattaaagttcaagttgcttaggcaaataaaataagacaggctccgacacagttatgccacacaccggcataaccatgccccacacgactcaacaagaagacaaacgaggaagaacacacgcgcaagcctactaactgctcgtctactgctgcgacgggccagggcggaaggtgagcaacagcgcatcctccgtgctaccaacgccggaggcttccccctcctggggaaccacgggcgcgggctcggcacgaggggtctcgacgaagcaggtccacgccagggactgacgaacaagctcaggcctggaggtgctcttgcgggcggtgatcttctggctgcggcagacgcggcgacgcttggggcggcagacctctccctgggcgatcttgagctgatgcagctgcgcctccaccgcgtcgaggtccttcttgagctgcaggttctcctgccgcagctccaggatcttcatgttgttctcgaccatacc

SEQ ID NO: 39835 - DNA, 2778 bp, Oryza sativa
cttttcttaagagccacgactccagcgggcacatgggttctccggaaagcggcggtgaagcgagcccaagtaatcggctgtccctctggctgcgtagcctggaagtggtcccaccagagagatgcgggtccctgcagctgatgggcggcgaagacgactttctcctcatcgctgcactgcaccgtgtctaactttttccccacggcatgcaaccaatccaaagcatccacggggttgttggagctggagaaggtaggtgggcggatgcggaggaactcggcgagtttagagtgttggggaggtggtggtggagcattctgttgtggcgggttttggaggtggtggaggaaagcggtcatcatgttggcttgctgggcgaggatttgggtgagaatggcgttggtgtctggtggtggtggcggaggcggaggaggaggtggaggtgggttgccctggtggttgtggttgctgccttcaggttggttgccatcaccggtagcagcatttctcctggtcgtcaccatctgaaaaccccacacagaaccagcaaacagagaaggagctaacaattaaaactatccacccacgactaccattattcttaaatttatcactgctattaaattggttcattaatgttcaagttgcttaggcaaataaaataagacaggctccgacatagttacaccacacaccggcataaccatgccccacacgactccaaaaaagacaaacgagaaagaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacggacaagctcaggcctggaggtgctcttgcgggcggtgatcttctggctgcggcagacacggcgacgcttggggcggcagatctctccctgggcgatcttgagctgatgcagctgcgcctccactgcgtcgaggtccttcttgagctgcaggttctcctggcgcagctccaggatcttcatgttgttctcgaccatcccgcggcgtaccatctgatggaagtcgatacgagccgcgtcgtacgcctccaccatgcgtgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagggtgccgatggcgaggagagcggcgctctggcaagcggcggggaaggagtctccacccgcggtgactgccaacgaagcccgctcagaagagccggcgaggatcactgcggtgacctcccacccagcgtggggctccgcgtcgtctccctcctgatccggaagcggcctggcctggtaatccactccatgtggataccccaagaccacgcacatgccccgcagctccaagacgaagccagtcatgtgcaaaccacgacgggtgacgctgccggccatctacaaacaaaaacaaaaagaaaacaacatttaaaagatcagattttggcgataaatgaagcagcaaggcagagagagactagacaattttcacaaataaccaaagatttttatttttgaaaatatagctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaagctgatacaattcagagtttaacaagcggaagcgtaaatagaattattacacgggcagcgaaggcccagcacacaaagacaaacgaaaaacagcggaagactagggcgacgaccacaggcgcttgacagcaggcacgagctagacaccaaagccttcatcttcaaggaactcctcttctggacttgggaaaaattgagcaagactgagtacatccaccgtactcaacaagacacacccacaaatgcagaataaatgcaagggagtacaagggaattataatataaagggttagggttgcagtaaacagcatttaaagacatttagttgctcaaggctattttgtaaacgcgatcctagcactaaacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcgggttttaagaattaaaacactaacttgggtacattgctcggcttgcccataaccgagggcgcggctattcgaatagattaaactctgatcagaggtgtacatctttacccacaagacacgtctttctcacgtgtaaccacgtgccacataccaccacggtatacagacggaagacgtgacatagtttccaacccatcctagccatagacaagagtaccgacccaatcccgcctacggccggaacctccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttataactagactg

SEQ ID NO: 39836 - DNA, 1891 bp, Oryza sativa
gagacttgaacggtccaattccgagttcaaatggccaagatatggccatttgaagtttatatgctctttaaatggatatttgcgaatttcttcatttaattttcaattaaaaatcctatttattgcgtcagccgagggagcagggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaagcgaacggcggtcctcggctcaccccgggacaacgacgacgacggaaacgacgaccgaagcggcgagagacggcggcgcgggtcgggatgacgagggcgacggtgctccggcagtcgacgggcgaaacggaggagcggacggggtcgacgacaacgcggcgaagccgatggaggtggcgccgagtcgggaggaagtccggagtgacgacggcggcgaaccgaaggttggcggcgacggcggagagagaggaggacggcgctagcacgaatccgacggcgagagcgagcggcgagcggcggaaacggaggagagaggcacggggagcaaatatatagcgccgagagggggagagcgcggccggagagggaggaaacggccgcggagatctcggctccattgaagacaccggcgacgattgcgggattcaaatcggacgaatccgagggagagagagagggaaaagagggggaaacgggagagggaatcacggggagtgatttccccctctttaatgcgcgcggggacggcgggatgcggcggaatccgcggcggcggcggcgctagggcacgggcgggcggcggcgcggcgcgaggaggaagatgacaggcgggacccacccgtcagcgagggtggcgggcgggcccacccgtcagcggcgcgcgcgcggggaggagccgatgggccgcggggagaggagagaggggggggagttgggccgagccggcccaagaagggaaaaggggaggaaaaggacttcttttagggttttctttttataaaccttttcaactttgtttatttcttctcaattattatttgtgctctgaaaattccactaaaatttatttacacattttaggcttttaggaaatatacaaaaatcctccaagcctcatttgacttttatctttgcacattttaattgttggaggctttcacatgaattttaattattctcggcacaattttgaggatgaattttagagtcgttttgggacgcgacaaacctaccccccttaaacggaatctcgaccccgagattcggaagaactggcgaagagatcgggatgggctgccttcagctcgtcttcacgctcccaagtagctttttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaatgatacggaaaggacccacataccgaggtgcaagcttccctttcgtctgaaacctgtgtacacctcgcaatggcgtgactcgaagataca

SEQ ID NO: 39837 - DNA, 2493 bp, Oryza sativa
ggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagcggcgggcgggcccgcctgtcagcggcgcgcgcgcgcggggaggccgatgggccgcgggggaggagagagagagagggagggagaagtgggccgagccggcccaagagggaaggggggggggaaaaagaacttcttttaggattttctttttttttataaaccttttccactttgtttatttcttttcaattattatttgtgctctgaaaattccactaaaatttgtttaagcattttaggcttttaggaaatatacaaaaatcctccaagcctcatttgacttttacatttgcacattttaattgttggaggctttcacatgaattttaattattctttgcacaatttcgaggatagattttagagtcgatttgggacgcgacacaagctaacacaacgatctaagacaacgacttaacaagtcattctagttcttccgagcataggaggtcgattgaaggctcgttcggctcatcttcctcatctttgatagctacccactcaaacttggaattgttgcgcttgggttcttcttcttcatcactacttatgatgatgaccggaggatttgctggggcaacttctttctccaccacgcggacctttggcgccaattgatagcgagggacaaacaaagctctcttccttgcggtaagacgaatcctagccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctggggttggcgaggatgatagcgatactcagtgtcggccaactgatcactgtagcgatcacgaagctctcctatggcaatccttgccacctcctgacatgcatggatgtagtttcttcctccagcttcaaacatcactgaggggatatcttcactattgctgttcaaggtgactttgactcggcacttttcttcatgacgatcatgacgaatctgggcataaaaaggagcattcccaaatccaatgacaaaggacatcgtacgcaactcctggacaaaaccttcaactccaaacaggtactcaggcttgtaacacggcatctaaagacaagtgaaaggagagagttaagacatctatccaattaatagcacaagtttttggattaatttgaataaagtttgaaaatcaaagtaaaaaggtaagtaattaaagtaaaccaagctttgcgaaataaattaaaacagttggaaacgagatcataaattttgtaattttgaataactggtttcaaaagaaatgaaagaaaattataaaatcaacatggtaaatttattttattgcagcaagattaaataaaacaatattgtaaaacttttgctgataaatgagccattagtacagtaatagatgtacagtactaataacactggaataaatttttaatgagaaccaaaaaaaaattatgaagtgcatgtgccattagtttggttaattaaaagagaaagggaggagaacagttctacttttccaatatttttagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgtagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaattaaacaatattaagccaacgctatacaacataccctgttgtataggcccaaccattctgaacaaccaccccggctgcacagttctatctccaaaccaggaatgtaccattccaaaccaggagctaatcaaattattaccagttatagcatcttttagggctgcag

SEQ ID NO: 39838 - DNA, 1142 bp, Oryza sativa
cgaagtacgccgccaaccaggggggcctcgcccagcgcctctcggagatggccgggactctccaacggctccccgaggagctcgagaggacgattaagtcatcctcgagggaccttgcccgaggagcggtggagctcgtactggcgagttaccaggccagggaccccgacttctccccatggatggcgctggacgagttccctcccgggactgaggacggcgcgcgcgcgcgggtccaggacgccgccaaccatatcgttcacagcttcgagggttcggcccctcggctcgcgttcgccctcagctccgacgaggagggcgatgacggcggtgtgggcgacagtggcgacgaggctggcgactcgggtgcatcggagtgagcctccaggtccccgccaatctttaaatacgtctttcttcttttctttcttccgaagccttcgggcctcctttttgtatagattaacttactctgcaatcaaaataaagaaatttctgtgtcaatttcattttactgtgtgtatgagaacgaggatgatctgtgccatggttcttttgtgtcttagctcgaacaagggctcgtgcccaggtcccagtcctcaaatggctcgggtcggggctagtgcctggggagatccacgtgtcgagactggccaggccgggagcgtggtgaccgagggttatgggtgacccggttgtgggtttttgccgattcccccccggagttaaccacgccccggggcacggctcggttctgggccccttttggcgattttagccgactcgagcccccgagggcaggatcgagcacgagtgacctatttcaagtcaagattcttcaaaaggaaacaacagcacagacacagcctttaggaaatcgaaaatgcttttattgaaatacagatagaagagaaataagaatatgcatgtgtggtagcccccggccaaccctgcacgcccgaggggggtacggggttggcccgagcccgaaacctgacacccgaaccctattaggggtagaagcgacgaaggtgttcgatgttccacgggttaggcagctctgtgccgtcgcccgcggccagccgaacggagcccggccgggggacgctgatcactcgatacggaccctcccacattggtga

SEQ ID NO: 39839 - DNA, 944 bp, Oryza sativa
gtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacccagctgctcgccgagatgcgcgcgcggatcgacgaggaggtccgcaagctcgacgagaagtgagtggggctgcaggaat

SEQ ID NO: 39840 - DNA, 1370 bp, Oryza sativa
gcagtggtcttgagatatgttgataaatatggaattgtgagagagagatttgttggtcttgtccatgtgactgaaacaacttctgcctatctcaagtcttctattgatgctctatttgcagaactgaagctaagtctaaagcaagttagagggcaaggatatgacggtgctagcaatatgtgaggtgagttcaatggtttgcaatcattgatcatgagggaaaatagttcagcttattatgttcactgttttgctcaccaactccaataggttcttgtggctattgtgagaaaacataaaggcgttagtgatttttttactaagatttccatcttactgaatgtggtgggtggatcatctaagagaagggatttgattagagatattaatgttaaagaaatgagtaaggcattgggttgtgggcaacttcaaactagaaccgggttgaatcaagagcaatgtcttcagagacctggggatactcgatggagttcccactataaaactctcaaaagtttggttggcatgtttgctacaatagtcaaagtgctagaaattgtggaaaaagacaaaaatgattggaaaattagagatcaagcatcgaatcttttggagtacttccaatcttttgattttgtcttctatttgcacctcatgttgactatattaacaatcacaaacagcttgtcactagcattgcaacggaaggatcaagacatagtgaatgctatgaaatgtgtaaagtcaactaggctcaatttggatgagcttagaagagaaaagtgggagaaagttctagatgaagtctctgacttttgtgacaagtatgatattgtcaaattggaaatggaagatacatatattgatcccaagaagcgtaggcacaaatctagaattacaaacaagcattactatcaagtggattgttttaatgatgttattgattggatacttcaagagcttgacaatcgcttcagtgagacaagctctcaattgcttatttgctcatcggcttttagtccaagagactcatttcatgatttcaatctagagaatttgatgagtttagcaaaattgtatcctagtgattttaattctggaaatttgagggaccttagccaccaacttggtctctacatcgctgatgtgagggatgatggtagattctccaacatacaaactattgccgagctttctcaaataatggtggagacaagaaaacatctttgttatccattggtttatcaacttttaaaacttgtacttgtattgcccgtcgctactgccacagttgagaggtgcttttcagctatgaagaatgtgaaaacatatttgtgcaataaaattggtgatgagtacttaagtgatag

SEQ ID NO: 39841 - DNA, 1277 bp, Oryza sativa
ggggggggggggcggccgtacccagccaaccaaccaggaggcataaaccaaaaacaagggtagcagaaaccaactattccgatcctaccaaagcaaagttctactactacgatactagtgctacctaggatcagtatcatcctgcgcatgcagcggtgcacgcatcatcacacatcatcttcgaccaggacaaaattgagtgaagaatcgctggtgtgcagcttgctgccggccgtggcgctggtgctgccgttggtgaccttgtcgtcggctgcgacagtggcagtgggatcaacctcctcgctggctcctcgctggtgttaatggagtagtagttatccacgatggtcgacaacaacgacaccacggtggcttcgtcagcagccatggcggtggtactgccgccggcgacgacagcggcgtcgaccttgacctcatccgcgacggtgttgttggcgctgggagtggggacggcgagctcgccgctctcaaccctggcactgccgctggtgtagacctcgtcgtcggtgtggctggcaacgatctcagcgtgccccctgggattgtagctgtcagccgtggcgttgggatcgacctcgtcgctgtcgaccgtggcatcggcgctgccggtgctggagtccgcgtcgtagcccataacggtgggcctggcagtggcagcgtcatcgacgccctcgtcgcttgtgtcgctggcaccagccggcgcagcactggtgctggcaatgttagagacggcagtgccaaatccagcgggatccaccagctggtactggaaggcgccgggcttgaactgaaccaggatgacggtagtgttctcgcccgatgccaagccgaactcaacaacctcctcacagatgacacgcagctctgcaccctcctgcatagcaatattaattggtcacagcattattggtaacagcagttttaacagcgaaagaatcgaagtcaaagcagatggcagtttgtcagccaggcatgcatattcagtgctaaactaacaaatggttttgtgaggtttagggcttacacagtttttttttaaaagaaaagagaaaatcaggatatttacattgcttgattgaagtcatttcctagaacagatagcatgattaacaccactaagatatcttgtcctgccaagaagacaaactgagggaaagaaaagactcaccaccgataaacggtcatgtatgtaagaaaccacgtccgcactgtccacgcaagacctgcagggggaaaatatacaggggctgcaggaa

SEQ ID NO: 39842 - DNA, 1780 bp, Oryza sativa
  unsure (1)..(1780): unsure at all n locations
ccatcttagctctgtggtgttcatatacaacagtatgaattggggagacagaggatacactaccatcctgcttttgacatcggactctccagtcttgtcgaagtgtcacagagttcagaattgattgaagtaatctcttcacttggccagttgttgcttgatgggctgaataaatattatcaattatttgtaatcttgtcaaggacgacttcagtgcaggatggatggtgataaatctttgaaactttcttagcatcgcactgccgtacctcagatgatcaatgtaatttctaagtgacttgtcaagatgcctaaaaaggcctggccatttaccacctacctcatactctggaagaacgtcagtagcaactctaagaaaatcatgtgcctctgttttacatgccgcttgataagtacatggcaaatcgatcttaacatccaacgagtcactgaccataacatgatccaaatcccaatggccattccaagatctacctcccttatgagaccttgttatcattgtcaacagattggttaaaatgattctccaatctgggtggtatctatcactggcaggaaaaaaccatcacatctaatatggcggggcttggtcagatgatacccacgtagcttcagaaatgtcctcaacggaatccatctgcaaatatagtactctattatttattcctaataatgttaacatcaagccattgttattgaccaaatttaaatggactcaagtaaaatacctatccggtttgggcatgtcacatatgcatattactggattttcacaatgaaaacctggtaagttcaaatcatgaataaatgtgcgcacagcattttcaagattcttctgaatcctgcaaaaaatatagaaattaagacactgactctcatatgaagatgatctaggacaagaaagtcaccttgggtagcattggcacaagtcatgtgcgagttcaggagcataactccaaatatgatcgaaatgtatgtgcatctcaggagagctcagggtcttcatagaatcaacaattgctccataatatggtatattgttccgctcgaagctgattaaaaaacagatcagatgctgctttgatttcataagccataaaacatatttcctaagaatgatagatttttaccttcttaaaaagtcgaggaacatgtgttccagcttttggtcttttccactcatgaaataagacgcaaaatctgctctcactgttccaggagagggaggcctggtttctagctgcgcattggtgggtgatggccttggcttaacactggagctgctaccatgttctcctgccatacgggaatgccgtactggaggaggaccttggcttgactcaagtgacgagcttacgctctagaacagagaaaaaaaatgatgaaggcattttgctagatcaaatcaactagatgaatatattacatggttatagcaatatgagtgtttacaggtaacatcaaaaagaccgtgacaatagaagtggctttgaacacagtagatttgccactaaaatcctacaatcaaaggaatgcatatttctagcaacatgctgaagtaacatggcaattctacatttagaacaacaatgtgctaagcatgggatagcagttaacatttaaggcaacaaaaacgtacatgatgctgggtttgcctggcactgtgaggcttcttcttnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39843 - DNA, 11063 bp, Oryza sativa
  unsure (1)..(11063): unsure at all n locations
atagcaatatgagtgtttacaggtaacatcaaaaagaccgtgacaatagaagtggctttgaacacagtagatttgccactaaaatcctacaatcaaaggaatgcatatttctagcaacatgctgaagtaacatggcaattctacatttagaacaacaatgtgctaagcatgggatagcagttaacatttaaggcaacaaaaacgtacatgatgctgggtttgcctggcactgtgaggcttcttcttaaagctttgcttagcaccttcaaaataattgccacttttcaacacagaatgttggtcccttgagattgtgatatcatgaaccaacacaccgctttcaccaggctaattatttttaaacaaaaaaggtcagtaattaaaaaaatgcactgcttaatcaaagaaagtggcagaattactaagggcttacagaatcaacagatcgccaaatattttggtagttccggaagcccacatctgattccagaacaaaaaatcttccatggtactgaaaagaagaaaatagaatgaaaactagcataccaagcttatttaaaaaaaggcaggtatcacaactcgtaaattacaataccttgtatacaacgttgaagtgctcgttttgaaagaaaatgaacaacttcctatcaggagttgctgctttcaaagtgtgtaaactgtgattttaaaaaaaaatgtcaatagaagaaacaaaatgacaattgtatttacctatagctagcatgcatacccaaactctgtgacttgtccaggattatctttcaagaacgtgtgaatcaactcatctacaaataaacaatttaaaaacagagcattagcgatcaaagaaagaaacatatttgcatccgtaaatagttgacaggtgaaaaatgtaagatcgttacatcttctagtttcagcagcatctatcataaaatcagcatctttctttgagttgtatttagccctatcgatattcagctgattgtatgaacgtccatcaactgcattcaataaaatggtgtcttcctgttcacaaacataccacagaagaaaaaattaggcaaaacccaagaaaaaaaatattaacatgactacaacactaaattaatccatgtaataagtagccatggttcaatcatactaaaagacatctccagtagcatacctgattgttcatgtctagtacccaggcatgatataaagggatatccaggattctaaaaagcccatactgaggggtgtcctcaaacccgtcgacactgcgcataccaattacacatcaaaatatacaaatggaggctatattattgcttaagaactcgcttaaccacaaaccttgtgcaataaatatcaatatctagtcctgtagccgtttgttccaccgttgcctgtgcagttttatagctgtcatcctacacattgcaatgtgattaataatcttcaattaaaaaaatggaatatattgttttgataagtggatcagatcgaaccttcattttgctgaaaacttgactaaacacacggtcaactaaataatctaggtaaacaattgtcatggatggtggcaaggagagtttcctggtaaggattagataattgcctgcaaaacagagtagttaagctacatgggacagtttatcagcgggtatagtataaacaacaaacaaaatctcacatatggctatcaaggagcagggtccattcttggactggaggatgatcttatacccccggcccagaaaggatatgagttttgtttcacaaaaatctctgggcacacgaggcacttgcggtggaggcaaagtgctctcccctccttcatccttctgtacacactcctcttcggtctcctcctcctcgccctcctcgtcctcctcatcaccctcctctgcggagtcaccagcggtctcctcctcctcgccctcctcgtcctcctcatcaccctcctctgcggagtcaccagcggtagagaaggacagcgagcggtcaacctcgaagagctgcgaagctagccggccgaacaactgcgggccggccaacatccggctgacggacacctgaccgatcggcttgaaggcctgaccggtgctcagcctctgacctatgtcgcggaagggagtgatcagaagccgcggcggtacccgctgccgaccgggcggaggatctccccgcggtggaacctgccgctgccgaccgggcggaggatctccccgcggtggaacctgcccctgccgatcgggcggaggatctcgccgcggatagttggatcccatcgtagagaaggtcttctaggggagcggtgggaactgaggctccaccctcgccgtcaacctcgacgcaagcgcgcgccgacgctcccccgtccgaccgagcggaggacctcgccgcgaccgatcttggcggcggatctcgcgaatgtttttttttttctttttcttttttttcgagaggaactcgcatgaaccctaaaccctaggaggcggcggcgtttggtttgaatggtggagttggctcgagtggaatggcatgacctattagggtagtaggtgcgaggaggcgactgcagtctactgaagtcggcctgtgggctgtggtccgaacggaccaagacggcccgcgtcttggactacggagtgttcagttgagctgcaagttttacaggatttttttattattgtttttctaaagatttataaaaattactctaatataaattatcgttccaaagttttgcaaaaatactctccttcggcatataaatcaccctacaataagaccatctatgtgacgtggcaccccgtagaaggggcacatcgcgacaattttgcaggcctcccgttgggcgatttatcgtcgggaggggccacctgcaaaattgtgaaactttgaaatgattttttttacaatagggtgggaggagtatatttctataaaacttcaaaatgaaataaatataaatattaaaaaaatgttttacaaagagtaaattttacctagactcatgtattattatactttaagttacacaagaccacactattgatcatttcgacttttatttatcacagttttgaattctacaataacatctcaaatttatgtgttctttattcatcatataaatgatctacatccatgtaactatagccttttaaaattttgatatgtgaatatgtcaaactgattagtgacgtggttttatggaacttggaccattaatatcttaagttatatgtcacgtgccaaattttatgtggttttgtgcaactttgaccattataggtgaggttttgtaaaatttactcttacaatctagccttctaagaaaaacttactccgtatttcatgaaaataccattagtaagacttatttctggaaatgtgttgatacctcggtgccaacgttggtatcttttacattagatgataccccacacgctgctacaggtttattattataatttaaaatacacatattagtatgatctattaaaatactaagctgcataaatgttataatttgaacacaaaagcggtaggaacacgctgctacgggtttattataacaactagttgggtgcccgcgcaattgcgcggctagcacccatacaaaagtaaatatttttatatgattttacttaaaatttattaaatatttgtctcgttgtcttaagactttgaaagaccaaaccttatcatccatgtgtttctaattttataatttttaaaagtcacaccagttgctaccccttacttctgtcatatcattttttatttgcttgcttgatctaccattgtttatatttctttctccttgaaacctttacaaattggatcttatagcttttagagtttattgtccagttgggtcctctatggtccgcccgctaccccttatttttattgccaataggattttaacaatcgaacaaaattatcattggggttctttttctttactttctagaagttcggtcaaacagtcatcagctccaccactgtgatcctctatggcccacccgctaactcccctcgattttaaaaatcgaacgtaattatcattggggtttacttttttactttttaaaagtccagccaactgtagtgaccgtgctatttaagtatttaacgccatgctcgtcgtccctcatcttaattgtcattggatttctatttgagattttgtttatagtttttatatgtctcatcatgcatcatcaccctactcctctattaacttattgtttttccctctttattatcatttatcattgttgtgttctatatggacctttttttaaagaaaaatcatatttttcattccgatgttctgttatttataaattttattcatacttgcactcttatataattattttatattttcaaattttattttatttttattttgatttttaatttatctcgtgatgggttctagatgatcttttctttcaacaatcttttctttaatttcgaattttggttatttataaattatattcctatttgtactcttctttttcttttttaattgtgaaatttattttattttctattaatctcatactatgtctatatgaattattcttctaatattttttattttttattcctaatttcagttgtttgtaaaatgtatttttacttgaactcttatatttgatttttctaatttctaaatttattttattttttattatggattttaattaatctttaattgtgttcggcatgaactcttctttcattttttattgtgttatttcaaaatcaaataaaaaatccgtgcacatgccgtcatgcttttctggttgctgacgtgcatcacccaaatccggctcattgtgcagccgcacggcttgacccgctgcttcggatttccgtcgctcgttgctagcatctatcttcatatcaacaaaaacgcatccaaattacggttctacagtggttcgttgtctgctacttcattaatatatatgtattatagcctaatttatctagaacctaactctggttaattggtttaggaaatcggacaaaactcttttgagaccgtttgcatgtaaaggtcctagctagagattgattctaattctgcacgcgtataataagatagatagattgatagatttcaaatacacatattgaacacgctgctacgggtttagtatatatgaacgatcttcttggcaaagatgatcgttttgattggaggatgacgtaagatataatgtacatagctgaagatataaatgtcaactgttcataggacgatggtgtaaaaggagacaacctggacgaaagcaacaagcaaaaaacttcaaagaaattataccgcttgctcaaatgtgttcactcttttatttttcttcggtggatatccttactgacacgtgtgaataattatatgaactgttcaaaggagaggatggtgtaaaatgaggcaaacctggatatgaaaacgacaaacaaaagttagaggtagccgtctgaatgtgctagctctttattgttctttcgtggaactcctcgcttttacctatttacgataaatctgatgatgttttgagtgggagggacaatggaaggaaccagaactccttttccgggtcggccaaatattggcaggccaatctcattatgattggaggaaataaagttttaattataactatatgaaggatgtcgcgctggtctcaaacaaacttaaagacggtaaggaaatagaaaacaatgtggcaagccccgcctctgagtgggattactcgccaggctgggaaaagatccctgctgccctccaaactacgatttccttattgatgccgtttgctagcaaatcaaccgacttggcgatgtgctgaaagatcctaacattccgctctctccaaataagccaacaaatgagcatgaacaaactatcgaaatctgtcctgtagccgttctgaaaatgccgtcttgtcgcgatccaagtggcctgccatcctccgcaggaattgcaatgttaatgttgcaccaaagtcttagcttacaccagaaaccagaaaattgggctgctagcttagctcaattttgtttactcttttatgttactcatggaactgctcactaacgctcaattttatgttagtatgttagctgtaaataagttcttaactacctctgatgagtatgatgaaaaaatactattgctgagtaattttcatccaacaacatagcatatcatgtgcgttgaggaatgaggtggtaatggataatcccatcccattcctcaaaccaaacaactcatcaagaatcaagtgatgaattaaattcattatctcactcaaactaaatgctaggccgacattccaaaaaaatgacttttgtgttgaactcaaagcaaacaatcactggcaatgtgcccaaatactcgacaattgccgagtacacaacggatgcaaaggtaagtcaagatacataaataactcacattgcatctgtacctttattatagatagattcatcaaccctccctccagcaagcttgtataatgcaacaaagcaacccccaaaggttttgatcacaaaactatatatgcccatcaacagtacaactccttaaaatcccatcaagataacaaattattgggcctataatactcatccgggcccactgcaatccaggtcactggtggacactggggttcacaccttctacttggtggtttctgcctactccttaggttgtccaactcttgtatctaaatcaaataaagtagccagtaaagcaagagttagtacccttttcaatgaaggggaagagcattcatgttgtccgcaatgagtacaatagagaaagcaaaaacctaaggctaatactagtacataaaactattcaagttggctttggttaatgccttattacttgttgtattctcttgtttggaaattggcatggtcccaatgtactttgattattactactttatatttaaatacatgctagcaaaatatatagaagcataattaatgataaggaaatagaggtggagatgactatattccgttgacaaagttcaggcctcattttccaactatggttagataccgaagggtttttcttaaactcacaccgaacagtatactgtgtaatgtctcttggtactgctctggcattgtattatatcaacatataaagcttaacgtcctaaacgaagttcactaagttactgtgttctaatcttagtttggttgacgtatatatcattcataccatgctaaacaaagattgagctatggcaatttactgcccatatgcacatgatgctgaatttgtcagggatctgcaaataccatttcttggatgcatgtatatcctctataggttagtaaattgtcaagaaaaaaaaacatttccatacatttaagccgttttacaaaactgaaagttatggattgtggtctattttatactgcaaattagcagccttcctattctctggataaacaaccgacattatatttttttaaagaaattaaaaaaataaccaatagctgcattaaattactgcaactgttcaatttttttggtgttgctttgcactatcatgatcatcaagagttaaatcacagtgcagcactgcagctaataaaaacccctatgatcccaccttactataacttgagaccggcttgcaaataacattttatcgatgtattaatctttgtcatatagtataaacatatacaattgacaagtaccagagcacatgcatatgatagcaaggagaggtaaattaagtacctgcagtaggagtgggatgtttggagatggcagttgcgagatagcatctcatggagaagagggtgttcttttttccgtcaagcttggccgctccttgaatctccttcttcctgacatcaagggcgatcatcactcctcccatatcacaatccctgttggcagaattgcacaagaggtaaacaacatcatcgtcgtcgatgctcaaggcggggtaagacatagccaggcatcctagggacaagctggaccctttggcttcctcatcatcgctggtgctgagcatgagtgtggagattatgggtaccccatacccacacggcatggttatccgactagtcataggggatagcttatatctatggaatatttaaccgatcatgacttgggtattacgtttccttttatattatgaagcggcctaaagtcctgatttgataatattgtaaaatagatttaggaaaccgataccgtattggttaaggtttctatcttgtaatcctgccccccatcctatataaggtggacaggaggccctctagggggcatgacacaaactgatcgtcagatcaatatacacccggcgaattcaaatccccaaacaggagtagggtattacctctcatcgagagggcctgaacctgtctaaatcctttgtctccgcatccatccacttttaggtctcgtatgctacccccttttcatattgccgaaaatttgtttcgacagttggcgcgccaggtaggggtgacgccgagtttcctatcaacgagtgcgatggaaatcaacttcagaaagaaaaaagatcaatgtcgatccaattagcaacgtcgccgggcgtttgcacgttcagcgctgatgatcatcttggcatgcatggatgcactggtccctggattctcgctcacaagatgtgtgtgcgtgctgcacgccgtgaagccgccgactgcttgccagggcaaccaatcatgagtgtgcatgcagaccggtggaacgataaagaagcttgagatcaagatcaaccggctagctcgtggccataatatttggcatcatcacatatatcgatctatacaactattacctggtttggctttccactttaattttatttagattgatccctaatcacatgttactctacgttgttttctctccttgatttcatgcatgtactgctgagtgcgtggtgatgtcatactgccatcatgctatcacggtgatgatcatatcgaggctgaagcggagtacaggacacaagtcgctgcgcaactcgccggctgcatgtcttgatccatgcattttggacgtcacgttactctatacggccgtcgcacgttcgcatggtgtcatgatctccaccaattgcggcctcacgcgctcatcaatggatctaacaccgatgactggattggattgtcgaccatacccactgacggccatatccgtcattgtcgaccgggcagatcacacccctattaaattgttcagatatcgggttagctgttccaattcatagattattaaaattaatctttgatttatttatttttttacagatcaatctattatctgtatatatttcctgtcgtcgattcggccgagtcctttgaccatgcagttgtacgtcgaactactcgctgaacaagtcgatggttatacaagtcctgtacagggacggcagctgccggacagaacgaggagccaatgaaccacatgcaatcgtgcatgcgcttttgtgcttatggttatgcaggcctctctatcaagtgccaatcaagccatgtgtttggatctattgattattatatcagttatttttttttacaaatatctaaccacaggttgatgtgcaatttcttgtctttgcatgtatcatcgcctgtacttcatcactgaccggctggcctttgccaccgccaactggtgtttccgcctgcacggctggcctattatgccgtcgttgttgggcgtctacgacttcaccggcggcttgcctccgtcgccgccgattggtgtcctcgcctatacggttggttggtcacaccaccgttcatgggcgtccacatcttcaccgaccggctggccttcgccgccgccgactagcgtttctgcctgcacggctggcctattatgccgctgttgttgggcttttacgacttcaccgccggcctgcctccgtcgctgccgactggtgtcctcgcctatacggctggtcggccacaccaccgttcatgggcgtccacactttcaccgtcgatcgccttcgtcgccgccgacgggtgtcttcattattattgatggacgactttgttcccacattggccacctctgccataatcaaggggaatatgacaaagctaagtcatcatttattttattctttatatgatattttgccttttcctttgcctcactacatcaactggttcgccgttgactagtgagtcgggggctacagatgttatatcatattttttaaacaattttcataatatttatcttgattgcttgcgacatattctgaatacaaaagtgcctatcgagttatggagttccatcttcctatgctttccgtttggtttgccaatggatagttgcctttgggccgattcctagcacctaggggcttgttggatggaccgaataacgcaaggtgctaagtattattcggaataaatcaaaagcatagagataagataatttattttctgctcttaataattgcaaaagtacccgagtagtaaactccgacccatgaaactttgttccattaatgacgaactcatgtcactcatatgcatgtttgggaagtgcttaggccgactcccggtgcttgatggctatgactagtcgggcagagtgtttaaacgtaatgagtcatctgctcgggggaatcaaaattgacaagagaagaaatacatatttataaatattttaaaatacttgaatttttctcgaagtattatatttacatcagatactactcatcctatatgttcgttctgcaggatccagatccagatatgcataaaagggattcatggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39844 - DNA, 2073 bp, Oryza sativa
ctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcatgggcggcggttcacgcgaacggacggccgagattgatccgatccaaatcggacggctgagattgatcgagtccacggcggttcacggcggacggccttgatgacgccagcaatgacgtcaccgacggcggcggcggctcggctcggcagacggctcgggcggcgcacgctcaccggcgaacggcggcgctacggcacgaacggaggacaccaacgggtagcggacggcacggcgaacacaccgacgaccaaaacgacggcggagaagcaacggacggcgacggcgacgagaaggaagcggcggctaccttcgggttgtcgacggcgacgaagctccagcgggttccgacggctgcgaaggggcggacgaggacggcggcgacttggcgatgacgacggcggtcttcccgagcggcggcgacagctggagcgacggcggagcacggctgaagcggcggcggcgacggcgaagctagggcacacggcgctagagctactccggcgacgagaggcgaaggcgagggctgcgacgggtagaggagacaccgggggtccttttaaaggggctcggaggcggcggcgaaggcccacggcgacggcaacggcgaaggaaactcgcggcttggaaagagggaaaaccgatccgaatcgaactcgattccaaagctttccaaagcgatttaaccaaagattccaaaggagaaaaggtagaggagatcccggagatcatttcccctctattgattcggccggagaaggaaagaggcggccggatttggaaagcggcggcgacggcagctcggcggcgcgaaactagggtttcggcccgaggaagacgacgactgacgggtgggccccacctgtcagcggccgaacgcgcgcgcgcggctgcggactgggccggctgggccgaggagagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaatgaaattttatctggcccaattttatattggaatttattaattaaacatagattttcttttcaagacttttaaaattatttctaaaaattccatttaaacaacaatttatatattttgaattttcagggtgtgacaaacctaccccccttaaacagaatctcgtcctcgagattcggaagaactggcgaacagaagcggatgagctgactttaattcatcttctcgttcccaagttgattcttcttccgagtgattactccattgaactttgcagaaacggataactcgattcctggttcttctctcatttgtttccagtatacggattggtttctcaacataagtcaaatcctcttggacttctatctggtcaatattagcttcttcggtaggtacccttaaacactttttcaattgcgacacatggaacacattatggactcctgccaaggattgaggtaactccaactgataagcaacctctcctcttctgctgacaatcttataaggtcccacaaaacgcggtgccaattttcctttggtctgaaaacgatgaactcctcgaagaggcgtgacacgaagatacacataatctccttcttcaaaactcaaatctctgcggcg

SEQ ID NO: 39845 - DNA, 1271 bp, Oryza sativa
gctgtatgaattcacggtgatgtcgttcggtttgaccaatgcgcctgccttcttcatgaacttaatgaataaagtgttcatggaatacttggataagtttgttgtggttttcattgatgacattctgatatactcacaaccagaggaagaccatcagcaccatctccgtctggtgttgggaaagttgcgggaacatcaattgtatgccaagcttagcaagtgtgagttctggttgtccgaagtcaaattcttagggcacgtgatatctgcaaaaggagttgctgtggatcccgaaacagtgaccgccgtcaccgattggaagcaacccaagacagttacccaagtccgcagtttcttaggtttggcaggatactatcggagattcatcgagaacttctccaaaatcgctcgacccatgacacagttgttgaagaaagaagagaaatttgtgtggagcccgcaatgcgagaaggcgtttcaaactctcaaggaaaagctggtttcctcgccagtgttaatcttgccggatacccgcaaggacttcatggtgtattgtgatgcttcgcgccaaggattggggtgcgtgctcatgcaggatggtcatgtggtagcctatgcctcacgtcagctacgacctcatgaaggcaactaccctacacatgacttggaattagccgcagtagttcatgctctaaaaatctggcggcactatctcattgggaatcgctgtgaaatctataccgaccataagagtctgaaatacatcttcactcagtcggacctgaatcttcggcaaaggagatggttagaactcatcaaggattatgatgtgggaattcactatcatcctggtaaggccaacgtggttgccgacgctctaagtcgaaagagccattgcaacactcttaacgtccgtggcattccacccgaacttaaccaacagatggaagccctgaacctaaacatagttggtcgtggatttttggccgcgttggaagccaagcccaccttgctcgatcaaatccgcgaggctcagaagaatgatccggacatgcatggactcctcaagaatatgaaacagggtaaagccgctggtttcacagaggatgaacacggaaccctatggaatggaaatcgggtatgcgtcccagataacagagaacttaaacagctgatacttcaggaagctcacgaaagtccttattccatccacccgggcagtacaaagatgtacttagacttgaaggagaaatactggtgggttagcatga

SEQ ID NO: 39846 - DNA, 2080 bp, Oryza sativa
ccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgacacaggttttacaaaatgtgtgctgctacagctcacctagcaaggtcctgcaattcgattacccattgtgtgaccaaagttataggtttatcaactggaaaattctgtggatgcttatcaatccagtttcggagtaattccttccagagatcaatttcctcaaatatatgcaccacaattatgacattacagcggctgaaacattgtccacataaccaatagttcactatgatatcttaatgctccatttctattttttgtggcagaattactgctccatttcggcatacagtcctttgtgattgcaggtcaaaacaaaaactcaagacttccccattttttttatcacagaccccttccatgattattagaaatcacacatcattgtttatgccagaaccaaaaatagcaaatgataaaactactagtaatttttctcagatggacgaaataaaaggcctaaaattagcacagagcttcacctggctcctgaagggttcgtccacggtacctacaagagaggccatcagacaccccaagtgacggcgaatgagataaatgggaatagggagcatgtcggattaggattcggagcctcaccggctacggcagcggagtcgacggggaagacgagggcggcgacggcgtggatcgcgcggacgacctcgccggcgctcgacgcggcggcgaccgcgtcggccgcctccgccaccttgtccagtgctaggtcttcgaggcgcgcgccaccatggccgccgccctgggagcccgcagccctcgccgcggagctgcttgggttgctcgccatgggagggtgaagggaaacacacgacgaacctaagagagagcgcttgagaaggggaggttttggagcaagagtaattagggggttttgtttggaggagaaataacagttttacccggcttgactgccgttggctaagataaaattttggggtatgtttgagaatatcaaaatttgcaaatgaacttttgttagagaagatgtgtttgagataccaaaaaaataattgaaggaattaagaatgtcgaatgtcaattgtacttttattcatgataccagtagtatattactcctattatttctaagtttttttataaggatagaattggagctgctaagagcaagtttaatagtatagccaactactagctctaaatcatctatagtcaatctactccttccttcccaaattgattttatacaccaaaaccaaggataatttaaatcacatcaatcaatacaacatacacacattctcccaccatgcatcgattaaaacctcatgccacttacaccatagcatgcacacattcttccatgctgtattaactgtattctgctgaaatccgtgtccatgcagttatatgatgatcaatttaagaatttttagattcttttacatgatgatcaatttgggaaggattgagtaatagtaattcatacaatagttaactagaaacatataccacactattaatatctggtcccacatgtcatactcacattgcctcttgg

SEQ ID NO: 39847 - DNA, 2793 bp, Oryza sativa
tcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccctcgccacacgcgctcgctctcaaacatctcttcttccggcgtcatggcacggggctctgctccactcgatggtagcgtgctgccgctttcccgcatcgtgagcgagaggcaggccgggctgccgcgccgcttcctgccggaatctgccaccggccaggagatagttacgctgggcgagggacgcccggcgccacgctacccggggcggaccgttttcttcctccctttcgcaatggcagggctggttccgctattttcttctttcttcatggatgttctggagttttacgatctccagatggcgcacctcacccccaacgcggtaatgacattggccatcttcgcgcacttgtgcgagatgttcatcggggtgcgcccatcccttcggttgttccggtggttcttcaccgtacagccggtgtcgccgccgtcggtggttggtggctgctacttccagccgcgggggccggtgctgaaccgctacattccttgcgtcctccacaagaagtgggatgactggaagagcgactggttctacacccccctcgccgacgaagcgcgcctccgacttccgaaccagcccccggcgcaggcctccagctggcgggcgccggtagatctgggagatggctacgacgccgtcctcgaccgcctggcgggcctgcgatcccaggggctcacaggggccatggtgtacggcgactaccttcgtcgccggatcgcaccactccagcggcgcgcccggggtgcctgggagtacaccgggtccgaggactgtatgaggacccaccggggggtcaaatgggactgggtccctgaagacttcaaggtaatgatccaacgggtgctgaatctcagctccgcggaggcatcgctcatcccccaaggagtcctccccctctgcagcgatccagatcgcgccaccatcctgaccatcatgaaggcggtcggggcctcagaggagcaggctcctcgaggccatgatggcgcgggcgggagctgcaggggagaacaatctaccccaggagggggtcgtgcttccgggctccgtgacgggggctcggggggctgccgccctgccgacgcccgagggaagaggaagcaagagggttcctcctccccatctcctccccgagggggcggggcggcgcgtgtcagcagcaggcgcccggagggggccgcgccgacgccgcagcccgagggggagcggaagaagatacggcttcgcaagatgggggggacagaaccatcccggggaaaccttatttcccctccaaggtagtcgtttaaccgaccccctcgcaggttcgtcccacgcccattgtggctgtattcattctcccaacgcgagttttcactcacccatcttgtttgtcttctggtctttcttctgtttcagcgagatctcgtcgcgtccctcccgccattccaagtccggccagtctgaggccgaggatacggcgaccgcggaggcccggaggcgagaatctgaccggcgagaagccgcggatcgcctacgggaagccgaggaggccgcccgggaggccgtccgggctcgccaggctgaagaagccgcttgggaggaagccagacttcgccaagccgaggcggcgacaacttccgaggcagctcgcgacgaggccgcgggcacatcgcttgggcccactccctcgggcaacactcaggacaagccaggtccgggggacgtccccgagcccggcacgtccatcggcgggccgggccgcgcggcatcctcaccgaggcggctctcccccacgccttccgttgccccactgagcgcagagccccttttgcaggccttggccgtcgcaaacaccacggtgttggacgggttaagtgcccagatggaggccctgcaagcagagcgggcggagctcgacgccgcatgggcgcgcgtcgaagaggggcgacactcggtggaggccatggtggaggtgagccgcaaggcacaccgccggcatgcctcagagctcgaagcccgtcggaaggtgctggaggagatcgccagggaggtggagg

SEQ ID NO: 39848 - DNA, 1061 bp, Oryza sativa
ctgtcggttacaaaaaaggtcctgtccaattctgttttcctgctcgatgttttggtgcaaccatctactgtttcagttcctggaagttatcaagctaggaaacaccagaaactaccaagatacactggtgcaccgtgatctgttcctcttgcaggtgacttcttgattcatgaaacttatcaccagttgaagaatcattttcttttttcctctgtaaaacttgtgttcttggcctgattgcaatggcagatgtacaatggagtagaggagagcagtgcaggaacatgttcagagctaatctttgcacccatcgatgcatcgttcagtgatgattctccgctgctgccttccggtttctacatcatccctatcgattctcctctgtaagtaaatctcacacaattagataatacactagcatttcgaatcaaattttctaaaatttttatgctataaaaaacataattcttctggattttctttccttgcaaatgttaggacacatctagctcgaactgcatgctagatctcgcttccatgctcgaagcagcgacgccatggagcaggatcagcggcatcaatagcagcggcgagctccaaggcggtgatgacgatcgcgttccagttcgcgttcgagagccacctgcagggcagcgtgcccgccatggcgcagcagtacatgtgcagcatcatctcatcggtgcagaggattgccgtggtgctctcatcctcccgcctcgtccctcccggcgttgccgccgccacgcagcacgcgccggcgactcggtgctgcccagatggatttgccagagctataggtttgtggcttcgcagctgcttgtaatacagttcatatctgtaagattttttaaaaaaaaacagttcgcttttcagaactcatgatgctttgcttatgcagatttcattttggagctgaactcatcaaatctgcagatgccaacagcagcagtgaatcggttctgaaagcagtttggcatcatcccagtgccatactctactgctctctcaaggcttcttcagcctctatttttctttttctg

SEQ ID NO: 39849 - DNA, 2876 bp, Oryza sativa
catcgtaaagcagagcagctgcagatcatcctgtggtgccatccgatccatgttggtgttgatgctgtgatgctgttgaaggcttttccatcttttgccgcgttgccaaaattttgaattttgaaacctgattctttttttttaacaaagtttgtttttcagcatttggcttttaaatcgctaagtacgtaactagaagtttatcatatttttttcctaattaagccagtattaggacaaccaatgtttccaaaatactataaggaagtgaatgatttaaattttaaattcttcctcgcaaaatagtacaatagtttatagtatacttgtttgattaatcatctctcttttattgtcttaatccaagtaccctccaccccttctccatggctcctccttaatctcttctcattatattatgggggtggtgccatggagacagtaactagaattggacgatgcgtctgaacagaactctgaaataaagcaatttttttttcatatagtatagttggtccgattacaaaaaatatgtagttcaaactttaaaactatagtgagatacataaatttgttcatgtctaattttaagatttaatttgagtaatttttttaagggactctagttgacaaacagctgatttctcttatactcccaccgtcccaaaataagtgtagttttgcactatttacgttcaacgtttgaccgttcgtcttatttaaaatttttttatgattagtatttttattgcattagatgataaaacatgaatagtactttatgtgtgactaaatattttcaattttttcacaaattttttaaataagacggacggttaaacgttcggcacggatatccacggctgcacttattttgggacggaggtagtaggtttcagcagtttttcttgaccgtacgatacccacgtgtcgcccatcgctcttgtcacgggcctgttcagaatctcgttttgttggttgtagtagaccttgctacttttgtggcccacaagccacagtccagaaaaggaatgactttatgccgactttgtataacatccctaatctaatattagaaatctttaccccttaattatatacccgtcacaagtacaagtagaatgcatgtcaatgagggtagaaacgccatatcgtgtgcctggctaggataagacggacggaaaacgatcgagaattgacggaagtgttaaaaatgggaacggggtgaactttgggtgctattaaagtgaaccggtatctttcggtgctataaatcaaaaaacgtgaactttcgatactatataaccaattttgccttattatataataaaaccgtataatttgggtctctgttttcgttgagtcagcaaaataaaaaaacaaaaagattatgaggcctacatgtaaatgaggtggatggtgggagatgggggaagagaagaggtggcggcggcgatggtcccatcctcctaggtcgaccgcgactccgcgagaatggtagatcggcagcagcacgcgcacatccgacacagcgccatgggtaagctcccgcggcggcggactcgtcgtctacgacactgctctggcgggtgcaaacgcacgcgcccggcccaactccacccaggtcgttggcttccaactccacccaggtcgttggcttcctcacgctcaccgtcctcctgctcccgaccaggctcacgctcaccagcaccgtcgtcgtgctctgcccatcgtgctgctcactagccccatctgggtgcatgtcgccatcgtcgttgcagacgaggcagcaacaaccttccatagtttcatggtcaaaaaagaagcactgaagacatcgttgccaaggccaatcatctgcttcagcgatcgatgtgtaagcacatcattgacagttcgacagttcgtaatcaaacttgagcagtaattgaaacaatttcagccaaaaaaaagaagaaaaaaagagttcgagcagaaaacggactctgtttctgacgttctgcaatctgcattggtggccgggtgaagatctacagcggctgccagggatagtacaggttgggcccggagggcgcactgcgtgtgccatcggaggcggcggcggtggaggcgttctgtggcggaccgtgcctggtgcttggctgcgtcgatgccatcatggacagcttccgcctcacgctcgaccttggttgtggggacaccggtaatcccatgtgttatacagtaccacttcctggatcagtaggtggtacacacatagcacagtataatattataactgacatcgtttaccggtgtttctataataataatacaagggtaaccttattgggtcccgaaatagaccaagcatgatcacttacaatacaaaataccaaagcaatagatagaacagcggaagcgaagcaacggcggtccatcgaactccacaagcaacgactggtgaacctatggtccctaatccatcatcttcaacacgttcttgacagcagcatggcataaatctaatcgacgccaacttctttctaaaagatttaattaagcaagagttagtacatacgtactcagcaagccaccactacaaaatgaatctaatgcacacagggttcaaggatggcttagtttatttgcataaggctagttttcacgattcatttcacaagcctattggcatagcagttttaactgaaaaacaacgttattgttgaagttgtaattatttaggtttcatccacctctccaagccctgcttagttcggtttaccctcatatttcgtcttattaactctactatactgaccttcccactctatgggcaaggttcacatgtctctcataactactctaagcagtattcaaatctataagtctagtca

SEQ ID NO: 39850 - DNA, 26838 bp, Oryza sativa
ccacatgtatgacaaggatatctatgatagagttttgggatggtaggtatttttcttcttctcaattgtttgatttcaaaaaagaactgccttgctctctgttatatttgcattatttgttctgcaggattgatgaaatattggagaactatgaactccttgagttccctaaaaggtacgtattcaatactactagactactctacacactattgtgctttggtcttaaaaataataaaatggtagactggtgctgatctaagggaacacatcctatgcacacaaggctttttcgtgtacacaccaactaacaaatatcacaaaaattctggaaaaaaatgtacatgaactttaagtcgtattatatatatgtgtaaaatctcaacttcaaattcattatatatagggggtaacaaaaaagacaattctggcatatttactcttaaaactgtcagagtttttatcttatttgttacgtctaaaatgtattgaatttaaagttaagactttacatataagtgtaacactaatggaaatacatatgtacaatgttttctaggatttttggtctaatttgttagttggtgtgcacggtgtgtatacggaaatcttatgtgcacaggatatgttccattgatctaacatcatcaatatatttcttttagttgttcaaatctaaatattctgctagttaaggaaaatacttgtgaaacatgtaattgaaagcgaagcttctcaagtaagaaaaaactttaattacgttcattaactggtattctccaaaagtttttctaacataaggcgcttgtgttccagctatgaaaatcaagacctcaaaactactgaacggtatgaccttaaggctaaactcattctccttttgctttctttgtgtatattcttcattgttgggcttgcgctttcttctctctacctttacacaacctgttatcaaacttaaggggcagtttggcagagctccacctccacctctcctagagctggagcccaacctaacagtttcagctccacccaaaaagggagtgaagttgctggagtgctctcacaaaatgaactagagagttagagttggagtggggttcaggctgctccgcaactatactccaaacccaactctgagttaaatttaagagttggatccctgccaaacgggccctcactatattatttctgctcttgctcaatcattaatgacatgtacacccatggattaacctctgaagaacactggaacagtaggtcataaagataggaatgaaatggcacagtaaatcctttgttttctggaatagatttgctgcagtagccacaagttgggtgattcattttgatgttgccgctagctgtgtcattttcttagactattttggataagttggcaaagcattagtgcaatgctatatgtgaggtaaagactacaaataatgaatgctcgagtcttttgtgaacagaatgccattcgaaggtagcaatgagccaatgattgtgatggattttatctgtgattattactgaaattatctttaatgttttttatgagccatcaaaatttaatgcagtcattttaaggccatactactctttcatgtcttgtatttcttgttattactgtgatactgaactaacattgtcgcctacataaacaaggaaataacaagagaacaatacactcgtgcatattaaataaagtgtttagtgttcatatgtcagctcggcatcaacatgttaggcctagccagtagagataatatgtacttaaaacaactataaggttactttccaggtttcactggcaactataagcttatttccagttttcactgaatgaagcctttgcttggtccttatatatgaacttgtctgttcagtgcattcatgaaactttgtgattcattagtgacttactgatacatatgtgaccatgtgcgctggatatgaaggttcattccaagcactagtcatatgtaaaaaaaaggtgcaatatgcacctgataattgtagtgctgtgtatgtacatttaatctaacatagttagtagttcattagagtaattagagtggttcatgatattagttcattagttactctaaacatagttatatgatgtgatctttcttgtgatttctgttgtgttacacagttacggcatagattttcctgctataactccaacaggtcacgatgatgccttccccgatcctcacaggttcgtctccaatcacctaaagtataggtaaatcatactcacatagttaatagtttctgtttttgtatgcagtggtattggtggtggcagcagccagcatgttggtaatatgacacccatggaactctcaaaaatatttctttttatgtttctgcatctctacagtcttgttttaccacttatttatacaacagatccaaatgatccaagcttctttccttctaatcccttgcatgtacccttaagtggcacagggtaatccactttttctttttattatcttgtcattttagtacacatgaggtcatttttacttatgaatggactttaatatttgaaaataggagtgctccaccgagtggtcattataatccaattggtccaccagatgtgccagggcttgagccttcttgctctgcgaggtaatatagttgttgaggaacagtatttatacacaatattcttagcaaatctgtaagttccaagattgccagatactgtacttggctgcgtttaaaacccatgaccaacaaatcaaccttctttttcatatacttcaatttctggcccaacctcctgtttccttagcaaaggactatttatatctcacctcctgttgtaacaatatagtaataatgttggattagcactatcctacataattcttatattcccttggcattacaaagctctaaaagagtgtccatttacatctagttaaaactgtcaaaatgattttgggtgataccattttgattgggagttgctcatcctctgatcaacaggcaatgctaacctaatatagatttttctttacatgcaggcgtccaaagcaggaggccccccttcaaaggccaccttcctaatcgtatttgaagcacttcgaactgctagattgcaaatagcttatcagacattgcctgtaaaaacgtatgcaaactcctgtatttatcatacccttgcacaccatatgctcgatcacagtttacacacatatgcaatcgtatcaacctatttccgttacccttgcacacctaatagcgacctgtgggatggaatgtaaagcacctctcgcagtcgttcgaaggtgcatcatcgtaaagcagagcagctgcagatcatcctgtggtgccatccgatccatgttggtgttgatgctgtgatgctgttgaaggcttttccatcttttgccgcgttgccaaaattttgaattttgaaacctgattcctttttttttgaacaaagtttgtttttcagcatttggcttttaaatcgctaagtacgtaactagaagtttatcatatttttttcctaattaagccagtattaggacaaccaatgtttccaaaatactataaggaagtgaatgatttaaattttaaattcttcctcgcaaaatagtacaatagtttatagtatacttgtttgattaatcatctctcttttattgtcttaatccaagtaccctccaccccttctccatggctccttaatctcttctcattatattatgggggtggtgccatggagacagtaactagaattggacgatgcgtctgaacgcgcctgaactctgaaataaagcaattttttttttcatatagtatagttggtccgattacaaaaaatatgtagttcaaactttaaaactatagtgagatacataaatttgttcatgtctaattttaagatttaatttgagtaattttttttaagggactctagttgacaaacaactgatttctcttatactcccaccgtcccaaaataagtgtagttttgcactatttacgttcaacgtttgaccgttcatcttatttaaattttttttatgattagtatttttatcgcattagatgataaaacatgaatagtactttatgtgtgactaaatattttcaattttttttacaaattttttaaataagacggacggttaaacgttcggcacggatatccacggctgcacttattttgggacggatgtagtaggtttcagcagtttttcttgaccgtacggtacccacgtgtcgcccatcgctcttgtcacgggcctgttcagaatctcgttttgttggttgtagtagaccttgctacttttgtggcccacaagccacagtccagaaaaggaatgactttatgccgactttgtataacatccctaatctaatattagaaatctttaccccttaattatatacccgtcacaagtacaagtagaatgcatgtcaatgagggtagaaacgccatatcgtgtgcctggctaggataagacggacggaaaacgatcgagaattgacggaagtgttaaaaatgggaacggggtgaactttgagtgttattaaagtgaaccggtatctttcggtgctataaatcaaaaaacgtgaactttcgatgctatataaccaattttgccttattatataataaaaccgtataatttgggtctctggttttgttgagtcagcaaaataaaaaaacaaaaagattatgaggcctacatgtaaatgaggtggatggtgggagatgggggaagagaagaggtggcggcggcgatggtcccatcctcctaggtcgaccgcgactccgcgagaatggtagatcggcagcagcacgcgcacgtccgacacagcgccatgggtaagctcccgcggcggcggactcgtcgtctacgacactgctctggcgggtgcaaacgcacgcgcccggcccaactccacccaggtcgttggcttcctcacgctcaccgtcctcctgctcccgaccaggctcacgctcaccagcaccgtcgtcgtgctctgcccatcgtgctgctcactagccccatctgggtgcatgtcgccatcgtcgttgcagacgaggcagcaacaaccttccatagtttcatggtcaaaaaagaagcactgaagacatcgttgccagggccaatcatctgcttcagcgatcgatgtgtaagcacatcattgacagttcgacagttcgtaatcaaacttgagcagtaattgaaacaatttcagccataaaaaagaagaaaaaaagagttcgagcagaaaacggactctgtttctgacgttctgcaatctgcattggtggccgggtgaagatctacagcggctgccagggatagtacaggttgggcccggagggcgcactgcgtgtgccatcggaggcggcggcggtggaggcgttctgtggcggaccgtgcctggtgcttggctgcgtcgatgccatcatggacagcttccgcctcacgctcgaccttggttgtggggacaccggtaatcccatgtgttatacagtaccacttcctggatcagtaggtggtacacacatagcacagtataatattataactgacatcgtttaccggtgtttctataataataatacaagggtaaccttattgggtcccgaaatagaccaagcatgatcacttacaatacaaaataccaaagcaatagatagaacagcggaagcgaagcaacggcggtccatcgaactccacaagcaacgactggtgaacctatggtccctaatccatcatcttcaacacgttcttgacagcagcatggcataaatctaatcgacgccaacttctttctaaaagatttacgtactcagcaagccaccactacaaaatgaatctaatgcacacagggttcaaggatggcttagtttatttgcataaggctagttttcacgattcatttcacaagcctattggcatagcagttttaactgaaaaacaacgttattgttgaagttgtaattatttaggtttcatccacctctccaagccctgcttagttcggtttaccctcatatttcgtcttattaactctactatactgaccttcccactctatgggcgaggttcacatgtctctcataactactctaagcagtattaaaatctataagtctagtcaagagtagtacaggtctcggcgctcattaaccgcgagcacagctattcgaatagatagatttactcacactgcagtggatgtacgcttttaatcccgcactccgtggcttgcccaacacataagcctagtcccaacatataagacttgccacggcacagcttttcagtcgctctcgcatttcggcacccgctccaaggactatgaacccccattgcgccccggcactcctaacccctctgccggatagtgaggggagtcctggcgctctagggaattggggatattatattatatatatagttatagggttcattttaagtttataccatggcctttacctttccgacactgcactcatcacaacacacttatacagaactaaccatgactgaggtgtcgccccacaagagcttcctaatccgctggtctatacccactgaagaaatgcggtcgtactctgttcgtttctcgtatagcttcctgactcggtccataactgactagggtcggcgactaaccgtttccagacccacccatattctattcatgccgccccagtcgaaatggttttgttgtattaagttttggttttcgcagaaggtttgtgtgtggcgggtggcactcatgtctccacccgcaaatcatcaatcactcacatcgagtgatctcacacccataatcatctagcataaatatagagtgtacgtatgtctataatagcatcgctaagcaatgtcaataaatgaccacacataaataaacgactcagctaatcaaaggtatacaacatgtataaaggtaatcaatatcaaatgtaggcataatcgagcatagatacgcactttataaatagcatgcaatttatttgtaaacaaaacatttataaatctaggatcaatatgttcaaggaagggagcgtagtgacttgccttgctataggttcctaatgtcttcgagatatccgcattagttagaatacccgcgatcgataaatatccgacacgtctgataaataaccgaagaatatccacgcataatcctaaaagaaataaaataaagcaacattcaatacaactaatggtgccaatttaatagatctcgaatttagagagattatggatgttggacggagtcaatcggggttatggtccaaaagatatgaatttccgaagttgaaaggttttataaaccgaggagggagtgctctcgggaagggaggtgatttagactttatgatagggctctgggctgaaatgaggatgtgtatggactttagtgtataggtaggccgatggtgggctctggaggataccaattagacttctgtaggtgaatgaatccctcgggttctgctagggggaaaagtacacgcaaggtccctcaacttgttagccatatacaaaatcgtcccttaaccgcaaaaccggacatccgacgtcccccaacttacaaaactggtcacaataggtccctcggcggttttcaccctggttttgtcccacgtggcggctgactcagcgtgggacccacgtggaccccacatgtcagtaagccacgttagcaccctatctctctttctctatttctctccttcctctcgctctttgctctcgcacaggcggcggcgcgcgcggccgaaaggtggtgcggctagcgacggcggctcccgggtggcggtgcgcgggctcagggcggtgcgagttcgccggcctccccgtccccctcgtgcggtcggcgatggcggcgcgcggctacggccatcataactgacgcggagagaagggccgatgcggcggcgtcaccgacgcggtggagaagagggtcggcacggccgacggggaagaatcggcggagaggaggagcggcggcaaagctggagccacacgcgcggccggcggaggcgcggggaggccggtgagctcctcccaagtccaaatccggcggcgaggcgggaggaacgcggtgacgatggcagggaggcacggggaggccagcgtcggcatcgaggcgggaggaatgcgtcggcgttggctcaggggagcaaggcggcggtggcggcggtgaggggagcaaggcggcggcgtcagcttcctctccgtgctcgccgacgagaaggagcggcgggcgaccgcagcggccaagctggtcggctgggcggtggcgacgaggcaggaggaacgcgtcggcgtcggcttggcggtggcggcgagacgggaagaatgcggcgacgacggcgacaccatgatggcgctcgaggaccgaagccgcgatgccctcgacggctgccacccgtgcccagctccttccccggtggctgaggctgggggagacgtcgacgccgtcttcctcggcttcatctacaaccacgcgccgctgccgcccttcacgccgcccgtcccatgccggtctgttggccgtcgcgaccgcgctgggctgccgccgcccttcccttctcccgtgtcgccaccgccgcgtcgccggtcggcggtcgtcggacctcctctcccgcctcaccccgacgacatccccacccaccgcccgggccgcccagcctgtcgagaggagataagtgagagagagaggaagggggaggaaagatagagagaggtgatgacatggcttactgacatgtggggcaaaaccggggtcaaaaccgccgagggaccttttgtgaccggttttgtaagttgggggacgccggatgtccggttttgcggttgagggacgattttgtatctggctaacaagttgagggaccttgcgtgtacttttccctctgctaggaggtaaatagacttcataagagggcctggtcctttggacttacacactaaagtacagggaagtgatttagacttccatgggggaagtcaactcagggaggaagggtctagactgcgggtcccacttccttttcttttcctctaaattttcttcctctattctctctctttcttatcccctttcttccttctttctcaattcttctcgttctcttctctgcttcccgcgcacattgcaatattggactgcaaatatagggcttcgttgttttgacactccgagtgaataacaaatgagtctatctgtgtctataaaatataggtccagtgtcattatagcaaaggttaatgtttgcagtgtcataattgcaaaccctccgggtgagaggggcgggggcggcggcgtcggggaggtgtgcggcggaccggtggtgaggtggtgctcgactgcagggtgggctggcgcggcggcggggaatggagaggggagggccggcgtatggtggctgagggcagcggcgcgatggcctggcgcggctcggctcggtggcgtccgggtggcagcctgggggcgttggtggcggggcgacgcgcgatggggatgcggcctggccgaggagggaggagggggcggcgaagtggcggtcgggggcggcgcagcgcggccaggtagtggctagcggcagggatggatgggagatgggggcggcggtagtgaggtggaatggaggggaggccgtcggcgtggtggcggctgcggtctggcgacggcgcggcgcggttgggcagcgcccgtgcgcggcgccgcagccatgggggaagggaggcggcacggaagtcgaaggggggagcggcgtcggggcaggagggtggcggttcgaggtggaggtgatacggcgatgccgcgcatatggcgcgggtgacgaagcggcagtgtaggggataaatgtcagtgggttagtgcgagataagggttaggggttagcgtgttagcgagtcataggtcagtgaaacggaaaatacaaggggtcagtcggcccgtttggttggagggagtttttagtagggattgggagtttagagggatgaggctattaagtgtcttgtttagttgggagacatgagaattttggtgagatggagatgaggaattgaggaaggaactccctccttttcaatagctgggtaggggcaggtaattgggaggaaattcctcctttactttgtctaagcaaatctcgaccatccgtttttattaatgatctaatctccaactaaactccctatcaatttctatcaccactaccaaacaagatattgggattaaaaatcaaattcccatcttaatctcatcatcaattccctcgtgtaaacaaaccgagtgtgttagaggttagtgaaacagaaaataaagagtcagcgggttagtgagttagtgcaacagaacaacaaagggttagatgttaggggttagtcgttctcaggtcattcaatggcgcggcggccttcctgtcctcttgctcaactgaggcccagccggagccggctgtggcggagcaagcggagaggtggcaggcagcttgtgcgcgagatggaggagtggcaatggcagagctcgagttgggagaagggagaagaaatggagaggagccgagctgctgctgtctttggtagggtttatatagctttgctggctgcctgagcatgggaggcaatgtgagggtgggcagggagcagtgccgaaacgtcgacatcgccacagtaccaggtacgcatggcccattgtacttggctttgccacttttcggtgtgaacttggtgttgctcttctcagtgaacttggttctgtggtggcatgtatttagtggagggttttgtggattgggttcatggtgaatgtgttgctgctgttgtggagggacccctgtcatttggtagctgcaaaagtaggttcaattcactgtggtggcttgtgggcaattgatcgaacacgttctgtgcatgcaggtgttcggctgagggaataggacagcaatacatgcatgtttttttcggtgaactcggtttatcatcttagtgtggatttgtgtctcctgtgttgttggtgctttggggagggtcctgtgaattgggatcatgggtgcatgggatgttgtttgggagggaccctggtatttattagctactgttgtgagccggcaaaggtgggtgcaaagtgctgtagtgtcttgtgggcttatgtcgagcacctcctgtgcatgtctgttggttgttttgggcagggcaggcaaagcagactttgggtggttggctgagcaagtgcacaggggtgggctgtcagtcggctgggggaggaataatggacttgtgtggtgaaatgggctgtgctagcagagggggagatggcccaagtgtaataggagcttttgtattttgtagggatttgaaaaggaatggcgtctgtatttgagctggcacacatacagtgtatttgtaatgggactgtaatttgaacatttattttggctctgtactcagactgtatatatggaactgtacaattggactggacttggatcggtattagaaatagaatatgcacaaggattggattattgaactgcaatacgagatttggtttgcttggatgatacaccgcatcttcgaacagggaattagggatgacgcccgataaacaattccatcggcagtcttaggatttcgtcgtgagcgctttgcacgaacgggcgacggaaacaaaacagtgatttttgggacgacgcatggcatacaaatccaatcgtcgcggtaggaatagaattgaatatatttgaattgacacacaataaataaatacgccgatcaattgtagacattcgaaggatttattgagttgaattaatacaacggtttgaaataaccggagggtaagaattgagaaagatatgtcgtgctgcgacataagggaagattttcaggttaaatattctgtgatttggtagcacttaataaatcagaccgtgaagatatgggaaagaaaggacgttggactgagggcgtccctttaggagatatgatttaatcgagatctttagcacacaacctaaatacacacaaatgcataataaatcccagcatgcaaaaaggttttaaaaagatttttgattattctgagtttttaattccgtatttcagaatcgaaattttcgggatgttacaaccttcttcgccagccgcgttttgggaagaaaagagaagaaagaggaggatagctgtcatgtgggctcccacgtattttttttgttatctttatttgctgagtaggatgtcaaatcaacgaaactggacatatatgttagagtatatggtagttagagtcatattaggatatgattgatttgtgtagactccttccatatctgtaattctttcttatctcctctccatgtactcttatatataccagccccctgaggctcaatacagtcaatccacgattcacaatatcctctctacctatactatccaacatggtatcagagcttcggcttccacttcgtcgttctaccccacgcatcatcggcttgatcacccgttcaaacggccggctacgacgacaccttgctgctaatcatcttcgactacgcgtctacgccatcaagcttcgggctgccgctgcgtcgcccccctcgggccgcagttccgctgcctgtggtccacacctccactggttgttgcagtgctgacaggcgccctccttagcatggctacatcaccagtggacttctcgccgctgcatcgacatggaactgcagttgtgttgtcttctcgaaccacaactttgccgctttcgtcgttttcatcgtcgttagcgcttcgacaccctcgtcgtccgcattggtcatcgtcagccactcggatcttctttgtctacttcgagcatcgccgccgcgtctccaagttgccaccgtcgccgctctaggccggtagtccagctacctctacatggctactgacgttgccgtctaggccgttggttccgctacttcgccttctttttcgtccatcatgattcatcgccagtgtcgccgtatcttcctcgactacactttgctcttctccgacaactacatgctgctccggcaattctccctctacgtcgttctcgcgttgcgaccgttccggaggtcttctctgctagtctccttcaacattggcttatgattcatggtggtcccctgcctcgcccacgcggtattggaaacactggcgtgcgcgttcgtcccgagttgtcccggggtctggcaaaccctgtgtagcgcccgttccgtcgtggcgcctagcgggaaaattatctcttaaaaaccctaatcgcgaaatttgtttctttgcttgttgtctagtgtccgtgccatctcagatctcaaatccccgatctatcgtcgagttcaattccgaatccaatccttccaaatcaaattcctccgcaaaagtctattttgcctcccccggggtcgatgggccgaatttttctcggcccatctccccctggctcgccagcgccctctctctctcgctctctctcctctcactccgctccgctccgcccgcgcgttgcgcgggcgtgcgcgggagccgcgccgagcgcccctcgtccctccgctctgccggcgcgtgcgtgagccgccgcgccaagcgcccctccctcctccgctctgtctgcgcgcgtgtgcgtgagccgcccgcgccgagccgagcccttctctccgctccctcgctgccgctccccgcgctcgttcgcgcgagcgcgcccgcgtggtcctcgcccgcgtcgcgtctgcgccgcccggccccgctgccctgccgcgcctgcggccgcgcagccgctcggccccgcagccagcgcgcgtgcccgagccgcgcctctcaatccgccgcgccttctgttgcatcccgcgcgcgcgtgccgtggtggccgaccgcccggtcgccgccgccgtcagcctctgcccgcgcctgtcgcccgtgtcgccgctccgctccaaatcgccccgccgtcatcgcctcggccccgccactccgcgcgcaagccgccaagggacggaggcagagccctcctccctcagccgcgtcgcccccgctcccctcctccttttcccaaagaagcaaagggcgagctcccctttctctccctccttttcccattttcctcccgccggcgtcatcctccctccgccctgtcgccgatttggacgcgagcgccgagcgccagctcgcgccttgaccgcccaagtcggtttccaaaccgacattgccgccctttaaagccccgggcgccctccctctcttctcctcccatcgcctccactccattgttgccgcccctctgtttcgccgacgccgttcgtcgttgcgcgcgtcggaggagccggcacgagcgaggacgcggaaggggactccgggcgctcgtcttcctcctcttccccggcccgaggccggagagattactcccgcaccgtcggcctctcgtcacagcgcccctcctcatctcggtagtgcctccctccgttcttcctcctcgctccacctctccccctaaattttcggtagtagctcgagtagcctccccgtagctagccggcgccgccccgaccgttgccgccgctcgccgtgtgctcgccgctgtcgccgcccgtgctccgtagcacccgcttgtcgccggcctcgctcggcgtagctccgctcaatccgacgctagcaacggattcccgtggccgcgtagatgctctcaccgccgggaattggcccctcgtgacctcgtcgccatttcccccttctcccgccgccgcttgccgccgccgcaattcgtcgccgtcaagctccctccgacgaatccgagccgttggctcgtctctcctcgacctgagcaaccacccggtgtgctcgctttcgcctgtatcgccgtggttcgctccgctgctcgccgctgtcgaccgccgtccgttccggcaggcgtcgtcgtctacctcccgccagcccgcgtggcagccacgtaggcgccacgtcggcgccagctcggccaagaccgggtcgagccgaccccggtcagcccctccccgtgcgcgcgttccaccgcgagccgtgaggctgcgcgtgggcccgccgcatccgtttcaccgcggaccacgcgcgtgcaccgcatcccttccccgcccgcgcgcgtgcgccgcgtgctccctccgcacggcgagccgagccgctgacaagcgggtcccactcgggaccgcgcgtggtgagcccggtctactggcgctctctctcctcccctcccgcgcgcgcgcgtcttgggccgccttgggccgcccagcccatttagctcggccggaccgccccaattctctcgggccgcgccctagccgcccgaggaaaagtctattttccctccctcttttcttttcttttcttttcttttccaaaaaggatttaattaaatccttttcctttagacaaaaatccaataatcttagaaattcaatatcttctcaaccgtaaatccgtttgactccgttcaacttccaaaattcctcaaatctcgagatctatctaatggcacgcttagaggtcattaatagggctttattttcgccgtttgttgagttgtcccgttttgcgtatagtttcgaagcccgaagacccgcagccgtgcccacggtcatgggcggatgtgaggtgattcctagcgtagttttgtttgactactgcttgtgaaattgctgttgtggaaaggggtttgatgtttgaaaaacctgcagctgatgggatcagctaggcccgggtggccgtttgaaagttgttggcccgggtggccgtttgaaaagctgttggccgggtgccaaccttgtttcaattctaaagactgatacattgcacatactccgaccggacgagacgcactgtctcatccgtgtcgtttgagaagcactcacttagttgtttttagaaaaaagagttcaaataaaatcaattgcaaaaacaacagcctttccttgaagcctgcattaaacacttatttcccatggcttgttgtagcgcccgttccgtcgtggcgcctagcgggaaaattatctctcaaaaaccctaattgcgaaatttgttcctttgattgttgtctagtgtccgtgccatctcaagatctcaatccccgatctatcgtcgagctcaaattccgaatccaaatcttccgaatcatttcctccgcaaagtctaccttgcctcccccggcccatctctccccggcccttttccctctctctctctctctccctcgcgctccctcgctctctcccgatcccgccgctttgcccgcgcgccgcgcgcgtgcgcgcgtgagccgcccgcgccccgcttttccctcccccgcgcgccgtcgcccgttgcctcgcgcccgcgcaagccgagtggccgaccgcccggtcgccgccgccgtcagctctgcccgcgccagtcgccgctgtcgccgctccgctccaaaccgcccgccgtcgtcatcgccggcccccgccactccgcgcgctagccgccaaggcccggaggccgtgcctcacctccctctgccgcgtcgtcgccccgcgcccaccctctttttcccgaatcggcaaaggagagaattcctttctcctcctccttttccccttcctcctttttcctctcccgccggcgtcatcccgtctgccaccgctttggccgctagccgagagccagctcgcgctcttgaccgcgcaagtcggttccccaaaccgacattgccgcctccttaaacccccggccttccccttctcctttcctccccattttcgcctcctccactgccgtctctattttcgccgtctccaaacgtcgccgcgcgtgtcggaggagccggcacgagcgaggacgccgaagaggactccggccgcgcctcttcttcctcttccccggcccgaggccggagagatcactcccgcgccgtcggcctctcgtcacagcgcccctccttcccgcggtgatgtttcgcttcgttctccctcctcgctccgtctcccccccttagacttcggttttagctcgagtagacctcccgtagttggccggcgccgccccgaccgatgccgttgttcgccatgtgctcgccgccgtcgccgcccgagctccgaagtagccgcacgtcgccagcccagctcggcatagctccgtccaatccaaccctagcatcgagttcccgtggccttgtagatgctctcaccgccggaaatcgacctctcgtggcctcatcgccgtttccctcttctcccgccgccggttgccgccgccgcaatccgccgccgccgagcaacctccggcgaatccgagccgttggctcgtctcctctcgtcccgtactaccgcccggcgtgctcgccttcgccggtatcgccgtggcccgctctaccgctcgccgccgtcgcccgccgttcatttgcggtcggtcgtcgtctacctcctgccagcccacgtggccgccacgtaagcgccacgtcggcgccagctcggctgagctcgggacgggccgaccccggccgatccctccccgtgcgcgcgttccaccgcaagccgtgaggctgcgcgtgggcccgccgcacccgagtcctccgtaaaccgcgcgtacaccgctttcccccttccgcccgcgcgcatgcgccgcgtgctccctccgcacggtgggccgagccgctgacaagcgggtcccacccggggccgcgcgaggtgagcccggtccaccggctctctctctctcctctcccgcgcgcgcgcgtaaatgggccgccttgggccgtccggcccgtttagctcggccggaccgagccgaatacctttgggccgcgccctagccgcccgaggaaagtctagattccctcccttcatcatttcctttttctttttccaaaagggatttaattaaatcctttttcctttagaccaaaaatccaataaccttagaaattcaatatctttccaaccataactccatttgactccgttcaacttccaaaatttcccaaatctcgagatctatctaatggcacgcttaggggtcattaatagggctttattctcgccgtttgttgagttgtcccgtttcgcgtgtagtttcggagcccgaagacccgcagtgcgaggatttcgaggatcaagctccagatctcgagcaaggcaagccacctttgaacaacttgagcctatatttgaaatttaattatattgcttgcaaaatattatgcattgataggatcacacttaatctgttgtcccgtctgcaaggcagattggcggacctacctaacttgttgcatttgatccatccgttgttaattgttacaccatgtccccttgtaaccacccagatgcgacgcgatattcgtgcactctgtgcgaatatcgacggtcgccttcaaatttaaaatctgaagtaacaacttgggtaaaactggagttttacaaaagacttggaaaacccgacacctgggtcggtgcttgcgaactaaatgaatttccaaatccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgatgtgaaatcgggttcgatgtttgaaaagaatccgcagctgacgggatcagctaggcccgggtggccgtttgaaaagttgttggcccgggtggccgtttgaaaggtgttggcccgggtggccgtttaaaaagctattggccgggtgccaatcttgttcaaatctaaagactgatacattgcacatactccgaccggacgagacgcactgcctcatccgtgtcgtttgagaagcactcacttagttgcttctagaaaagagttcaaataaaatcaattgcaaaaacaacagcctttccttgaagcctgcattaaacacttattttcccctggcttgctgagtactcccgtactcacccttgctctatataaataatccccccccagttgcggaagaagatgaagtggatcctgctgacgaggagttcttccaggagcaagtcggctacgatgagttttagggtttcagcctagttcccaagtcgcgcctgtgatgattggtccaagtccgggcttccgctttccttttgtaatgcagttgtgagctcgggatctgtccgcagcccaacatgactatattcctactctataataaagagacctctgttgctatgatattctgtctccctgtgataccagcactgtttcctgggactggtatcgattaacaggttaatttggagcgtcacgggctagttccagccggaactggttcggggcgtgacacttgttgagtactcccgtactcacccttgctctatataaaaaatccccccccccagttgctgaaaaagatgaagcgaaacctgctgatgaggacttcttccaggagcaagccggctacgatgagttttagggtttcagcctagttcccaagtcgcgcctgtgttgattggtccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgattaacaggttaatttggagcgtcacgggctagttccggtcgggactggttcggggcgtgacaccctgtgtgacgtctcgtccttcacggttcgactacatcggcttttcggcgtcatcttcctcaacgactgccgtgattgtgtcaccgtcttcgtctccagtgcatcctcgcgcaccttggtccacgacgcccctcccgtgcgtccacgaccactctacggcgccctatgcgcgtcctgcggctcggctacctcgacatcagcttcctgacttcggctacaacgaccacggctactctacacacggcttcatcaactacggctcccttgcacccttcgctttggctacattgactacggtacacagggctatcatccgtattgagtactcttgccggtttcttctccagtccaagtgtccacgctgctcacgcttggactgtgggggatgttagagtcatattaggatatgattgatttgtgtagactcctatatctgtaatccttccttatctcctctccatgtactcctatgtatatcagccctctgaggctcaatacagtcaatccacgattcgcaatatcctctctccctgtactatccaacattatatactgctatataatctaaattacactgttttatataatttaggggatgaagatttctagtatcgtggattaggaatgtcatacaaactcgacgtaaagataagggatgacaggttaactcgacgtaaagttggagtttcaactatataaacagccaatatctatctaccaaaaaaaaaatcccctcgacgcacccatcctgattcacgcatccaaactcattccacgttcacgttgttgctaattgctaacaaattcatcttctgagcatttcagacacgtttcactaattttgtggggaaaaacataccacctaagtagaactgaaacatatttaagcctggattccatgcttagacacacaaaaacaaaaaaggttgtattaagaaatcaaagctttacaaaattttaagtgaagtttcacaattttataattgaagttgcacatggttaaaaagtattgtttttgggatggagggtgcaaatgcactcgatcgaaaagaaaaatatgttctctgaatcgctcagcattcaacgcttagtgagggttagattacatacacattgaatctccttattaatatgcctagtacaagcatttttcaagcacacgagaaaacctactagcacttgctacatatcaccagtccaaaagcataatatttcagtacaagccatttcatgccattgcaaattagatggaagcaacagctacagaagcaaactcaacagctacagaagcaaactgagataaaatagtaaacgttgggactttacttattattagtatgtcaagtactaacttcttttaggcaagcataacaaaacctactagcatttgcaagttgcaacatatcgccagctctccccggaaaaaaaaaacatatcgccagttcatgccattgcatattggacggaagctgcatgtacagaagaaaatcaagctaaatagtgtccagctcttctagaatcacaaaatagtatccaactcttatgtacaaaaggtgttcattcccaacaaaaaatgctagtagatgtacagtctagcaaaaaacaactctatatatccctgtcaaaacaaatttgcaatcatctcatagcaaaacaaaaaaaaaagattcataccatcaattacagcgaaacatgcagataacaaaaaaaaatcaccatccatacaaccaaaattgcatacaaataaaagattaaccaaggaactgaaaagacaaacagattcttcagtacaagccagtttagtctatgcattgtgcaattggaaattggatggaagcaacaagaacagaactaggtatttgttcttaagtaaatgatgttaaactctgcaagtttagtctatgcattttgcaagtgtatgtgactgacaattaaggaaaaaacccgacaacaaaacttatgctgggaaataaaccaaaatattctaagaattctcattaatttgcaacttaagttgcacgtatttataactaaagttgtgcatatttataacttaagttgcacatgattgcatttttttattcttagaaaaatcacaaaaataggtaaaatacctagaggaaaatttcctagatacacaacagtagcaagtattcaagggtgcggaaataaaaaaaaatattactctaggtacctagatacacaatgcagcaagcattcaagggtggcaaaataaaaaaaaaagaaaacaaaatgcaaaaagcacaagcagttcggaactggccctacagccatttttctgatatataacattactgagaacattcaaatttttagttttcgaaaacttgcagctaaatcctaaaaagttgcaaaagtttttgctaaaaatttgcacattccaaaaaagcaatgggtataaaaatcgactgacagattgaagattttcaatcacctgcaaaataacaaagcagtttttttctgtatgttaagttttccttataaattataatgttttccagttctattttgatctaaggtatagctagcatgtttatatatacccaatataatgcctcctaaatttcttatcatcaaatttgctaacagaagttttataccaattcccgcagcaacgcgcaggaaatcatctgtttaagtatggtgacctcatggtcaccgtcaccgaggcaacgtatggtgacctcatggtcaccgtcaccgaggcaacgggtagacgggttcaggagcaggtccagtttgagggaggactccaagtggtgaaaaattcattaactcattacttgcaacaaacaggtccaaagagttggatcattgttttgtgtttaactcaaaggcataaagacaattagtgccacataaataagccaacatatattaatattaccgtctactactacttttatagaggggttcatcaacccaaagtaagcaacctggacaaggttcttgtcacaaaactattaactatatatgcccagcaacagtacaactccttaacccccaatcaagccaacaaaccactgatccgataatatttgcatccaggcaggctgcagtatgatgcatatatgtcactgggttcgcacattctacttggcggcttctgcgtcctcctcagatcgtccaactcctgtgtctacatcaaataaaatagctattatctcataaaatgtccttgaagcaagaattagtactcaagggaagagcattcatgttgtccacattgagtacaacaggaaaagcaaaacctaaagcaatatactactttttcaagtatgctttggtcaataccttattacttgctctattctcttgttcttttgacatggtatgaatgcactttgattaattacttcttcatatttaaatgcatgctagcaaaatatattacacgcataatgacactgttggtacttaaaggcttaaaagctagcagctgttgagctagctgtctcatgaagctagcttaattaagtctgatttatttatatatgtagacatccagagagagagagagagagagagagccagagacaagcttagcaacaacaaccaaaagcaaggagcactaactgcagctgttggcgatcgaattaaggatcctgcagctacaagcaagaaggtgcaggtgcagggtgcggccatggcgaactaccaccaccaggagtactaccagatggcggcggcggcggcggtggcgtggccgagggagccggacagcccgcagctgagcatcatgagcggctgcagctccctcttctccatctccaccctgagggacgacgacgacggcggcggcgtccgcctcgccggcgccgcgctgcccgccacgccggtgtcgctcgccgggatcgccggcggcgccagtacccccggcggcgacgaggtggacatggaggtgcggcagcagagcggcggcagcggcgacgaccggaggaccatccggatgatgaggaaccgggagtccgcgcttcgctccagggcgcgcaagagggtacgtacgtatatacaataccaaatacgtataattatacgtatcatactacagtatttatgtacgtatgtgtttataacgtacggtatgaattactactgatcatcaacaaatgttctcatatgtactctctccgatcaatattacttgtgctttccgacaaagcaattccgttctattaaacgcaggccaatttaattgtctgaaacggccggcatgtacttaattatgtccggagggagtaattaacatggaaatttctcttttcaaaaactgaatataattagaatttaattaaaactggatctttcacaaaaataaaatgctgctaataagtcgatcacttataaggtcattgttggaatgcgataatttaattaattaggttttcaatagaagtttgtagcaggcgaaattatataatttgcacattgaattatcagtaaattgcagtcacgtcgttattcatcgttaagtttttgagctgagctgaactggttagtttacacaactgaatatatatgagcaaatttcattacatttcataaaggagttagtctatatattttacattatatccttgatgatggtgcatggaggagatatctgtgtgtaccttgggcagatactgtatggagtgaaactctcgagtatagtgaccaagtttggtcaatttgttaaagaactaaaaagttgatggagtgtgttatctcttgcatcatgcataggttcctgttgataatgtttagtcaatatggcctaaatatgcatatctcttctttgattagtgccctttcttttattaccagtctatcatcatccaagcaggcacttgtgtgataattaatatcaaaattaagtcagcttcacctaatccaagattccaagtccagcagaaagggcccataccagagagtgtatatatatgtatgatatcctcgtggacatggtgtctacttgtctctccatgcatattggtaatttgtggttagctggtttcactctgatatatatatatatatatatatatatatcactaattaatagtacataataataaaaaaagaatgtgcggaaaaaaagaatgtgcaatttgttaacaatagtagtgtagtcatgggtattatatatattttccatcccttgtacgcatatatgccctttaggccaactcaatagatcatcaatagtaaatatcccaaatcactcctaaagttaagtagttaacacaattaccatcgaaaaaacgaatgtgcaattatgttcttttcttgaatgatttgctaattgctacatgtatcctctttcttgattaaacattagagaaaattggtgcccctgaatttgtaagagttccagattaaatagagactgttaacaacgacaaatcgaaccttctaagcaaaaaagaaatgaacataatgtcccagttgatattaactatatttgggtcgatgcatgacacaaggtatcccaaaatataatcaccacgttagactcagcttacatcacaattaactactcctgcccccaagaaaaagtcttcctcgtatgcttgagatattttaacagatagtctcacgctaatatatacttctcttgttaggtacggactaattaaataagcataaagaacttaagttgatcgggacaagaggaaaatatgaaaactagcttggcattatctcgactatctatcatctgaataggactgcactatgaattaattggatcacacctgctgctagtgaggagctccttttaccgtctccatctaacctctctagactctagaggtactccatttcagaactaaccatgcatttgtacctaccaaaagggcaataagcatccccaaaaaaaaaacagactgcctacttgtcaatgaatccagttctgtcatattaatacgattcagattgtattaattgtgaagtaatttgttatgcaggcgtacgttgaagagctagagaaagaggttcgccggctggtggatgacaacttgaatctcaagaagcagtgcaaagaggtactcatcactaattcaattcacaagtgatcttcacatcactaattaattactaccaccgtctcagaatataagaatctagaatcggatgatgcgttttctatttttgtccagattcgtagtgctaggaaacatcccatctgaccataggttcttatattctgggatggaggtagtagttgataataactcattacttttgaaatgttgtgatttgatcattcatgtgacgagcacttgtacttctgcttggacagctgaaacaggaggttgctgcactggtgatgcctacaaagagctcactgcgacgaacttcatcaactcaattctgaaggtcgaccaaaacaagcaagattatttgacgatacaaaatcattagaaagatctaaattatgtgtatttgcaatccggtgtgcgtttgtgcaggggtcaggcatgagagaggatattgtgtgtaggtgatcgatggatgctatgaactacctctgcagttagaaatgtgttagatcttgtctctgcaaagatgaacaccttttcttacttgttcaactcgatcagcatgcagtatcctgttcaatttttttccccttcagccattcagaaattcagaagtggctatcatgctttaattttgtttcagtcagtagtagtatttgttat

SEQ ID NO: 39851 - DNA, 16986 bp, Oryza sativa
cttggccactcctcggagacatgtcgcggagcttcttcggagacatttcgtcgagcacgtcgcagacgaggatgcccgcgccagagatcgacccagccgacggtgccctttgcgcctccgagcatgatggtcttggctggtggtcaggtggtacatatggctctctcagctgagtgatggatcgggcacaacctgtccctcaccggatcctccacggacacctcctggcatgtccaactccgggcgatcgggacagtggacgacggagaagtgggagagggcaggcgggcggcggcggctcgttccagaatgcacctcgatgggatggccggtgctcgttctcgaactggcggtggtggcgttcttaccggcggaggtgtagcctcggacgctgccgctggccgcgttctccgcggcggcggcggccatggcgctggatcggaagtgaacttttttttttttttttggttctccctctgcttgaaggcttaacgttgggcttgggcctaatcggtggcgccttatgctgggttgtactcaagcccaaaatcaattgggcctttccaattgagccaagcccgaaaacctagaagataagacagaacatcggagacttttgattggagcttctctgtcccgctgtccggaatggtgcactgtcagctatgtacaaaatatatcttgaactccctgctgcagaagagttcagagttgagagggtatgatctgcacactaacatattattcctgttgcatagatattgttggattgtcactgtgtgtaagacaagtattctatatatactatataatcagttttctttggtaaaaagttatactgtcttgctatgctagtcgatgaatctgatggcgggcattgttctgagaatgaacttagaaaacacattcgttcaaaaaaaaaaaacagtttgaggcagcggggagcagatccagtttgagggaggactccaagtggtgaaaaattcatcaactcattacttgaaacaaacaggttcaaagagttggatcattgttttgtgtttaactcaaaggcataaagacaattagtgccacataaataagccaacatcccctcaaaaaataagccaacatatattaatgttattaacgtctactcctacttttatcatcaacccaaagtaagcaacctggataagattcttgtcacaaaactatatatgcccagcaacagcacaactccttaacccccattcaagccaacaaaccactgatacgataatatttgcatccaggcaggctgcagtatgatgcatatatgtcactgggttcgcacattctactcggcggcttctgcatcctcctcaggtcgtccaactcttgtgtctacatcaaataaaatagctattatctcataaaatgtccttgaagcaagaattagtactcaagaggaagagcattcatgttgtccacattgagtacaacaggaaaagcaaaacctaaagcaatatactactttttcaagtatgctttggtcaagtactaccttattattacttgctctattctcttgttcttttgacatggtacgaatgcactttgattaattacttcatatttaaatgcatgctagcaaaatatattacacgcataatgacaaggaaacaagagtgacgacacatttactgctatgaattttcacgaagaatgcaagtaattttatgcattagtcgtcgacattttagtggaggtgtctttattctgttaacaaagttcaggttttgtttttgcaagtacagtcagaaacacaacgtttgtctgaaactcacacaaaacagtatattgcataatgagtattggtactactctgccaaaaggactcttggtactgttctgcccttgtatcaacatatcaagcctatcaccctaaataaagttactacattctagtcctagtttggtcattcggaccatcataaacaaagaactataatgatcagccctagatccttaaatggcattttattacccatatgcacatggtgctgcatttgttctggaatacgagcggtaattaagtacctgtggtagtgttgaggcgtttggagatcccagttgcaaggtagcatcgcatggagtagagggtgttcttttcggggtcaagcttggccactcctcgcagctccttgttcctgacgtcaacagcgaccatcattcctcccgtcttagcacccctgccagcagcgttgcccaagaggtaaacaacatcatcatcgatgcaactcaaggccgggtaacacaaacgcaggcgacctagggacaaggaagaggttgccccttgaccttgagcctcctccctgtgttcatcaccgctgttgctgagcatgaggctatgaagcaactcgtaatggtgacttgggttggtgtcaagatggacttcacgcgattcagcagtgcagtcacggcgccagtcgtcccatgaagtgaccgggataggcatgctccatgtagtgattctccacgaaccagggtggaacacggagcgtcgccgtgtcggctgaggttctctgctgcggcgaacccattcaaggtatgaagtaggatctgcagaggtggaggtgggtatggtggtggtcaccgttcttggcgaaacgatctccatctccagatacttgatggaatccttgtgttggctgatggcgatgtcccgacagaaggacacatcttcattgaggtacctcctccaattgcccttggccggccacggcagcggcatgtcgcggagcttccttggagacatttcgtcgagcacgtcgcagaggaggatgccgcgccagagatcaacccagcccacggtgcccttcgcacctccgagcgtgatggtcttggtggtgacgtggtacagctgcctcttggctgagtccgggatcgggcacagcctgtccctcaccggctcctccacggacacctcctccgatgtccaactcccagacgaacaagaagatctgtacaggcgcagcgtggaagtgaactcactccagacgtggagggcggccacgacgtagcggtcgtcgccgcagctgagtatggcgagctggtggtcaccgagggtagggggaggcgggttggggagcagatccagtttcggagacgggggatccggatggtagaccaagtagtcgttgtcatgcggggcaccaagctgatcgatggggactcggaggaggaggaggagctggccgtcggcgtcgtcgacggcggcggcgatggctttaggcgcgccaagcagattgccattgaaggatgggagatcggggcagtggacggagaagtgggagagggcaggcggggacgcctcccacaaagtcacctcgatgggatggccggcgctcaacctgcagctggcggtggaggcgttcttgagggtggacgtgtagccccggacgccgagcaggaggctgctggccgtcttctccccggcggcgccgccagtcgcggccatggcgtcgaattagggatttcgattttgggggtaaggaaggggaatacaacaaacagacgtagacgggtggagcgaaggcttttatttgggatgcccgcacccggggtgattagtccgcaaatgacctaattagcgctaatggtaatatgtactggagtaatattttttttaaaaaaaatacatcaataattattttttttaggatagttcacagttttaaaaaatagttgaaagatcatgaattttcagttgaaattttccataattcgagttgaaagttttagaagtttgagttagaaatttttttaatcgcgttaaaagtttttaaattcccagttgaaagttttcataattcaagttgaaagtttttaaaatcaggttaaaagtttcaaaattcgagttgaaagttcaaatttcatgttgagagttcaaagttttcaaattttgagttagttttaaattttaggtaggacttttttttattgaaatatgtagatctttacctatcataaatgtttaagatgcttttgccaagtatttttgtacgttgtcccagtataatgcgctgcgcagtccaatttcttttcctccctgtgcgtatttttttacgattttccggtccgattcctccatatcgccccctcccaaattgctccacgttttccgttttcatgtccagatcatatcatgtcctagcaagtagaacaaattttctcctcacatcagttcaggcccatgtaaccgccacattccagatcaattttacatacatataaaccctaaaccctaaaccagatagggctccatggtgcccgggcaccactgacatctgccgttggatcacattctcatctagttgatcggtacatgtatatttgattaacgggttcacccgttaagtacatttgatttggaaattgacagcatgtgcatgcatgcaaaatatttagtaacgtctttaatacctaggtttggtaattgacagcctgtgcatgcatgcaaaatatttaggagtatcaatttagcgtctttaatacctttccatcaacagttcacggccgttatttggtttctaaatatttgtcaccataatcatggatttgcggtttatttggcaacaaatataatgcggtttattagggtatatgaaaaatctaagtatacttctacgatgtagtatatatggaaatgttatcctgctgttattttgaaaataattatataaggaaaccgaggtaccctaagtacaccatgaacgatgtaattggaatataagtatatatggaggctaagtatatggtatgcttatgtacacctagctaaattagtgcgttttgcactttccagattcagaaaatgtttactcatttatgtaatgtaatggctatgtatacacgggttattttttctatatacttagctaacttgttaagtatacaaagttttaaattacgttaatttaattatattatgaatccaagcgtatataaatttacaatttgtgtacacggtatattttattattgtcatttaatattgttgtaaatagtaagtttggaaactaattaaatttggaaccaagtatattttagtcattacgtccggatgtaaaattttatataaattaatccaagcatattttttgtataccatggtttctaagtatatctatatttcaaatgtgtactgtagattattagaatttaaaactcgcctacctaggctgacagtacattatttcctaattaaatttggaaccaagtatattttaagtcgttacgtccggatgtaaaatttaatataaataaatccaagtatatttttgtaccatggattttaagtatatctaaaatttaaatgtgtgtactgtgtattattatttccaccatgtttttccatatgtgccgatttagattaaattcaatttctttccacagtgttttagatgcgcttttagaagtttaatatgctgaattgaaagagtagatctcttaagtgaagtctgaaaggaaacaaaatatcggtgaattggctcatccacatatcataggagtttagcataatataaatgaaacatatgctaattaaagtaaaaacgatctataaatatagatgtaactagtttattattacagtacgattgtgattcataaatgtaaaaacacagaatggctgcttatttgaccgatggctggcaaccatatcacaccatcagagagttgattttcggctggtacttgcatgttgcctcatgtttgctattcagacggtgggcgagtctcatttctcatcactaggatgagaatttatcatcactatgacgagaaatgatcaacttaggagcctccacctccctcttgacatctttacggtctgtatctatctcctacgaaaaaaaaacaagtggaaaatgttaagagcaggagtgacaaatccagaactggagctgaacgtgaaccaaaaatatattaaaataaattacctgtgaatcattgggcttcgtttcatcgtctattaacatctgcgccttttggagatatgcattctcctcttgaagaccatactcattgactagggccgtccaagtatcttcaaaatcacttgctgtgcgtgcatgatataagttgtgtagttctgacttcgtaccaaataatatgtgccaacggcagcgtgggtgatcatacttctgcagcgactgatcgatcttctcgctccgggcactagtgttcatcttgtccatagctactggcaatataagtataaatttcagaatactaagaagaggtcaacatatatgagaagtacatatacgtacagataagttggagccatacctggaacagaaatgtgttgttggcgagaaccagagagagcaccagaagtgagcagagtcgtattgttctgctctttatatgttgcaattgtgtctccgttggaaggaatgaaaaaattaatatcattaccaagtataaagatcttatttatggtaatatttatagctattacgaccgataggttacataatataatttgttaccgtcagcatggatcgatccagtcagaattgggtatcaattgattaatttagtaaccaacgagtgatttcggtactaattggccatagtcaacgggatagagagagagtgaaaaaatgcacgtctgaataccacaagattaatgacataatctgtacttttacaggtgtacatgtacacataggtttatgagtgacagagcgaacacgtatacatgtatatcccacaagatgaatgacataattatctcagctaccagctctttcttttcagcactaaatctctgtatgataggtgtgatggaagatggtacacaacgcgaaaccggtgccacgaatttaacacgaacagccttcttccttgtaggtggagtgacaaagtcatcatcatcgtgaatggaacgacgcttcacatttcttctcatgctcgcacactttggaagccgcggcatgctattaaaaactaccattattaaaacaagcaatatgattctcttcgggtcatatacttcaatttaaaattaattaaatctatatttacaaagattataattgagatgtccacgtaaaagagacattgctgctgtttcactacctacctaaattttattcactggatgcaaatcaagatattcgaacgggcatgttatatacctaaaacaatctaaattcaactgcatttcaacaaaaaatctataaatttaggttccaggtgattcatcatgtgctcagtttagtagataaaaagaagaggaatggcgaatcatctatacataacagggactgcatgtgaatgtaagatgtgtgagtgataaacactgagatccatacctttcaggtaatgcagcttgctagtgaataatgtctgttccgaagctcacgaacaaccagcgacggcagcgaaaaggcacttggacatcaggcgctgtgatggcttgacaaaaatggttgaggagttctggtttccagcaagaggcttgtggacgaacgtcgtcggtgacgaaaaccacggacgtcggccctcttcacggcatggcgagcaatcccggcgaggtaactcggtgaagacgatgtggatagctagctcttggaccgtgaaacagtgtggaaaagaaaaatcaaaaaaaggaatacagtagccggttatatgtgcatcttgaaaatggaatgtaatcttgaaaatagatggcaataatcgcaattagtggaatggcgtcatttttcaaaaacgaatcatgattcaaaaggtaagtatctgcatgcaaacgttgtatatatggaaatgtgatatagaaaatggaaagtgctaatcataatgtgtatgcatgattagagggcgcaaatttggaaatacatgcacagtaaaaatggaaatacctgcatgcatgttctaaggaaagtatatgcatgcaactcttatcgggttagacccgttaatgtgtgatagcatcctctagtgtgttgcacggatcttaaagcatttggacggtggatggctatggagcccgggcaccatggtgcccctaacaaatttactatatatatatatatatatatatatatatatacatactataccgcatctggcgtacgtagtagctaaaatgctccccctcacatcctacccccacccctcccaacccacccccgtgcaccccaaccaccggcgccccctacccctcccaaatttactagtaaattgtttactatcgaatctacatgctatatatatatagactagcaaaagtgaccgtgcgttgcaccgggtgtttacggagtgtgtatagcgatcaaaaagtattgtttggtttagagaactaatctgctcaaaaaaaattgtttgtttttagataaataatatgctctatatttgcgcacagagtgatgtcacgatggataaaatttaactgaacaattttttaaacagtctagtatttcaataataatcacaaagttttttttaaaatattccactttacatgtgtatgatatgagcgatgttcctgacgcgttagcgtaacgattgtactacggtggataaatttaactgatcgatttttaagcagtttagtattaaaaaataataatcacaaatgtttttttacagttattccacgtatacgtggatgatataaatgttgtacctgatgcattggcgtaatctctaatttcgaaatctctgccgattcgcgtgcaaacaacccctccacgtggcacaatacgattccagcgttagtcctctccctcagccgtcggatcgatgatcaacggtgtggaatagctgcggtggacctctttgtaatatgtgaggttttaggggtctttttgaaaaagttataccctgctatgcccttctctccgccggcagccccgcccccgcttcctccgcctcattcgtcggaggtcgacctacgccgatgtcgccgcctcttcctcctcctcacgctccagctccagctccacctccgcccctccggcgcccgaggccgaccctcccacgcgccggcgcgctgttctgtgcgtctctcccctcaagctcggcggcagtggcacagattcacctcgtcgctggatgtggcgatgaattcggttgccgtgcttggggatggggagggtgaaatcacgtgcatcgctacgtccgtctttgcctgccttttgattcgccagccgcctctctccccaagccgcggcaccgaggggatcttggacggaggccactggccgtgccgcaaagggcgtggctgaggaccgcgctaccgctgccggatgacgtcatgcaggagcaggagctccctcccctgcttccctatgtgttcacaccacaggtgattaattccacctgtaaacggaatcggaatcggaatatataaagcggcgcacatggggcgagcgaggaggggtgccacgtaaggattttgctacagtatatacagcgcgcggggtggcatttttgtgaaaaggccctccgcttcgcgcgtaattcggccgccgtcctccatgaacagtcccaccgagttgtctatttacgtttaggcctctggtgaatacagttattgcataggaggaagggagatgtggcgagttagggtcgcgctgtaaaacttgaaagacgagggtctttttcgcaaaaacgccgtgcgcccagccccaagcccccaacctgcccgccgctgcctgctcgtctcctcgtccctcccgtcccccgtctcgccctctccctctccttctcccgcctcgcgtcgccgccgccgccgccgccccgcgcgccgcccctcctccctctccctcagccatcctcctcctccgccgccggtccattctccgcccttcaccgcctccgttgccggccaccactgcccccgtccacgcctcgcgtcgccgcccccatccccgtccccgccccgtcgctagggtttcgtcacgagcgacctcccgccgtggaagcttccaccttcctcctcatccttgtcctcacggccgcggcgttcgcggcgtaggcggcgggggacgggtgcagcgccggatgcgagctcgcgctggcctcctcatcctcgagcgcctccaccccaatactttcttcgtcctcgcctcgtcgcgtcgctctgtcttctcccctccctgcctcttcggttgatgtcttcatttcttcccctttcgtgcgaatgggaccaacggcggatcaagcgagggcgccgcagatcgactggcggcacagcttctccccatcctttggtgctgcattgctggtatcatcgtcgtgtttcccgctgttggtgcgtgtctcacggaggtaaggtttgcagcgtgcataatgatgtgcggttgaagttgaactcagttttgtgttccttttttgatatttcgattttcttcttttcatagaaagaatggattggagtaaatcagcagcggtgtggattgtgctctgacctcggcaggggcggatacaagaacacagcgatgagatccggtgcggtttgtggcggaccaagcatgccggccgatggagatggttctctgcatctacgcattccccaccaacatgccgcccttcaggtacaaatcaagtctgataaaacactgccatccttcttgtgttacatgttctgtgttacatggtggcctcctcctccaccacagcggcggtgtcggcaaacagatttgagaggtaaaaacatcccttcttgtgttgctttacggccatatttgagaggagaatggcatgatgctgcagtttgatttcaccggctttcctgcttgccgtatttgtaatctcaactttcatttcaagtgattgttggggccaaacctatggtggctagtcgctgaggtggtgtcattaatggaggcaaagagtggcaagtggtgaccaaagcggaaggacctggtgtgttgcgcgtgcgccggccactggcggtgcgaggccacggcgacggtcatgctgccattatccaagtatggctgctgaccaatttcttccctgaagtaggtgaggttagcccgataggaacacataccacctatattgtgatatttggagctagggcacattcagtcctgttatttgatctgtagcatcaaggttgtaaaattatcagttttgcagaggatttttggtcatcaaattggagttgatgatattttttgagacactgaattaactaatatcaaatatataatctggatttcccttcaactcaaagcttgttgttgtcttgttgtctgcgtgcatgctggggtggctcttctgcgggcgatcaaaagggcagtgacagcatgtattgacgaacgcaatgtgcttgctggccgaatagacatgaacacatatcactgagagggagtgaaacagtgttgacgagtagcctgcttttgggttagttcttgatcaagctaaaatgcacttctttttcttgatcggtataaagggcaccctttttttttcttgcagcattttcatatgcacccaatattgcccacacggccacaccaccatcatctataggcaagtagtatgttcatgtgcaaattttgcagggatcaaataaatgtcatttccctgatccattatttggctatctcgtgtacttgatgccgatttttaatttcttattgctgcatgaactatttcttttggacagtcagagtctcaatccttgccatcattaaccgagaatcttttttccatgattcttactgtttcaggtgatagaaatagcattgtagtagggtggtaatagcaagaagccgaaaggtaaggatcaggctataacgttggggcattggcaactcaattaaaaggtaagtatctattggtcacagagcttgacaactttgaatctttgatgatcgtattgtaccattgtttcagttgtagtggccattgttcctgttaaatgcaagttgatactaataaacccattgaatagaggccttcatataattcaatgtttaagagaaaccaaccgtggactggagctctcagattagtttattcaagccacttttttctagcatgcaattatttcgtggcttattgcattccctataattttcattgacttagaggaggtttggggctttttatttttaatgaggtgcaacaatctgtccatctcactcgttggtgcaattacattttttgcttgattttcttcactgctttatgacgactgagataaaaacttatctgtgcagcttcatgtttctgatgcaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtacacctccattctcggtgatggaagcttagtggttagttgtctgatcatggagcgcaaaacaaattatccatgtgctgatgtgcaattaataccaaagtatttgtgtgtcactatgatgtcttgtctgcttgcctgaatgttcttgttctgaattctgaaggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggaggtaataactaataaccattacaatttcttatccaaatagttcattcatctagcagaaagaaatttcagccaatttttttgtgttcacagccttggagcgtgcctgaagttgtgcgacctctgtatgaatcttctgccttggttgcgcagaagatatcgatggcggtacagtaattatagtaccctgttcttgatgttcttgttgatttgtaaaaattattgcctaattcagtcatgcaaaattcagtctttacgctgcctgaggcaggttgcctacaaagatacccgttctgtgatcacaggatggggaaggaagcttgcggctttgcatgctctgagccaaaaagctcaccacgtaggactcctgaacagcagatgcttcttggttcttgccatgaatcttcagttcaaaagtgtgaaaaataattttgcatgctctcttttcagaggcttcaatgaagttctcaatgggcttgcggatgatggatggtccgtgatcgagagcgatggcatcgacgatgtttgcatctctgtcaattcatccaaagtgaccggttgcaatgcaacattcagcagtggactcactattgtcagtaccggtgttctttgtgccaaggcatccatgctgttgcaggttagcttcactatgaaactagaattagtactttctttttgtttgttttgtaattgccaatatttttcatacaatatttcttctgctgtttgctaggatgtctctcctccatcactactgcaatttttgcgcgaacaccagtcacaatgggctgacgatgaaaccaaacttctgcaatttacccatgtctcgtcttggaggattcagtggtcaggtcatacttcctttagcacacacttttgaacctgcagaggtaagtccatcttctactgtctgtcggttacaaaaaaggtcctgtccaattctgttttcctgctcgatgttttggtgcaaccatctactgtttcagttcctggaagttatcaagctaggaaacaccagaaactaccaagatacactggtgcaccgtgatctgttcctcttgcaggtgacttcttgattcatgaaacttatcaccagttgaagaatcattttcttttttcctctgtaaaacttgtgttcttggcctgattgcaatggcagatgtacaatggagtagaggagagcagtgcaggaacatgttcagagctaatctttgcacccatcgatgcatcgttcagtgatgattctccgctgctgccttccggtttctacatcatccctatcgattctcctctgtaagtaaatctcacacaattagataatacactagcatttcgaatcaaattttctaaaatttttatgctataaaaaacataattcttctggattttctttccttgcaaatgttaggacacatctagctcgaactgcatgctggatcttgcttccatgctcgaagcagcgacgccatggagcaggatcagcggcatcaattgcagcggctgtgctgctgcggcgagctccaaggcggtgatgacgatcgcattccagttcgtgttcgagagccacctgcagggcagcgtgcccgccatggcgcagcagtacatgtgcagcatcatctcatcggtgcagaggattgccgtggtgctctcatcctcccgcctcgtccctcccggcgttgccgccgccacgcagcacgcgccggcgactcggtgctgcccagatggatttgccagagctataggtttgtggcttcgcagctgcttgtaatacagttcatatctgtaagatttttttaaaaaaaacagttcgcttttcagaactcatgatgctttgcttatgcagatttcattttggtgctgaactcatcaaatctgcagatgccaacagcagcagtgaatcggttctgaaagcagtttggcatcatcccagtgccatactctactgctctctcaaggtttcttcagcctctatttttctttttctgattaagatacagattttacctagatttttataaatacgtttttttaaactgttgaactgtatatttcgaacgaaaaaaattcatatagaagctttaattacaagataaatctatttttcaattttaaaataattaaaccttaattagtgagatgttaatgattttctcgttttacctgtccgaacttaatcttttatcttaaactcgaatggggccagtactcaatactgttatgcatggaggattgtttgttatctcaatttatttcagggacttttgaatttttcgtgcagcttgactgaaattttgttgacacaaattcaccttaaagttgacagtgttgcacaccattaaccatttgatttttcatgtaggtgatgccagtgttcacgtttgcaaaccgaagacggaggcggcgccaggcacaagatggcggaggaggtgaacaaatctatgatcatcaggaaaatcaatcaaatttatgttacctaatctatccaacaagtgaacaaattggaggcagctaagactacataagaaattgaaaagcacggccatactcttttgactaagtttcgaagtcaggcttgcaaggatagactaaagctcttatatcagtctttcttctcttagcaaattctcattgctagatctcagatcatcttgcaaacctcttatatcatttatatcattttccatatgcaaatctgtggttcatctctaaattgtaatgactgggtaagctctctggtcctcccatgtccttgacaataacagtaatatccttcaacttttcaacttatcttcattctcacaggtaagtcttgtaattcatcttctatttgtgctagccttgatgttaagtctgcatttataacggtactctcttgagtttctaaactaacttcatcaatggattatttgacaggtgatgcctggtaagtcttgtaattcatcacaggtaagtcttgtaattcatcttctatttgctgcactggtgatgcctacaaagagctcactgcgacgaacttcatcaactcaattctgaaggtcgaccaaaacaagcaagattatctgacgatacaaaatcattagaaagatctaaattatgtgtatttgcaatccggtgtgcgtttgtgcaggggtcaggcatgagagaggatattgtgtgtaggtgatcgatggatgctatgaactacctctgcagttagaaatgtgttagatcttgtctctgcaaagatgaacaccttttcttacttgttcaactcgatcagcatgcagtatcctgttcaatttttttccccttcagccattcagaaattcagaagtggctatcatgctttaattttgtttcagtcagtagtagtatttgttatctttgagggacagatgggcttgtctcttgtcagcattcaccttagctttacctcttactagtatattttatcactgagtgcgtttatgctcatagggcatatatatcttatgttggatataagtttttttttttttggtcttgtttagttaaactgaagatgcatggccgactgaacatgagaaaaatatcatttcgtttggaatgtcatggaaagcactttctgaatggctaacaggatataataaatatcagctctcacctttgtccactattgatagaaaaggaaaggcaagaagattgccttaattaacctaattgtcatcaaatcaaagtggccggcttatcgagaacctagctttgtctagaaactttgccttgaaatgaattgaaaaatcatgcatgcacttggcgtgtgattctcctccttcctattgacaaaatacttttcgccatgtcaacgccggaatgatcagtatacactatccattgatgcagattactggcgaacaagagcagcagctcttttccttttagttcttcttagctagatatgagaaattttcttggccaaacattgtagagtttaaacaaaattcttcggaacttacatgccggcaagcaaaggaacacaacaaagtttagcctaacttatatattgaccgattaaaatctgttatgcatgttaagaattgagacagaaatttaagccaaagagattaatctctcgtagaacagcacgcaaataacagacatgacaacaaggagcggtaattaattgagtatacctgtagtggtagtagtggtaattaattgagtatacctgtacttgggcctaatcggtggcgccttatgctgcg

SEQ ID NO: 39852 - DNA, 4569 bp, Oryza sativa
actgaaattttgttgacacaaattcaccttaaagttgacagtgttgcacaccattaaccatttgatttttcatgtaggtgatgccagtgttcacgtttgcaaaccgaagacggaggcggcgccaggcacaagatggcggaggaggtgaacaaatctatgatcatcaggaaaatcaatcaaatttatgttacctaatctatccaacaagtgaacaaattggaggcagctaagactacataagaaattgaaaagcacggccatactcttttgactaagtttcgaagtcaggcttgcaaggatagactaaagctcttatatcagtctttcttctcttagcaaattctcattgctagatctcagatcatcttgcaaacctcttatatcatttatatcattttccatatgcaaatctgtggttcatctctaaattgtaatgactgggtaagctctctggacctcccatgtccttgacaataacagtaatatccttctacttttcaacttatcttcattctcacaggtaagtcttgtaattcatcttctatttgtgctagccttgatgttaagtctgcatttataacggtactctcttgagtttctaaactaatcttaaattttttgcgtcatgttctataaactgtaattctatcgctagcatcttcacatcttccccaagctacatcagtgggttccttatatatatttcacttgcactgagttatttggaagaaggttctttctatcatttttgtacaattttactaaggtttgtgtttccatgttcctctcatgaattttcccactcgttaactatgtcttctttgatcttactgaagaaacattccaggatattcaaagatgcggaatgtatccacagactatgggagcctgagcatttttgtctttccaagaatcgacctatactctattgaatatggccttttagtatggcagctgctcatcatggtgctgggtccatagcaattcatttttcattttattctggctcatagtatgaacttgaagcgatttgtaccagtaaattatgacgtgcatagaaacaatgtacttattctcagacggtgaaactgaagagcttgagtagaattacttcacatgtgaaagcgagtactcattgtcctatagctgtaatcatattgtttgccttttctttttaagaagagtgttgtttggtttgttagatgaacttccaggcggtgcgcaaaggcgcgcccctagctctagttaagaaaaaagaaggaatttcttttgctgttttcggtggtttttgcgtgttacacgatgctactgaatattgctcagattggcaccaaggaatgaattagttgccaaaaattaactgtcgcattgtaaaatgttttgtctttgtctgaaatctgaagagttggcatttcttgactcacagtacgaaggtggcagaagaccaagcatccgtaacaccttcacacatcagcacctaggcatgttaactacatctctgttcacctttgcctgctagctgtgctctgtacagaattatgttaatcaagttcaatcaggtgtatttgtatatctacaagtataaaatttgtcctatttagcaacgaaaaacacttcaacgatgtaaggtagaaactaacaagctgaatacacaatgacacatatgatatcatagcagtatctgaaaaagagccctagaggcaatcatagagatgattgtatcttatactatgtttacatatttatccgatattgttccttgaaatagataattcattattagttaatgaatatgtgattctttcatgagactcttcatgttgtttgttactatttctaaagtatccctgatcaaatatcatatgtggaacaaatatatttatatgatcagcacatgtattaattgaagatcatgtctcatgtatcatggtatggagataccaaattaataatgtggacacatgttggtgaacatgttgttggatagatccaacatgagacactgcaagagccatatgtgttgtgtcattagtgatctcatttagtgttggtgttgaattcttagacctgagattatcatggttctcaacatgtgtagtagcttacttagggactgctaaacgctactctgtaattgggtagttataaaagtagttttcgggcatgctatgaaacatgtagtgggatatgaataatcaagatgggatttgcccctcctatggagagatatctctgggcccctcgatgttgtagattatgaaagtgcatggccatgccaaaggtgattgaggagtcaatcataagttatataatctatcaacaggttcgagtgaatgattgagctattagaggatggcacatatctagccttgagcttaatcaatatcgtgaggcaaatgggttcatacaagtatacactagaggttcagccgatatgatctttatgtatgcccggtgggtcaatacgttctgctaggggccgctgttgacgcgtggaccgaaaaggagttttcgggttacagccgagtatacatgaacctacagggtcgcacgcttaatgggccggaataaggggattggatggagatccaatattagcttaattcggatagagatccgaataggagtcctacgggccttggaggcccgagtgatggatcctatatattcgtgaggggtgtgaccggcggaggtattgcatcacgtgagaaaccctagtcgtcgcttccctccccgagcaaaaccctagccgcgcgcgggtgctagcacatctgcgcgtggcgttccgtccctgtacgtgtggataccggtagaggtgccgctggtttgcggtgctgatcagcatgggaatacggcgaggagaacgcacgaggaggagaaggtcgagccggtgcgatcgactacttcctctacatcgacgcgcgctacttcgcgagaattctttcgacttcttagcgcatttttccgctgcgcagcgcgtcgagtggtaacgatctatgatctaatatttgcatggttcctggtttacgcgatagaaaattttaatttatgctatcgtagcttacgcgtatcccaacaaaagaaacatgtatatatgtctattattgtctgaaatatgacaaatagtctatcatgtggttgtccttgttgataattcttctatgcaactagaccatcctgtcttttgccaatggtcatagctttgttatgagaaagattttactcttcctatgatagcttagcgagtatctagacctatcaagtttatgtcgtcaaacaaatttagttcatttattccagaatgtataggtcctatcagttgaacctactcgcagggattattcctgttgtcagttcactcatatagttatataataagtccaactcacaccttttgacatagttagataggttcaagaaatagaatattggctatacaatgtaccatgcaattttctgagcaaatctgatacagcttcataaaaatatggtccattttattcctcagagaaaaaaaaagtcttctcattttactatgaatattccttgaggccttgaagttagttattactgtgccaatgttgaaatgttcagtatatttggtgaatcatgatgctcaatttctctgcaaaccatggtttctgaattcttctctgagcactactatggttgagacaggttaaatgtgatgtaggagtacttcagcttttactatttcatgagttcaaaatataaattgatcattccagtgaagcatcctactatgctattctcagatgtacactacaaaagttcaatcgcgactccacttcaaactgaaattatcattgaagaatgaaaagcaaatgctctctttagctatcttttctgaaatagaaatgtgtcctttgattgaattataatcttatgtaacattttgaaacctccagtctggcagcatcatctctctaaagctaacgaatttattcactattccattccattaatctggtttcacttttttacactgaatcactgatgttgttaataatcttcagcaaaaagagatattctacagctctgtaatttatctctgcctgttggtagcactctgaagaatagcctgagtttatcacccatcattaactctctccgttccccctgtcttcgttgatgctgctatattgaaattgcattttgatattggttctttgacaactgtggagcagatagcaaattaccaagagaagggcagctcattccagatacggtggatcggtgacactatagagcccattccagatatcgtaactaatgccatggcagaggtagatatcatacctcttaatataataaacaccagttgtgcagcttcagaaatttatattgcagtttgtcaagaaaatagttaaatttctaattgagaaaagaagttttgcattgcatggcacacagttcttatgcttcaatgtaaatgattcagtcaagctagctgtgcatcttcctatagttcattttcaaataaacattgttctttgatgggtctattataaatgcagagaacacatgctttattcaaataaacaagat

SEQ ID NO: 39853 - DNA, 4912 bp, Oryza sativa
atcatgttggcagtctacttactattttggagcattttaatgaacacaatatattggagtatttttaaaatgaaattcccgagtctaggccactctgctaagaacactaggccattcaccgtaatggcgtggcaaagccatgccaagttttctagtgattgtactatgggaggaacacatggtgaatttcttggtcactttcatgtaagaggtgatggacaaaatttgtgtgattaaccaaaacaatttttgcatttaaaataggtaattgtatcataatactaatgataatcaagacggttttaaaatactattgcatatttacttaaagtgttgtagtggtcacaaagtatgtgatctcgcttcaaaatatgtggagtcatgtggagactggtcgtgtgacacatggatgatatatagcgcgttgactcttgagtgaaaaattttattacaattgactttttttatctcaaacaaatattaaagtgaaagttttggtgattatgatgtcaacaatataaaatatatcacttgtctgggaagtatacgtgtatcttaattttttttggggcatttaactatttgtcacttttaagatgtggcaaaaaaaattgccacttgctgtctatgacatgtgggccaccctgcgtttatgacatataggcttagtgacaaattctttttatcacttgtaagattggtaaatagttaattattcttttttttcagcaaaaatcaacttggtggatcagcaaaaatcaacttggtggattagcacaattacaattacaaagaaacttaccgcacctaaacttggtatattgctctctcgttccgaaactaccgaggagagccaaaatctctcgtttactctctctcttgctctctcgtttcttctcccccatctcatttactcctctcttggttggagggagtttttagttgggattaggagtttagagggatgaggctattaaatgtcttgtttggttaggagacataagaattttggtgagatggagatgaggaattgaggaaggaactccctccttttcaatacctgggtaggggtaggtaattgggagaaaattcctcctttactttgtctaagtaaatctcgaccatccgtttttattaatgatctaatctccaactaaactccctatcaatttccatcacctctaccaaacaagatattgagattaaaaatcaaattctcatcttaatttcatcatcaattccttcctgtaaactcccaatcctcttacctcgagttaccgaacaagccgctcgtttactctctccattcctctcccttctcacgctcgccctcaccagctctccgtcattccgcctcccgttgaccggcgctcctccacatctcctctccatggtcgcgtggatccgccgtcggcggcgacggcaggggtggatccaccgagctccatcatttgtccgcccccgctcgcgccgatccaccgcctctcgcgtcggcagcgacgggaggggtggatccggcgacctccgtcgtctctccgcccccgctgacgccgatccaccgcctctcccgtggatccgccgtcgacggcgacgggaggggttgatccggcgacctccgtcgtctctccacccccgctcgcgccgatccgctcgggctcgtcgtcgcgtcgtttgtgggctgcttcttcacgtccgtcgcctcgctcatcatctccaagctgcatccgccgtcggcagcgacgtgatgggcggatccagctcatcccttcagtcccaactctgtctggtgagcagccgatccgcgacgtttagatctttgctggttcttttgcggtgatcggtgacggtgagggatatcttttggttcttggttcttgcagggtgtccaggaagagaccggcggcggggagggccagaatggcggcggtggtgagggcggaggcggtggacacatccatcagcccaacgatgagggcgctccggtcgtccaagaacatggccatcacagaccaggccacgacgttgcggcaggccggcgagctggtcatcggcctcgctgcaggggagcccgacttcaacacaccggcctcgctaccgaggtaggtgccttctcttgctcccgagagaaaatttaatcctatcgaaatcatgatatctgtatccaagttgtgtgttgtaaggattgaattgattcacatttctaccattcttaattgtactctaattcatgcactaagtccacaaaagctcaaatgtttgtttgtgtataacttgaattggccgattttggcacttgcagtgcagcagacatctaagtaagcaatacctaggtgtcagagtacttgtgttatttcttatactgacaacctataaaaacacacacacacacacacacacaggcaactgttgctatttgtatgctaacttctagggaagaatattttgttttacttacttgctccctcttgttatacatgtgatgaatccttttttttatacatgtcgcgaagcagacggagttgggtttagatctttgctggttcttttgcggtgatcggtgacggtgagggacggcgccctccctggtcgtgggaccatgcagagggagacaggaggtattgaacccgaacctatcttgggccgtatggttgcggtcgaagattatatttcttgcggttttcttcctccaccttccgaatttcttcttctcgttttgaacttctatggcctttctttgcttcacttgaatcccaattccatcgtgttccttagcattttctcttatctttgcgaggcctacattggggtagagcctttccttgatctcttccgcttttactatgagttgcgctggatggaacccaacagggtatctggatgtgttgggttccgacttcgagatcgcctgaagtcgcgttacatccccttccggtgcccctcttttcgcagcaaatggtgggcgagatggttctatatttagatagaaaactcggatcccgtccttgttgtccctgaagagcagccagacaaaatcccagagtggaccgccaaacccgccctgactccctccctccagtctttcatcgacatcatcgatgacctccgaacacaggggttgtcggggtacgaagtcgctgccgacttcgtaggtaggcggatccaaccgctccaggcccgcgcccatgcggcctttgactactctgggctagaggacgtgacccgggtttctcctcggggtattttttcttgcatttcgaattttacttcgagtacgtctgtttctcctggcttatcgagttctcgtcctcgatttacaggtctggacagcgacaccgtgggacagcttgtcggccaggtgatgatcagcgctccctcagcggcgagcgacatcccggtccccctttgtgagaagggtccggtcgaacgcgtcgctgcaattaatgtaagtgtactcgatgactcctttacatccttctcctcgagatcgcgttgtgacttcacgttatgtaggttctccctctgcggacgtcatcggaccactcgcggaccaccaggcagcggcgtcattgaaggagggcgtcaccaatgaggcgtccgacgttgcagctgctgctaccacgagtggcaacaacgttccgaggaaggggaggaattctcctccgtactcgggacccgtcggaaggcgccaaacccggcggtgagcctccctcttgttttttaacgtgtagtcggagtgactggacctcacaccgtcgtatcttacttagactcggacgcgtctccccacctcagcgaaggcaaaggctagtgactagtgacgatcggcgagaagtaagtagacgttcttgaagtttttccattcacgaaatcttgatcacctagctttatgagaaagaggaaactcttcatagggcggcgcaggcgaaggcggcgcaaggtgggaccggtgcggcttccagtgcgtcccctgcagtgacctcgacagatgtagtggtcgctactaaggaccgggaggcgacgtcgagtagccccgccgtcaaccttgtgtctgctcggggcccgtccaccgatgccctcacctggggggagctccaggcggagatggagcgcctcctccaggccggtgctcggggcgtaggccgcgaggtcgaggaggccagggcggcagcgtcgtcagcaaaccagcgtgctgaccagctggtacgtgacttggcggaggcccgtgaggacctcctgaagatgagggagctggtggccggcaacgagaggcagcggcaagggctcgagcaccggatgttggagctcgagaacaatccgtcagaaatccgatgctcgctgcgggtatcgtacaccagcctacaccagctcgccggggaacgtggtgtcacgactaccagctggcctgcaaaatttgcacatgaacgtactacttgcctatagatgatggtggtgtggccgtgtgggcaatattgggtgcatatgaaaatgctgcaagaaaaaaaaagggtgccctttataccgatcaagaaaaagaagtgcattttagcttgatcaagaactaacccaaaagcaggctactcgtcaacactgtttcactccctctcagtgatatgtgttcatgtctattcggccagcaagcacattgcgttcgtcaatacatgctgtcactgcccttttgatcgcccgcagaagagccaccccagcatgcacgcagacaacaagacaacaacaagctttgagttgaagggaaatccagattatatatttgatattagttaattcagtgtctcaaaaaatatcatcaactccaatttgatgaccaaaaatcctctgcaaaactgataattttacaaccttgatgctacagatcaaataacaggactgaatgtgccctagctccaaatatcacaat

SEQ ID NO: 39854 - DNA, 760 bp, Oryza sativa
cgactacactttgctcttctccgacaactacgtgctgctccggcaattctccctctacgtcgttctcgcgttgcgaccgttccagaggtcttctctgctagtctccttcaacattggcttatgattcatggtggtcccctgcctcgcccacgcggtattggaaacactggcgtgcgcgttcgtcctgagttgtcccggggtctggcaaaccctgtgtgacgtctcgtccttcacggttcgactacattggcttttcggcgtcatcttcctcaacgattgccgtgattgtgtcaccgtcttcgtctccagtgcatcctcacgcaccttggtccatgacgcccctcccatgtgtccatgaccactctacggcgccctatgcgcgtcctgcggctcggctacctcgacatcagcttcctgacttcggctacaacgaccacggctactctacacacggcttcatcgactacggctcccttgcacccttcgctttggctacattgactacggcacacagggctatcatccgtattgagtactcttgccggtttcttctccagtccaagtgtccacgctgctcacgcttggactgtgggggatgttagagtcatattaggatatgattgatttgtgtagactcctatatctgtaatccttccttatctcctctccatgtactcctatgtatatcagccctctgaggctcaatacagtcaatccacgattcgcaatatcctctctccctgtactatccaacattata

SEQ ID NO: 39855 - DNA, 1731 bp, Oryza sativa
  unsure (1)..(1731): unsure at all n locations
agtgtcaaaacagcgaagccctatatttgcagtccaatattgcaatgtgcgcgggaagcagagaagagaacgagaagaattgagaaagaaggaagaaaggggataagaaagagagagaatagaggaagaaaatttagaggaaaagaaaaggaagtgggacccgcagtctagacccttcctccctgagttgacttcccccatggaagtctaaatcacttccctgtactttagtgtgtaagtccaaaggaccaggccctcttatgaagtctatttacctcctagcagagggaaaagtacacgcaaggtccctcaacttgttagccagatacaaaatcgtccctcaaccgcaaaaccggacatccggcgtcccccaacttacaaaaccggtcacaaaaggtccctcggcggttttgaccccggttttgttccacgtggtggctgactcagcgtgggacccacgtgggccccacatgtcagtaagccatgtcatcacctctctctatctttcctcccccttcctctctctctcacttatctcctctcgacaggatgggcggcccgggcggtgggtggggatgtcgccggggtgaggcgggagaggaggtccgacgatcgccgaccggcgacgcggcggcggcgacacgggagaagggaagggcggcggcagcccagcgcggtcgcggcggccaacagacaggcatgggacgggcggcgtgaagggcggcagcggcgcgtggttgtagacgaagccgaggaagacggcgtcgacgtctcccccagcctcagccaccggggaaggagctgggcacgggtggcagccgtcgagggcatcgtggcttcggtcctcgagcgccatcatggtgtcgccgtcgtcgccgcattcctcccgtctcgccgccaccgccaagccgacgcngacgcgttcttcntgcctngtcgccaccgcccagcggaccagcttggccgctgcggtcgcccgccgctccttctcgtcggcgagcacggagaggaagctgacgccgccgccttgctcccctcaccgccgccaccgccgccttgctcccctgagccaacgccgacgcattcctcccgcctcgatgccaacgctggcctccccgtgcctccctgccatcgtcaccgcgttcctcccgcctcgccgccggatttggacttgggaggagctcaccggcctccccgcgcctccgccggccgcgcgtgtggctccaactctgccgccgctcctcctctccgccgcttcttccccgtcggccgtgctgaccctcttctccaccgcgtcggtgacgccgccgccgccgccgcatcggcccttctctccgcgtcagttatgatggtcgtagccgcgcgccgccatcgctgaccgcacgagggggacggggaggccggcgaactcgcaccgccctgagcccgcgcaccgccacccgggagccgccgtcgctagccgcaccacctttcggccgcgcgcgcagccgcctgtgcgagagcagagagcgagaggaaggagagaaatagagaaagagagatagggtgctgacgtggcttactgacatgtggggtccacgtgggtcccacgctgagtcagccgccacgtgggacaaaaccagggtgaaaaccgccgagggacctattgtgaccagttttgtaagttgggggacgtcggatgtccggttttgcggttaagggacgattttgtatctggctaacaagttgagg

SEQ ID NO: 39856 - DNA, 4203 bp, Oryza sativa
actggattattgttcactattgttcattaatagagagtgagtactttagtgtttagctagcgctagagtagtaattaattgcatagacatggtgtctaggttattaattactagtgattgctgcatatcccatagttcattagaggttggtgtagaggtggtgacagcccttgagattatcacagtcctccctatccgggtacagagtagagcgtgttctggtagtagcgagcaagccagtgcctgaagtattacgatatgattaaattaagcttatgtagatattgttcatcactaggaaatcctcactaagaaataccaacatcaaccaacatcaacaatgacaccatctctactgcttcagccgtctgttgccattggctgagccagcatgtgtccacggcccagctcgcgtaccgctgtagccatgaatgagctcagattgagttcatcccttccattcggtcactgccttgacatgttgacaatctccatagcatcctataaatagcaccccatgcctcttctctgcttctcgccatcatccaccatttatccttaaataaatatatcctgaagctctacccttcttattctagatcgagtaatactgcacgagacactaaccgagtgcttaaggtcttgtttagttaatcccacatgcaaggggattgagaaggatttggagggggaataattcccaattttattgagatgtggaatttatcccgtcaatcccgtccgtcagtccttccctcttgagaattaaccgaagaaggcctaatggtatcacattccaaacggctcaagccaagcggagccccgccaccttactaaacacatgtcccaaactctacctgttaccccaatcacagtgatgcgctttaccatggtgtcgagcccgacttcccccacctcacgtttctccgttgttcataaccaagctcatgctagcacagccatgggtaactggggacaaaatatccttcccttacaccatggctgccaagcccaacccgattcttggccacagtcttcgctgggacacacagttttgcttttcagcctccgcttcctgccaccgcacccaacctctgaggataaaaacatgccccagtttttaggctcaatgtttatttataaacaatttcaaaatgattagatcatagagagaccggacaaggacaataaggtacaactttgtctacttaggtttttcctataaatatcaaaatcagtaatatcactgtgatattacgagaacacttatatagtaaaattgtttacacaatttatcatttataaacaacctatattttaaatagtatgtagtccttatatgatcggacattttaccccattctttttcaatgacattggtggagaaagcgtgtgtagtcccggttcgtaaccccctttagtcccggtttccaaaccgggactaccaatccgggactaaagatagatctttagtcccgggtgaaataaccgggactaaagctcgatctttagtcccggttggtaacaccaaccgggactaaagatcgagctgaccttttttttttttttgcatggccctgttgctgcatggtttatatatatatatatatatatatatataaaccatgcatatatatgtttcaatacatatatatgcatatatatatatatatattatattatatttatatatgtttcaatacatatgtacatgcataatatatatgtatttatacatatatatgttatgcaaatgcatatgtatatatatatatatgaccaaaatatatatttacattatagaaaatgtgtacacatgcatatagaaacatagtcatgtattaattacaatccattatatgtcctatctagctacgatttcgatgtagtagtagtcgctatctcagaagctaaggacatatgaattgtatttccgtcgtagtagaattcacccttgggatcaaggatttgttcattgatgaatcccatgagttgttcttgaaccgccgcgataaattccttgtgtgtgatcaggttatccctcatgcgaataaactatatgaatgtatgaaattgattagtaattaaacaacaaatcgatacgtaatgaaattttgaatttatttgtacgtacatcgagctctcttgtggtgatgatttggtctacaaggcagtggcaatactcgcacacgtagtagccgcacaagttagttccctgcttttgctttgcgcactataaataaatgacaaacgacgagagatctaattaatgtacacttgtatgtatttgaatcggagaaatataaatgtagagtatgtgtactcacaggaaatttgaacttccgcctaagtctttctctccatttgccgcggaccaaatgacggagccgataccaagccctacatggagtttaaagctatgatttgtagtagcaattaactataacaagattcttaattaacataggaacttatgacagtacctgtctataagttcgaaaaccttgtcaaacgtacactctttttatccgttgagtcatatacgttgacggtgcaggcctccaggtcgaagagtaaaagcacccagttgaatcagaatgtgcgtgggatgcattacatatgaaacacttagcatgttcgtacgagaatgaaatttggtatagaaagacagtaaaattaaactaactctgtgttgtacggcaacagtatgaacgtcttgtaatgctgcgccttcaggagatggatgagattaagatacgtactttctgtttctattgtagacatgggtcatcgtcgattcatgtatacatgggtcatcgccttcaacagtatgaatcgacgatgacccatgtatacaaccttcctacagtgcttaagatacgtactttctgtttcatccatacagtgagtgcaagccttgtaccccttgttggactgtccggataggttgctaagtgcaagccaatcgttgatggttacgaacaacagcgctcgtaggttaaactcctcctgtttgtcctcgtcccacacggggacaccttccttcttccacaacagtttaagatcttcgaccagtggtattaggtacacatcgatgtcattaccaggttgcttggggccttgaataataatcggcattattatgtacttcctcttcatgcatagccatggggggaggttgtagatacacatcgtaacgggccaagtgctatggccgctgctcatctctccaaaaggattcatgccatccatactcaaaccaaaccgtatgtttcgtgcatcctttccaaagtctttaaattttctgtcgatgtttcgccactacgaaccatcggcggggtgtctcagcatcccgtcctgttgacgctcttcagcgtgccatcccatcattctagcattccccttgttcctgaacaaacgccttagccgtggtattatagggaaataccacatcaccttagcaggaattctcttcttcgttagctgcccgtcaacttctcctggatcatctcgtctaattttgtgaagaaattttgaagcttgctcgggcagctggaggaggaagaagacatatatataggggtgggactttagtcccggtttgtgttaccaactggggctaaagatccctgagatctaccaaccgggactaaaggtatgatctttagtcccggttgtaccaaccgggactaaagatcccggggggcctgacaggacctgacagcatttgaaccgggactaaagatcaaatatgcccattaccctttttaacagggactaaagatcatctttagccccggtttttattgcatccgggactattgtggaattcggctgaccgacgaaagatggtttctccaccagtgtttagtcataattatggactcaaacccagctaagtggagttatattatacactacttcaccaccacacttgatattttatgatctttagtcccggttggtaacatcaaccgggactaaaaatcatctttactctcggttcatcccgtgtcagtagtctgtcagggggccgaggatctttagtcccggttggtgacaccaaccgggagtaaagatcatctttatagtcccggttgataatactaaccgggactaaaaattatattgatctttagtcccagttagtattaccaaccgagactaaaatttaatacgtagtatataatccctatcccttat

SEQ ID NO: 39857 - DNA, 20503 bp, Oryza sativa
ttgatttgagtgtattttttttaggatttgtgatgtatttgatttatgtttataagtaacttaagatttgggatgttactttgaattagggatttggggattgatttagggatatacatggcactagatttgggagaaaatatagagattaaatctggcaaaagaaaaaaaagcgctactatctctttagtcccggttggtggaaccgggactaaagataactatctttattcatcgattgatactcccagttggaaaaccgggactataggggggttaccaacagggagtaaaaaggctttctccaccagtgaaacatgtatttttcggggcgaagctatattgtgcttgggtgcacatggacccccccaatttttaatttctcacttgaaaatactagaatatacagtgttatactgaaattttctagattttcaatggtagtgcacctctcttgttttgatgctagcttcacccctgtgtattcttaaatattggtgtagaggcaaaaagttaaaagttatgcatgttttattaagaaaaagtctagtgtgtagtttagttgtgtgttatttattatctaaaaaaattgtgtgttatttacttcttatacatgatgcgttttgttgaaacagatctgtcagctctattaatagaaaacacacgactatataaaaataataataaaaaaggcaaatgcacactactaggaaaagcgttatcgcaagcagccgaaaagggtctttgcaggcgaggcgaccgttcgcctgtaagccaacgactgtgaagatcgctgatcttcgcaggcggagcggccggccgcctgcgaagataattttcgaggtggacattggctagtccggtccgtctgcaaaaataggaatcggccgccgtgcaaaaaaaaaaacttcccccctacgaaagataggtagaaaatattgaaatttaataataatttgcccgtaaattacttttaaattatttaatagaaattcttgcaggtagattattatatacatatattggaagattatcaagcatttggtacagagaaatctacatatattgcataactcaaaagtgttgccaaaatatatatattacaatacttttttacattttcacttcaaataacgtcatctagttacattatggcatagcagtgttccactcctgaagatccttgaattcgtcacttgctgctagggcaccctctgggtcaaagaaatgtcctttcacacgacaacactcatggtggatgaagtggcaaagatcacgctggacatttgtgatacctttatcgtcaaagcttgttcgacattctaatctgggaacgtgcaatctacagggtgtattctccttgaggtcattgaaggggtaatctggctcaggttctttggtttcggggtgaggcaaaagcatgtgcttgacgcagaaatccatcatttgcctttcaaactccgcagccccttcgtctctaagtttatccttgtacgcttcacgcttcttgtgggggtcatttttgaacccttccttccaactcatcttgctcaacatacctcgaactcttcccccatgctcaggagtacccagtgctgtacttagcacatctttctcccttttaggcttgaaagatcttttttttgtgaactggataaattttctattttatcggcaacactctgcagctccggattttcaaacgatacttttccttcatccgtgatcttcggagttctagctcttacccagttccttgatctctgtgtccactcctccattggtaccggttgccccttcttcctcatttcctcctcctcttttgtccactgctccacctttggtgcgtatcccgcggagcctaagcgatgaggaaatttgttcttcttggccaactctgcatacttttggctccttcgaatttcttccgaggagttcttcaacgtcagaaagtcgttccactgattcggggttatgttggcatacgtcgaaaatggtgtgcgtcccgtcttcacaaatttcttgttcaaggtggttttccaaccacaccaagacttggccattgtttgcagtgcacaattcctcactgctgcctctgatccatccgggaactggaagattttcttcaactctttccataggacttccttatccccattcgatacataatgacagtccttgaccgtgatggggatcttttcccttactattatgccacactgtgaaatgaatttcgcacgtgccgtcttaggggcgagcggctctcctttaggcgaaacatgggtaacaacatggaacccttcatcctttctattcacgcttctctcgcccttccttttcttcgcttttgctgaccgttcgcttttctttgtgccggttgtgttagctggtacgtcgtcatctttcgacggaacttttttcttcggctgccgttttgatcgccgtggcgccgtttcctacgagaaggtatacatggaagtttcgaattagctcgggctaatagttatcacggtgaacattttacatattaagtttacttaccccttctttagggggaatgtagtccttgtcgccttcttcaccgttgcccttttttcttctctttgggcttgggcttggacaaggatcgcttggcgacgagtactcctcgtcttcgtcagctacgtcgctgtcggaactaccttccggtgggaccgttggttccagagcaaccacaacagcaagggactgctcttgctcccctaaacccttctcttcagtccctttagttctatcggccatcgtttcaaacctctaatataaaaaaaagagttatcgtccacattttaaattactcaaattagtacaaacaactttgtacaaaaataaactgtatattaacaatatgtcgtatgatcaaatttaaattctctgagattcccaaatttaactattatactaaattaattagtacaaacaattttaaattgtgaaatattattaattagtacttactattatgctaaattaattaatacaaacaaatttaaattgcgaaactaattactacttactattatgctaaattaattagtacatacaatgtacaaaatttgatatgttattatcaagtagtgcactaattgacagttacatttcatcgacatgttgattaaaaaaaattgaaaaggcaaacatatcctccacattttttttaaaaaaaatgttaacataccctcccacatgttatttaaaaaatttgacaaattcacatatcctgcaaaattgaacataccctcccaatttcattcacatatcatccacattcccaaattcacattcacaatcaacatataacccctcattcacatatcacccacccctcatgcccattcacacccatatgcacacacatatataccccctcacacccacatgcacacacataaaaagaaacacccacatgcacacatgtccgtgttcgacgaacagccgacgatgagcttcggtcgtggatgacgaaggaagggccgacgacgaggttcggccgtggacgacgaccggccgaagacgtcgttcggccgaggacgtcttcgctcgtggacgacgatcggccgatgaagccgttcggccgcgagcgagatagagagagaggtggtggccggcggcggtggaggggcggccgacggcgcggtggaggggccggcggtggtggaggggccagcggctgccgcgcggtggagtggccggcgcggtggagggcccggtggcggtggaggggccggcggcggtggagcgggcggcgtatagctcgcgcgcggtggatgggtcggcggcggcggcggcagagttgtggagctcacgcgcggtggagcggcagcaaggggcggcggtctcggtgacagcgcgcggacgacgacggtcagcggcggcggaggacgatggtcggagagtgaaggtcgcaggcgggcgacggcgacggacggcggaggcgtgcggcagcgaaaaaattcggcagcctaacggcgccaaaatttctaaggttcccgcctggacttagaaattttggtttttcgggcttgcccttatatagggcaacgatcttcgcaagcgggccgtccgactgcgaagatgtaaaccctactctgtataacaattttcgcaggcggaccgcccgcctgtgaaaattggtacatagttgaatatatttattccaaaatatacaaaccttaatattattacaaaatatacaaaccttagtattattacttttcaaatgtataaatggttattgcacataaaaatattactaatttaaattttttaacaaatattttacactacaaatggtaaaaatggtaattgcacataaaaataattacacttttcaaatattactaatttaatttttttaacaaattttttacactacaaatggtaattgcacataaaaattagtacaaactaattatataccaccaaaatgataagtacaattgttcgtcaatttgcgatatgatcacacatcaccttacataccaccattacataactactaacttcttagatgcttacatgccactcaacaatcattaccctttaacatttttgcccacaccgtccatgcgcatgtaaggcttcacggtcttctgagtagatgtctcgacattcttaatcttctgtacaaactgactataaagtggcatactatcgtattggttgtaatcttcgacatcttcaaccccatccactcccaatatcttttgtttccctggtagcactatatctttcttcaaatttgaagggtctttcacataaaacacttgtgccacgcgattggcgagtacccaagggtcatccttgtgacccacactcgccaggtcaacaacagtaagaccgaacttatcaacattgactccgttcgggtattttacccactggcacttaaatatggggaattgcattgtgtgcccatagtcgatttcccatatttcttcaataaacccgaagtatgattgtttttccccggcttcatcaattgtctccacacggacaccgctgttttgcgtacatgtcttattatctcgggctcttgtgctaaatgagtatccattaatgtcatatccctgccaagaatttactgtagttgatggaccaaaagccaaccgcttcatagttatttcatcggtagtttgtccctcaggtaagtctaggtctcgcaaccaatctatgaagagacgcttgtgttctttcattatccactcggtggtgcgacccttattgttaacgcgtattagttcgacatgttgatcgatgtacggctcaacgatagcaaactgatgaagcacgctgaagtgagcttcttggaatgatttgtgatcatgggtgacaaatctcttctttcctattgttcccctaccactcaacctgccctcatgtcggggcataggtactccaattgcatatccatctttgaggtaatcgatacagcactcgacaacctcttcagtactataaccctcaaccattgatccctctggatgtgcacgatttcggacgtaacccttcagaactgccatgtaacgctcatatgaccacatttgatggaggtacaatgggccaagcgcaaccatctgcggcactatgtgaacaatgaggtgctccatcatatcaaaaaatgacggagggaaacacatctcaagttggcactatgtctcatgtgcgaatgtacggagatttcctaactcttcgagactaatgaccttctgtgacactgcgttgaaaaagtagcacaaccttgtgatagcaacctttaaatgctccggttttatggcccttattgcaattgcaagaaacacggtgagcaagacatggcagtcgtgtgaattataaccagataccgacaaatctttcattgaaactagtcgactgatgtttgatgagaaacctatgggcactctgacatcacggagtgagttgcaaaatgacttcttctcctcaggtgtcagtgtgaaataggctagtggaagataaactttgccattcttttctccttcttgagggtgtaactcttccctgattcccatctcgactaggtccattcttgattgcagaccatctttagtcttctttggcatgtccaacaatgttacaactatgttgtcaaacacattcttctctagatgcatgacgtctatggcatgccgaacctccagatctttccagtacgggaggtacttaaaaaatatggaatgcttcttgaatgggggagggagtttatcatctggctttgaactatcatcttgcttcttactatccccttgtttcgtattcttctcgggtttcttgcgctttgtcccctttgatggtttctttgtcatttttccaaactcgcaaacaattttctctgtcattgcacacaccttttctcccgatgtaggttttggtgcaggatcagtctctttagtaccatcgaactccgccttcatcttgcggtacttgtgatttgtgcgtaggaactgtaggatcaaggaggccgactagagggggggtgaataggcggttttaaaacttaatggcacttaaacaaaactaacctaagttgctaggcaaggtgaggtgcaaggttaactaacaactaagttaagttttgcaaacctaagtgatatgggctcaaatatgtctatatgaatgtaaatagcacaaatgtaaatgcaacaaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggcgggagccggcccacggagaggactacccaagcctcgatcactcggggtagttcttcctttactccgaaggtggcgaactccaaaccactcacaaacggtgccgggcctcctccacaatctcctcggagaggtcacggggcaactcctccacaagccgtctaggaggcggcaacctccaagagtaacaagtctaggatgcttgccgaggatgatcaagtgccacactagctataacaatgaagcattgcacttggattggcttaactcactctctaacacctcactagataaactaagtgcacaagggtgtgaaagctcttgcaagggttcaagataatgcaatggagtgccaaaaccttacccttgctgctggggagtgggtatatatacccccaaccaccaaaactagccgttatgtcgaaatccccaactctgtgctctgccggttagaccgccatagagtggccggtcagaccggactactttgtaacggctagaaaactagccgttacagggcaatcattgagcccactcaacctggccggtctgaccgcagtgtagtagccggtcagaccgtccaccgctcggtcagaccgccatcggctcggtctgaccggttgcgactctggcggctctgtatcgccaccaaaaaccagaccaatgcaacagaccagtggggccggtcagaccggccttatcacgccagtcagaccggctaacaggaccggtcagaccggcctaaggcccacggtcagaccgcaggtcacttttcagcttaactgaccgttagtaaaacggcgatatctcttgactcgggtctcggaatttggcgttcttggactctatggaaagcttattcaaagggccatccaacccatgaaaaatacatgcaataaacacaacttaagtcaaggataaagggctcacactccaaaggatatccaccggacatacccacaagatgtcactcactcctattggacatgcccacttctctcttggtttaggacttgagaaaactcatcaaacttggttagacaagcccacaaaatgcacctacatgcatatgaactaatatggcacaagatcatccacaagctcgcttcatagacccctcttgatagtacgacgtctatctagcaaatccggtctacaccaaacaccaagaccgggaaaagactaagaaaacattcttagccacattatacctttgccttgcgccatccatcttggggtcaagcttgagccgagatcaacacttgtgaccatccggttgaaccatgtttatgccgaggtcttgtccatcctttgtcaagactttattctcataacaagcttgacctcattcttgccaacatgacgatgtccttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatggatatgtttgttgagtattcattaacatcacaagtttcatatactcgtatgcaagctcaagtgcaaagattcgatataaataataggtgaacaacatggatctagaacatgcacaataaatatataggatttgctccccctaaatatatgcatacaaataaatatacaagagatgcaagtgtatgcataattagagaatgaccaatgggggtttatcctatacatatagtgaaggcatatgtagtaatgatgtagaccaacataaaacatataccttcatgatctccatgttctcaatgtaaatgagactaaataagataacattcgagtaaacattagtctcacacttatatatcaataacatggaaatcatatatatgaacctatccaaaagtaggagataagaagtggtatatatcgttttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttcattcttttctctctttggtgatggataataacccgatataaacaatatagagagatgacatgaaaaatgatttcaaatcaagatagaaatcttataataaacaaaatatagaataagctccccctcaagatgtgcatacatatggatatgaaggaacgcatatgcacataatcaataaagatcaaataggaagctcacactatattttggatccacaagagagaccaagttagaatatgtgaagtttaatacatacctctcatcatttttactttcatatccaaatgagactagtcaaataaaggctcataaaaacgttagtctcatataaatagatttgtcattaatcaccgaaaccaaattaaggcacttgaactttcaagaaccgccggtgccgcatgtacacaagcttgttggaacccgggagatacctatagtacgttccattcaagcagatcacacatcctgttttacctttaatttgacctgaaactgtgaagatgatggtcacgaagatgatggccttcactgtgaagtattcccttaagtactcgtcccacactttcaatccctctttccataaatcagccatctcttccaacaatggttcaagaaatacgtcaatatcaataacaggctgtcggggtccctgtatgaggatacagagtagtacgtattttcgcttttgacaaagccaggtaggaagattatacatggtgagaagcactggccaagtactatgtgagctgctcatgtctctaaaaggattaactccatctgtactcagggaaaatctaatgttccgtgggtctttagcaaactctctatactaagcatcaaagtttatccacttacgagcatctgccgagtgtcgaatcatcccatccttcttgcgcccttcttcatgccagcgcattagttccgcatctcgcgggtttgagtataaccgtttaatgcggtctttgacaggaagataccacatcacaagctgcgggatttttctctgtcgtccctcagttgcttcagagggttttaggccagtattgctattcgacttgtaccggcttgcaccgcatgttggacattcatctaaagaagtgtactctttcctgtacagtatgcagtgatttacgcacgcatgaatcttttccacaccaagtgaaagggggcatatgagtttctttgcttgatatgtgctggatggtagtgagttaggtctcgggagcattttctgcaaaagttctaatagactgtcgaaactggtatcagaccatccatgcctcacctttaacctcataagttcaagaactgaccggagtgttgtgaactcactgtcagagcccttcgactcattgtacaaaacttcctttgctgccttttgtaaagcttcaaagttatttaaccctctagccgatcccatcagcacctcgggttctgcatgacgtaacatttcctctaggtcgattttgtcctcaacagaaccatcgtcatgcaccatgtcttcaacttgtgtcggaactacattttcaggggactgggctaggctccggttttctcggtgtgcgactatgggcgatctccggtgatctcgtccatggtgacgccggcaccaccgggaggatggaatctctcccggcgatgctattcgtgaggaggcctggcgtcgcttccgttcgccggtccatttttcttcgaaattcagttcaacacctttccgattagttgtggatcttccccgtgctagctttcatctcacttcttcttcggtggctttggcccttagggcggccattggctgatctcctgccaatctcgctatctctcatcttaaggatcgctcctactcctttgtggtctgttcgaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagttaaagcatcttttataatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccattacagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcatgaaatattagtaagtcattagttatcccgaatgtgtactaatgtttctaagcagggctaagcaattatatctaatatctagttgaaccaatataaataaagctcaactagtcaaattgtaataacccaaggtatcaaggaatagagtaatcaatgcgaacaggccataacaaaggaacaggttcacaccacccggtgacattcgaaaataaatgcacagttgaaataaatagagaatttaaatataggatcaacatgctcaaaggattgtgtttaggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccgggcgcacgggcggcggttcacgcgaacggacggccgagatctaaccgatccaagatggacggccgagatcgatcgggtccacggcggttcacggcggacgaccctgatgacgtcagcggtgacgtcaccgacagcggcggcggctcggcagaggagacggctcgggcggcgcacgctcgccggcgaacggcggcgccaggacgcaaacggagggcaccaagacgtagaggacaacacggcgaactcaccggtgacctaaacggcggtggaagaccaacggacggcgacggcgacgaggaggaagcggcgggaaccttcgggtcaacgacggcgaagctgctccggtgatctccggcgacggcgaaggggcggacgaggacggcgacgacttggcgagcacgacggtggtcttcccgagcgacggcgacggctgaaacgacggcggcgcacggctggagcggcggcggcgacggcaaagctagggcacacggcgctagagctcttccggcgacgagaggtgaaggcgagggtggcggcgaaaagagaagactccgggggtccttttaaaggggctcggaggcggcggcgaaggcccacggcgacggcaacgacgaaggaaacctcggcttggagagaaagaaaaccgatccgaatcgaactcgatcccaaagctttccaaagcgatttaaccgatgattccaaaggagaaaaggtagaggagatcccggagattgtttctcctcttttgattcgaccggagaaggaaagaaacggccggattggaaggaaacagcggcggcggctcggcggcggcgcgctagggtttcggcccgaggaagacgacgggcctgacaggtgggacccacctgtcagcgaccgaacgcgcacgcgcgcgcgggcggctgcggactgggccggctgggccgaggagagagagaagagaggttttgggccgactttcggcccaaagccaaaagaagactttttaaaacctttttcaatttaaattatttcttaaatgcaattccatttattaaaatacttccttagctcaaataaatcccagaaaaatctaggaattatagaattaagcaaagtatttaatgaaattttatctggccactttttatattggattttattaattagaactatatcttcttttcaagacttttttttaaaataaattctagaaattccaattaaacaacaatttatataatttgaatttttagggtgtgacaaacctaccccccttaaacagaatctcgtcctcgagattcggaagaactggcaaacaggtgcggatgagctgacttcaattcatcttctcgttcccaagttgattcttcttccgagtgattactccattgaactttgcagaaacggataactcgattcctggttcttctctcatttgtttccagtatacggattggtttctcaacataagtcaaatcctcttggacttctatctgctcaatattagcttcttcggtaggtacccttaaacactttttcaactgcgacacatggaacacattatggactcctgccaaagattgaggtaattctaactgataagcaacctctcctcttctactggcaatcttataaggtcccacaaaacgcggtgccaattttcctttggtgtgaaaacgatgaacccctcgaagaggcgtgacacgaagatacacatagtctccttcttcaaaactcaaatctctacggcgattgtcggcataactcttatgtcgagactgagccactcgcaatctttcttgaatgacctttaccttttcttccgcttcccttaggatatccgtcccgaaaacctgacgttctcccgtttgatcccacaaaagcggagtgcggcacttccgaccatacagtgcttcgtaaggagccatctgtagactagcttgataactgttgttgtatgaaaattctgcataaggtagattcttatcccaacttccaccgaaatctaaagcacaagctctcaacatgtcttccaaaatctgattcaccctttcggtttgtccgtctgtctgcggatgataagcagtgctaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaatgaaatgagccactttggtaagtctgtcgactatcacccaaatagagtcatggcctgatgacgttctgggtaaaccagtaataaaatccatacctatttcttcccatttccattcaggaatcttcaaaggctgcaacaaaccggcgggtttctgatgttctgccttgactcgctgacaaacatcacatactgccacatattctgcgatttcacgcttcatacttgcccaccaaaatctttccctgagatcctggtacatcttagtactaccagggtgaatggagtataaagtatcatgagcttctttcagaattgcatcttttagatctttgttgtcggggacacagattctcttacccaaccatacagttccttgctcatcctccaagaaaccgatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggacacatcgcaatacacttgaaaacccttctttggatcaggcaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccgataatatcctgcgaggcctaggaaactgcgaatctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaaggcgaagatgttcctcatgctcttctttggttcgagagtatataagaatatcatcaataaagaccaccacgaacttgtctaggtattccataaacaccttattcatcaagttcatgaagaaagcaggggcattggtaagtccaaaagacataacagtacatttgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatttggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattttgacagaggggctacgttgcaaagagagtgcttgattgcttggggtactaaccatcaaaggacgtctaagatcttctacttccatctcatgatatcccgcaaaactcatagataggaatgaatgtgtagcaccagaatcgaaaaagtactgttgcaggaactgagttaacaaggaacgtacccaaaatcacatctggagcatcttgagcttctgcagcagcgacatgatttacacgagccttggatgctggtacagcagagttattctgggcagggacaaccttcacgcgtcggggcttcggacacttgtcagcataatgtcctggatctccacagttgaaacacaccacgggcttgttgccttgctccctcttagcaggttgttgctgtgctggagctgcaacaggacgtggagcttgattacggatgttgttgccagcattgttgttgaagaactgacgttgcggacgaacaacagacgaagaacctccctgtggcatagactggggtcctaaagtaagacgtggcttctgattatttccctgatgtgtcttgaattgagcaatccgacgtttcttctgctccatgcgattgtacttgtcctcctgacgaatagccttatccactaatttctggaaatcaggatgatctccaaccatgagtgggtaagaaagctcatcattaagtcctcccaaaaacttctcctggcgctcttcatcattgcgcacatcttccggagcataacgagcaagacgattgaattcgtgcagatactccgtaacagagcgagatccctgagtaagcgacctgaactccttcttcttgagagacactactcccaatggtatatgcgtcttccggaaagcagcggtgaattcaagccaagtgataggttcagcagtagtcctgttaaggcggaagtgatcccaccattcagaggcagggccatgcaactgatgtgatacaaatgagaccttctcctgatcagtacactgaagtaaatccaacttcttctctatggcatgcagccaatcactagcttcaacaggattagtggtactagagaaaacaggcggcctcacacgaagaaattctgctaacttattctgtggaggtacatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatggacagggcacaagaagagaaaccggggaaactacttaggacagagaattactttaacttttattgatcttaactgagtttcattattacaaactgaagactctcacaccactaaactcaccaacttcctaacactcaaaagcaaacaaacacatgcaattacatcccaccactgatgtaaatcacatgcgagacccacacacacaagcaaactttaagcaagcaaactaacacaacgatctaagacaacgacttaactagtcactctagttcttccaagcatcggaggtcgattgaaggctcgtcttcatcatcttgagttgctacccactcaatcttagaattgttgcgcttggattcttcttcttcatcactacttatgatgatgaccggaggatccgcttgagctggagcaacttctttctccaccacacgaacctttggcgccagttgatagcgagggacaaatagagctctcttccttgcggtgagacgaatcctggccttctgcggcggtgcttctcccttcaatgcggctaattccttctccaaacgatccaccttgtcttctagcttgcaaatcttaccacgattccggtcttcacgatcttgagctgctaacacagtctccgcacgactttcatccatagcccacaacatctccaccaaatgcttcgtggtagcatcattctcaattccttcagtctcaaggtaactgccacggtcacttccctgaggttggcgaggatggtggcgatactcagtgtcggccaattgatcactgtagcgatcacggagctctcctatggcgatccttgccacctcctgacatgcatggatatagtttcttcctccagcttcaaacatcactgaggggatatcttcactattactgttcaaggtgactttgactcgtcacttctcttcatgacgatcatgaggaatctgggcataaaaaggagcagtcccaaatccaatgacaaaggacatcgtacgcaactcctagacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaacagttggaaacgaggtcacaaattttgtaattttgaataactggtttcaaaagaaatgaaagaaaattataaaatcagcatgctaaatttattttattgcagcaagattaaataaaacagtattgtaaaacttttgctggtaaatgagccattagtacagtagtagatgtacagtactaataacactggaataaatttttaatgagaaccattaaaagagattatgaagtgcatgtgccataaatttggtttaattaaaagaaaaagggaggagaacacttctacttttccaatattttccagagggcttctatgggtaaccatttggcataacctagggtcaaagatgctctgataccaacttgtcacgcccggaatttctatccaaaattccaaacgcttacttgtgtgtgaaccctcgtccaggaatcaaccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagttaaagcatcttttataatgatgagaggtgtgagactaatcacgaaagacattgttagacccgcccataaccgcgggcacggctattcgaatagttttactctggccagaggtgtaccactgtacccacaagacacaaccccacatcatgtcaccatg

SEQ ID NO: 39858 - DNA, 3535 bp, Oryza sativa
  unsure (1)..(3535): unsure at all n locations
cgcgcgcgcgcgcgcggccgncttcggactgggccggctgggccgaggagagagagaagagaggttttgggccgactttcggcccaaagccaaaagaagactttttaaaacctttttcaatttaaattatttcttaaatgcaattccatttattaaaatacttccttagctcaaataaatcccagaaaaatctaggaattatagaattaagcaaagtatttaatgaaattttatctggccactttttatattggattttattaattagaactatatcttcttttcaagacttttttttaaaataaattctagaaattccaattaaacaacaatttatataatttgaatttttagggtgtgacatcgaagcaagtgggtttgtgggtttatcgtcttaaatcttatacttgcgatgattttgctcttcgtttcttcctctggagacatggggggccgaattggcagtgggagtttgactcttggagtcgggaacaggaaaaggaatgggtgcttgtggctcccaagaaaagatcttcgtcttccttaaggcggccggatcgttcttatgctcaagctgttcagaatcatgatatctcaatcaagcatgttttttcttgtttaaaagactccctgtgtgcctctaagcctgaccaatgaagaatctctattttccaccagcttgagcagagggaaatgggttcaggctcttctccggcgaactccaaggcggctgacgtctcgccgctgcccattccggcaacggagttaatttcgcataccagaggtacgcgggatcctaatttgtcacccaatttgaatttggaaatcaatctttgcggccgttgcctggaaaggggtcattcgagggcttcttgctctaggcctcttagatgtaaggcctgtctcatgccgggccatttagcccgttcctgtttggcctctaagcccacaaaagccccgcaccgtaacaatccgaaaccgtcggctcggactactgcagtttggaaggccaaaactattcctccggaaatctcgccttcttcctctagaaacccttcctctcctgaatgcacagtgcttcccacccatagcttccctcttcccccaatggccaatctaaaccctaatccgctgcgcttcctaaggcaggggctcgctgttcatgcatcccgcgggttgacctcactgtcccgcagtgccctgctcggtgccatgaagacttttgtgtggccattgttgagccaatccccttggagcaagactgggatcatcattgggccctcattgccaacttcattcaagatgaacttcactacgaggttcgtaacagcttccggcacccgtttgcggtaggttttttccagatgaggtctgccatgaatagggatgctttggtcctctctttgcctgagttctatgatggggttcaccctggtacttttgttaatcatgaccaaggtcctaattggagggcggcaaactttcatagagaaggctggtttatgttcctagatttcccgctagattttattgatctccatcatgtgcacctggcagttgcttcttttggtcagttaactttttgggcggatgcggacagaatgttgggaagggttttttgttagagctaagtacagggaccaggattctgtgccgagaaagattgtcctctttgatcctcttggtgctgggggtgggggagaatcttggactgtttcggttttcatgcttcagggagattttataaattcccccctgaagaggacctcccccctgctggtcctcagccaggccctgatgatgcaactgatgatgaccccgatgctggcaatgtttggcagtttggcaaccctggtaaccagggagctggaggttgggatgaggcagtgcagcagcaacaggctgcaaatgaacaacaagaagatgcatggggccaagatcatccaatggggcagattgaggagaacccaggacaattgattataccacagcagatggccacaccttgcccttcttctatgatgacaccaatctaggatcctgttctagagccgcaagtccaggaatttttagctcggttgaatagaattgccaaaacagaatctccaagtcacccctacctttatccaatgaagggtatactggacaagtttgacttgctctgtaaagcaaagggtatcatgcaaactttgatccacgacaagcctattcctgctgctttaaagatatccaacttttcggcattggtcctgccaagaaagtccatctatggttccactccttaagtgggccagcatgaatctaaatgggctctgcaaccttttgagtctattttaccccctcaagaaaggatgattgaagatgtcattccaatcagtgtgatgccccctactagcccaaccactgtggctagtcccatcagtatggcacctgtggccctgctccccccaaggcacctgtaaagaagtgagatgggaagaccattctctacagtccctacagaagacaaagctcaagacttctgcaaggaaatgcaaccaaggatttgcagatggacccaagaatggggattaggaagccaaggggaaagtctgctaaaaagctaaaagaatttgcaggtattgcaaaactctttattgatagcagtttgcacgagtctgatttcaatgaaacttcttatagtgatatgaactctgactcctctccctctgattgttcactttcggtcatacaaaagatgggggtggacatgtgcggcctctctcctaaggaggtggctgaatctagcctggggggtgaaagaaggcagaagatccccaggctaaacatggaagataattgatgaagcaatattttgttctgttggcaggcctatgttttacagttatcatgttacaagggtctgtaatctgtatgctgtcaaagttgctttaccagaattttatcctgtcagcatgtcaacactggtatgtttgtcttttggattggtcctggttagctatgctagccttggtatttttgccccattctcaatggtgtgtaaatgactagtaattttaaatcctggaatgttttatgctggaacattagaggaatgaatgctgagaataagctcctgtctttaagatagaaaattgataagagtgattgccgggttttgtgtcttcaagaaacgaaaaaagagaactttgacctttctgagatcaaaaaatttgctcccaagcgctttgactcttttgctttttccccctccatgggtgcttcagggggaattttaattgtctgggcttcaaggacctttagtgggattctcaaagaagttaaccctttctctgtgacagtagaattaacttctacatttacttcacaagtttggtccttgactagcatgtatggcccatgcaatgggcctgaaagaccagactttgtgggctggttaaaaaacatccagatcgatgctcaacagaactggctctttctaggggactttaatttctacagatctacttatgacagaaataaagtgggagccgat

SEQ ID NO: 39859 - DNA, 1252 bp, Oryza sativa
agtgatccctttgaccaggaatatctctgatcatgttccttgtgtagtaaagattgatacaaaaatccccaaatctccaatttttagatttgaaaatttttgggtggaagctgagggtttctttgatgtggtgcagcaagtttggctgctggatcctggttttgatgatccggctaaatgtatatccttcaagttgaaaattatgaggaaaaaactcaaactctggagtaaaaatctatcaagaatcatgcttctcttgaacaattgcaataaagtgattgattttcttgctctgttggaagaagatagaagcctctccttatttgaatggaatttcagggaggtagttaaacatcagatcctcaaacttctagaatacaagaaaatttactggaaaaaacgttgcactaacagatggatgctgctgggagaagagcacaccaaattctttcaatctattgccacagaaagatacagaatgaacatagtttcacaagtttcgaatcaaagtggccagatagtttacttacatgaccagaaggcaaacttgttctatcacagcttcaagaacaggatgggtatctcttgctccccaacaatggatttcaatttgactgagctttttgtacctagaacagatttggagtgcctgatcgacatgttttacacgcaagaaattgacaacctcatctctataatccctgctgacaaggcccgtggtccagatggtttcaatggttttttcatgaagaagtgctggcatatcattgcacaagatttctacagacttgtagctcattttcatgctgagtctacagatttacaggtcttgaatagttcttttatcactcttatgccgaaaaaactctctccagaaacagttaatgatttcagaccaatttctctaatgagatgaagtctcaagtttcttacaaagttgatggcagatagattgcaaggtgtgattctcaaagtggttagtaaaaatcaatatggattcatcaaaggaagaaccatccaggattgtttagcatgggcttttgagtatattcatcaatgtcagcagtcaaaaagagaaataatcatcctcaagctagactttgaaaaagcgtttgatacaattgaacacacagccatcctatctgtaatgcaaagcatgggattcccacaaaaatggctaattgggtgcaaatggttttttcctcagcaagcactgcagttctgttgaatggggttccgggtaattctttta

SEQ ID NO: 39860 - DNA, 17589 bp, Oryza sativa
aattacctctctctgtgatcaaggctatcgatacagcaagaaggaattgcctttggagaggaaataaccctgaatctaccagaaaatctttggcctcatgggaaagagtttgtatcccaaaagaaaagtggggggggggttaggtgtggttaacctaaaagtccaaaatgctgccctgctcatgaaacatcttgttaaaatctacaccacagctgacatcccctaggtcaatcttgtgactaattcatacctaacagctaaagtccctcatcttctaaacaaaggatctttttggttaaaagatgttattgctctggtggagatttttagaggaattgccaaatgcaacataaagacaggtactacagctcttttctggacagatctgtggaatgatcaattcaaatgtcagcaatatcaacatctttttgcctcctctctgtacaaagatgattcagtccaagctatgtgtgccagacctttggaggattcttcatgctgccactctcttatcaagcctattgtgaatacatcaatcttcaagatgaactgacacaccttcagctggaacaaggaaggggagatttatggtgcttcatctggaataacaactgttttacccccaaaagattctataaggtcaactttgcttctattcaagcacccagacctctcatctggatttggaagaccgagtgtgtaatgaaaataaaagtctttgcttggctattcttctgggacagattgaatacaagagatatgttggatagaagacactgtgccaaacaagatgatgatctatcatgtgtactgtgcagcagcaaccaaagggaaaccagggatcatctcttctttaattgtccatttagcaaagcttgttggcagtttttgggaatttcatgtaatggtaatctagaattttaccaaagaatagcttttgcaagatggcagtccaaccagcctggttttctggaaattttcttcgtggctgcatggcatatctggaaacagcataatggactcatctttagaaatttttcagcctttcttccattcttggaaatctctcttcacaaatgagattcttctgcagctttgcagaatgaaagatccactgaagcaatctgtttctaattggttgcaaactttataggacctttttcattttcttttgtttcttcgtgtaaattttactataattattctttcaataaatgaaaatcacactgttgggcaaagacctggcagtactttcagtcaaaaaaaaaaactacattttcaggcctgtccacttgttcttcgccatgacgtgtctatatttcgtacttgcccataaatccacgagttactaagtactccttcactttaaaagcatcgtcaaagtcccaggctatttcattcttacagtcagcatatggataaattatcttcctcatattgttcttctcagcgtgtgcattggcaataccaataaatttagacacttcgtttctatatggagacaaaaacctcggccaatgatacatccattcctgactttccatatctctaaaaaaatacacgtaaaatatttgcacaattaataccaaatttgtagggtttattgaaaaaacttatcgctattcaaaactaattaactaaaggttaagtgtaaattaataaaaaatcaaagtttatttcaattttttttacacagacatgccaaattagtacattaggaaaatctaacaaaatcatatcatcggcatatttcaaaatactataactattttttgattgcaccgaataaatatacattaaaaattttattctctctatatatgacaagatctagatctagatctagatctagaactaggaggtggatgtgatagcaaaaataaaaaaaattgagaatttatgttaccacattaaaccactacaacaagaggcatcaagtattacacatacatttaacatcaacatatcaaaagaaataaaattaaaaaacatggagctcttccttcacaattttacatgaataaatccatcacaaattaaggtctaaaagcttaaaaaattgcatacctagtgtggaaatgagtagatttgaagatttgaagtaccgtagaaaaatcccccgaagatttgaagttcaaaacctcccccctatatttaagtcactttaggagagagaaacttcagagagaatgaacagggctcggggaggaagaagactatataggggcttcttttcaggcgggccatataagcggcgcctgcgaagatcgatcttcgcaggcggaccgccccctccaccctgggtactttttttgccggcggggttttggctccgaattacatgcccgcctgcgaaaatcgatcccctacgacgccgaaaatgagttttctagtagtggcatgattaccagaatcatattatatatccagtttaattaggcctattttgatgggcctctatccctgctcacacacccgtacgtacgtaggccaacattgagacccactcgaataaggcctcacaggaaatgtgcgtagtacgagtatatgtcaaaaaaattggaaaaagtccactttgactcccttaaatatacatcgaatctgattcatacccctcaaccgaaaaaccggataggacgactccccgaactactaaaactagtacaatttgactcctctatctagtggttttggagagcggttttgttgatgtggcgctgacgtggcggtgttgacttggtattcgtcccacgtgacacttacgtggcattagaatttaaaaaatatatacgtgggacccatttgtcattcacacaaaaaatatattgtgggacccactgatatgtggggcccatatgtcatcccccctctccaatccttctacccttctccccttcttctcctgcgcccaccccactctctctcctggtggcggcgcgggggctaggcacggagatccgaaggcaatgcgaaggcggggcgaggtggcggtggtggcaacggtggtggtgtggaagaggctcgccggccccctctctccaggtggccatggacagcgaggaggagcacaacgcggagatccagaggcagcgtgaaagctacgcgaggtggcggtggtgggcgggcagccaccctgctccatcttccatgccagctcgaacgcgtactcgaacctcccgtcggcaacgaagccagcgaggagggtgttgaagaagacgacgtctgaggcaaccttcgctgttttcatgcgggcgagcacgtgcttggcctcatcaagcttgcccatgcggcaccacccgtagagtagcgcggtgtagtggcggagcgagagcgggagcctgggctagagctcctcgacgagttgctcggcggcagcgacatggccggtcttggtgagggactcgaggagggagaggaagagcgagagaggtcgcgaaggggaggaggcgcgggggcgggaggcggcggaggacgggggagaggagggacggggagaggagctgggcgggagtgaggcgaggagggaaggggatggtgcggcgaaggtgcgggagaaaggacttggcgaggagtgcgagggaggaagggagcggctctggcggcggcagcgacagggagcactagtggaagaagtggagtgcgagcgcggaggcggcgccgcagcggcggaggacggcgtcgaggaggcgcggtgaggtcggttcgaggcccgagccggagagcgaggcgatgagcctcttggggtcagagtggtggcggcggaggaggcgagggccggatcggccaccgtgcataggcggcggcgtagaagaaaagaggatagagagagagagagtgatgaggacatcaacaccatcgatacatccccgcctccacaagctcaactcatcctcttctttataccacggagacgtgtgcactcttgttttactcaggaatgatggagaggatccaacggggagaggatttgcgtggggtggactcggactgcagcacagtgccaacttctgatggccgccacgacttcgtgcgaactctaatttgggcgtgcaattgcttcatggaaagcttatcaagtctagtttcaaatggaacaacccatgtccatatctgatttggagcggccataatcatcgttttactactgagtccttttctgtccacggtgctgcgtcacctcattgggcccaatgggctgtgtatcaagttgggcccattaggggcgcgttctagggttagagcacgaccccagcacccctgtggttgttctccccctcttcttatacctttagccgccgccaagaacaattgggttttgtttagatcaaagtacagcgtcgccagattagatcgctactttgccgagttaatcctgtgatcggttagatcgccagattgcttgttactgaaccccacttgtgctaagcctctacttccccggtttcgagcacttgtgcgcactagtgcttgggacgagcaatcctccgggactccgctcgcctgagtagggcgatcaaggttttcgggagcgcgtctacgcgcgactgctcttggcactgcattctcttcgtcaaggtcttcttcctctacatcacaatgtctagcaccggcaccgatgctactaaatgagaaggaaacaacgctactggacgaggctaaattgagaaggtcaaaatcaacggtggcaataccaataactcatcatcctctagaacattctctgggtatatcattattttcttcttagtgttaaacatgttcttagatgatactattactgtttttagcatgttcatgattagcactatcactagaccatttcgttattcacatgtcatatttattatcttgtttttatggattaaaatatgtcgaattataaccaatatttccaactgttcatagttggcttatagtgtactactatccttgctcttactcaaataaatagatgtcatctctcacagttaaataattttatctttcccaatcactacaaggaaaaaacctagaggtgtttaactaatactgtagaggcattttttttctaatgcctctttaacattgtaggggtattataaaatcacatgtggcttatataaatcgcctttacaaacagataggtattttataaaatgcctttattctctgtggcacttgtggttttgctatgactagttgagatgtatgttgaattagtctcttttccagtgtatcaaattctagaaattttcacttcttacattatcggaagagatcgaaagttaatttataaatggaagtcataacatatcaattatgctactaatatacatatagtattttagtttgatgcgtacatccaaagcttagatgggtttcaatttattgtataatttggttaattcatttctcatagttatgcaatggcttagtttttgttatacaaggattccatatattagagacatacggtgtgactcggcaaatttagcgattaatcaaattaacatgtttgtatgatactgcataaaagattatgcaatctaattattttttctacgacttggtcatgtctatattcaaattcgtagaaaaaaattactatattttgatgacacattagtagatattcatagatgacagcagacaagatatttatgcagtgatgcgcgcccataaggcatggaagtttctagacagttggtgtatgagccgtgctatagctaggatggtgcaaaccaagatgtgcatggtcataatacgttggagtcttgttgcgacgtgctagatgggctacggttatcataacgaggtcagatagtagcaatgatatgtctgtgtcctgttgtattttctgtttcatttgttatttaccacggtgaagaaaccatttctcaaaacctcctcgaccaagctagcactacccaaaaaagaggtaagcaatgccggttggaaaactctctaccagtcttcccaaccggtactcaataagcggcacaacagtattaactcactactactacgtcaacgatttattcgtatagtcaaaatcaattttgcagcgggtgggtggttcacctacacccaggtgtctgtgaaagtatcagaattttgtatacgggtagggcattcacatatgggcacttaagccatccaactgcaaaaaaaaaaaaaaaaaaaaaaaaaaaaaaatcaaaaccctagaatgtatcaccgatgcgacgcctggatcgactatcgtcgtcatcgtgcctggatccactatcgtcgctgctgctgccaccgtcatcgtcattggagaggcggcgaggtcagcacgggagggggaggaggtgctggatccggcactactgttgccgccgtcgacgggattcgcatggttgcaagccaccgccaccacccgagctctcgcttgagactgccgcccttgcccgctggacccaccatcgccgctctcatccgagaccgccgttgccgggggtggcactactacaaaatcgattttacctaacgagaacccctctaagttgtaggcagaccataattgccctcacatgcaaagatcgctcccctgaggacgcttcaaggaccgcatgcagaaatcaattttcgcgggcgggcatcttaacatgcctaactgcgaaatagacatatttttgcgggcaggcctgttaagaggcccacctaccactagccctccaggtcgagctcctccttaaaatgcataagtcctttcctcatcctcgtcctctactatcctctcctccacttcctttcttcttcaccttatctccctcacctcagcctcctctatctctctctcggcagaagctcggcgtcgacgacagtgcgatgtagaggtgagttcagcagtgaggcacatgttaatgttggtgacaggggtgaccatcggcctcgatggatctaccgttactggtgataggagggtcagatatgcctccactagcctcagatgagcagcaggcctccctagcttctccatttccatcatcgatctagcggatgcggcctcaagaggtgcggatccactgccgttgaactcgggaggggctggcctccctcgcctctccttctccatcgtccatccggcggcggcggcctcaagagggccagatccaccaccggcgcccttgggagcttcatatgcatccagtcaagctggggacggtgggagcagaggcaacgagttcggttgcgatggcgacaatgacgatggcaagtaggacgtcgctgagcagcaaagaccagtccatccactccagcgagggaagcagagaagcgtgctttagtctgtggtgacgttgatagtgacaccgacgacagcagtatggttgggttggctagggtttctagattttgatattttcggaatttttttgccaaattttgttttttgcaaaattcattttcgcatgcggttcagctaggcgcctcgaaaattactaatcttcatagacatctacgagtgggtgagcgctttgcttgcctgcaaaaatgtgttttgactatttggaaaaagggtatatgtagtagtgtggggagaggagagggagagatgccggacttgagtggaggggagacttgaagtgggggagagagagagagaggggaggggagaaaaaagagtgccaagagagaggggtatttttttgatgagggtggacctgttaagacacccggatgcgaaaattgattttcgtaagctgtccttgaacgatccgagggggagcgatttttgcatacggtgataattatagtctgcctacaacctaaaagcggtctcatctgaaaaattgattcggtagtagtgagtaaatcggcacatatgtgatttctgtgagaaaaggtaaattttatagaattatatctaagttactgttggtatttcttaacgacattactagaaatattcattctcagcaatggcgccagaaattgtcctggtatatttatggttacagaagtaatccgcaagcgcacggatataccattgtagcattttacccggaagtattccacggtattgtatttttaatcccaagggaagataataagagtggactatgctaatacactttatacatatgttacttgtaattgtcaaagcctaagcaggggttaattttcatataggggtagaatgacacgaagcaaagctaatcaaatcctcataataaagtaattctaactaagtggaagaagaattagaaagcattcaattcctatacttctagtatacactcaaatcctagtttacatctgctagtatacaatcgtgtggccaataccccctaacagtgccctcctggtacttcgagagaccaccccgggttgctgagttccttacgacaacctatcatgaccgtccaaccggggctaaatacggaggagtaccctccccagaaatttgtcttaggaatatgtactaacgtggaggaatacctgtactgagcaaacacgatttgagtagattgaacctatcttgttcgcttcagcagggtcttgtttggcccaagccaatgacggttactaccgacctcccaatgacggttgtaccggttttggtgcccccaaccgtcattctcaagctataataggacctcccctccttcattttaacacacaccaagaaggattcaagaagaaaaagttctcttagtttactcactttgctctagtgctagtaggattagaattagaatagtcttccttagttcttcgagtctccggagaattcgggtatggcccttgtaagactttatccagtaataaaatattcttctttatatagttttggtccttgttggtatttcttaacgacattactagaaatatgaattcccagcaatgacgccagaaatggtcctagtatatatatggttatagaaggaatcggcaagcgcacggatataccattgtagcatttcacctgggagtattccaaggtatcgtatttatttaatgccaagggaacattgtaagagagaactatgctaataatgtatatatgctacttgtatgatcagagtctaagcaggggttgatatattcataacggtagagtgacacgaagcaaagaactcatatctctcattaaacaatcctacactatgtggaagaagaaatagaaaagcaatcaattcctatacttctatacactcaatcttagtttacatctgctagtatacaactatgtagccaataccccctaacagtgccctcctggtgtttcgagagaccaccccgggttgccgagttccttacgacaacctatcatgaccgtccaaccggggctaaatacggagtagtaccctccccaggaatttctcttaggaatatgtactaacgtggaggaatacctgcattgagctgtcaccatcagaggcccacctctactatcccgcagcatatatccctaattaatgatatttaataatctaagtaccgtgcttacattactaaatactactctacacccgtgcacatgacatagaaactgataaatcagacattaaacccgcaccattgcacctctctggatggctacccacaaaatcggtacaacacagatataaggtaagaacagtactcagactaaacaaagtaccgaagatatataaagaagaatatttcattaaaattgaaagtattacagaaaagaatacaagagctgctagagccataccgaaactctttcgaagactccgaggactccgaatactattctattctactccacttagcactaaaatactaatactaaagtatgaagaggaatttgagctaacttgagtgtgttgagagagtgaatgagctcctccttttatagggccggtatgacggttgtaccaatgcgaattgtgcattttaccctcacaaccgtcattaagagtgcatccggatcgtacacgtggagggccaggctgattgggcaccgccagttcggccgaaacctgggctagcccaacaggcctccagcttcggtacagtctttgacaggtgggtcctattgacggttttgtagttaaggcggtttccaggacggttacacctggcttctgagccctctcatccataagcttgcttaggagtgaggttttctccactttctctttattttatttgataaattcctgcaacatattgttctccaagtataagtggaactatattatttgaaaacaaatatgcattgtaagcatagctaattctccattattttagttatattgacggtcaaaatttgtctgtaacgactgtcaacagttacacaaaatcatagggattttggtgcacgacacaaatccacatcattaaccaattttcacgaaaccacatcattaaccaattttacatactcctcaaaattttaaaatgatttagttacatccatgtaaaatttctatgatggattaaaaaaactcataaatttatcaatttaagatgtaattgtagaactcaaaaggatagatcaaagtaaaatgatcaatagtttggttttgtgcaacttagatcacagtacctagggttaagtgagatttacttttaaaagaacacattaagccagtgttggtatttcttaatgtcacagataaaatctgcaagtgcacggaagataccgatgcagcacttcaactggcagtattccaaggtatctatttccatagggaacgtgtgtgttcagttcctcttcaggttcatccaaggacacaaagaaaatgtaggcaaagggtagagatgatttcctagtgagaaacggtgtctacagaaagctcagtttaatcctaatgcgatacttcaggcactggccagctcgctactcccaaatgtcactctactacatacccgtacatggaggactttagtgtacttgagggctatcaccacctctacaccgatctcaaacctactgtgggatacgaaggaatcaccggaaattaattacccagatactgcgtctattcaattaataactactttagtgctagctaaattctaaagcgatcacaataaattaatggactttagtgaacaatgatcccgcatgctaattagaaaataaccaagaattattcacatgaagtaaatcttaattactcaggaagataattctattaaaccagagtaattaacaatgtacaaaaagtaagaggagattaccgacaactccagaactcgtccgatttcttctaccatactctccctattctatgtgtaaaataaatcatacaaagagcctcttataattcagctcaagctacatcttggtgtgagttggaatgaaggatgaggagtggtatttattggtggaggtgccttcggagtgtggagaccctccatggaatcatatgagcatcttcactctcctcaagccaagcgtctatttggatgacagttggagagccgaaaacggtagaaacccacattggggagcggttgctaccgaactcaacttgggcctgggctagtggcctctgtcagggttgggctgaaccctggccggctccgttggccccgtttttcctcctgagcactaatattgggtacctcattctattggtacggtggttgggcccatttggaggtgtttaattgggtttttggtccgaaactccataagtttgaatatgagtttgattctcctccttcatgtatatttcttctcaacttaggtagtttgtcacctacatctaaatatacaccaacactcgtggaaattattagaaatatatcctaccactattttggatattttatactttcagatattttatactttcagttttatgtaggtattgacggcgagaatttggtatttaacagccgtcaacagccagttcactgcttcgtgccggaatttcaattgttcatccacaaattaacacatcacagattcaatttctatcaagcctaaaattttactaaaattagaagaattatcatctttgcatggctgatctaaacttaaaaatttatcagtcatgaagcgaggcttttggttgttcccctgacgcgccctgaactaagctccctttcttttgcgatccatctggttgcgctgatcctcctgacaaatcaacttgtcaaatagcttctcaaaatcagtataatctccatagatgacctggttggttagttcatcattaagaccaaacataaacttctcttgcctcacggcatcggtgcgcacatcaacaggagagtagcgtgtgaggcgatgtttgtagatccttaagtgtcaaatccgactgccaattcctgcaagaaagaaaattaaagaatataaaattgaatactaaacttagaggtagtggatattactaactagttccacaagtcttggtgaatatttgtatgcatgtgaattatggaggaaaaccgtctgacatgcgatgaaatatactaatcagacgtgaatacacagattggatggcccaaaaatcagagtaaaaccaacatatttaaggccatccaccgtacaccatcatgaagacccactaggcagtgacccaggtgcaaggtggcacgaggcggctcgactaggtttggccgaactagggatggctgttgatatttcttaacaacattactaggaacttagtcccaagcaatgttgtcagaaatattaaacggtaatcgtatgggttaaagaaataattccgcaagcacatggatataccgctatagcatttcacccggaagtacgtccaagatatcgtatttatttaatcccaagggaagatatggtaggatagtaatatgctataaattcttatcatacttatgtagatcaaagtcttatgcagggattaatcaattgaggataaggatagatttgacacataaaaggttcagtttagaatactctcactaaattataagtctaggctaaatagagaagaaattagaacaacatcatttatgcacttctagtatatagtcatttagtatacacttactattgtacaactctgtggctaataactccctaactatgccccccctggtatatcgagaaaccgccccatattgtcgggttccttacgacaatccgtcatggctatccaaccggttaaagatacggaggagtacccacagcaagaacctctcttagccctacctacgcacgtggaggaatacccatactgagctgtcaccatcagcggcctacctctacagatccgtggcatatagcaccacttaatgatatctaataatctaagcaccacgcttacaatactaaatattactctacatctctacagatgacatagagcaactatataaatagacacttagacaatactattgcatatctctggtaagctaactacatatttaatacgagacaagtatgagctaaagttcgtactcgaataattatgcaagtatagtaaaggaccaaaactagataaagaaaagtatttcattatcggataaagtcttacaagagagggaacagatactagatccatacccgaaatctccggaagacttgaagaactagagaagactattataattctaatttctactagcactggagcaaagtaagtaaactagagagcttcttcacctgaatcattcatggtgtgtgttgaaatggaggaggtgaggaccttttatagctgatcaatgacggttaggagcgacaataccggcacaaccactatagaaaagtcagtagtaccgtaatagccggttgtggctgggccgggacatgccggggtcagcagaacctagaggtccgccgacccctggccagcccccctggctgtggacttcctcttgggccctgacattttactccttggcccagtggcatggtggttgggcccatttgaagatgttctaatgagtttgtggatccatccatccatgtctgccacatgttgggctctgattggttgaacggtgaatttccatcatttctccatttatgaagtaatctactgtattcaaatactttgccaagtacaagtggacttggattatttctaagtaaatatgcatccaagcattgctagttctccattatttccggaagtattaacggtcgaaattggtctataatgactgtcaacaatggctgccctcgtgctcagcttccatgtggtgacagttatcactatcccgaagtcggtggcacaaggctcaacgcaagaaactgccatccaatgacggctggaggacatgtggaggtttgagaggagttggaggagaatatttccatagcatctccactctctcaagtcgtatccacattataagtagcccctctactcctcacttcaaatttgcaccaacaagcagactacaacttcacttatatacataggcattgctctttaagggtaggaatagaatggggaagctccgaaaggagtgcaccaaatttcagacatctctccggggttccggagaagtgccggatatgttggcattcttctaggggagttctggaggagtgccggagtcctgaagatgccggtactccctccgatcttgtacctcgatggatgcttcttttataagtaagtatttgtgatctcctttggtatttaattttatttagttttatcactctgcttaggtagactaccttaatcttctctgtgacgttgggattaggatagtaatcaatagcacagacacgatgtctaggctagagattacctttgtttgatgtgtgctccacgggttgtagaggtagttaacaggtggtgacagtattcgggtacatcatagagccatagccagagtctccttggcagaccaggggtaagccgatgcttgaagcaattgatagagttttatcttaacttgattaagataattaacccataggaatcctctctattcttggcctaccatatagttatttcccttggaagaatctcgttcttagattatacacatacgttgcctgtggatactatatcctggaatactcttggggtgaaggctacgactgtatttgtgcgcttgcggattattctgtcgtcgtaataaataataataggcggttgaactcgtgtaggtactctatagctatcttgtttccctaatgaagcgcatggaactccctcttattttgtgctacagtcccatcgggaacctatgccttcctgaagctacggcaaaattccgcccaagtgacatatgtcacagctgagcgggtgaccatgtagttgtcccaccaagcagaagcgggaccttgaagtttgtacgtggcaaagacaaccttctcctagtcgttccaccggaggaggttcatcttcttctcaatggcatgaagccagtcattggcttccattgggttgatggtgctggagaaagtgggtggcctgacatggagaaactaaagtagtttggactaatgtggtggtggtggaccaaactgctgattcagctgctgcagtgcctgatggtgcatcatctgctattgcatatattggtgttgtttttgcatctgctgcatatcattgtatgatatgcgtctaattggccaacacctgagcgattgttgaattctctagcggtggaggtggaccattgctagttgcaccactggtattggctcctccagtctattcctcactgctgctaccatcacctgttgcatggtcgccattccttgtgttcaccatctgaatggggatggacagaaaaagggggaaaggaaagaatatagactgctaaaaaacctaagctttattacattataatttaagtgcaattgtctaatctgaattaaaacaactacaaagaaaacaattcaactcctaattaaggtagtcataccgcaaccactgttgacggtcgttgtcgatcagtttcgaccatcaatattaccaaattaagagagaactagtgatgcttgcaatgcatatgtttgttagaataataatattccactagtattaggtatattaatcctttgtagagaatgacactaaagtggaggagaatcggcatcaacatagacgataaatcaatcggacaatgtcgagaaccagacttatgtatgaatgggaaaagaactcagaattgacacgatgaattaggccaaaattcacaagtctacgaagtgaagcaatagaggaattcgccaggcgaagatgggctggtttgggccagcccatggttcggccgaaccagggagttcgggcgaacccccatctccactgttgaggccagggtttggcatggacgtccaagattgcaccccaatgacggttggagggtacttcggacaattcctcttccacaaccgtcataaccacctctagataaaggcttcactctcttaacttcaacacacacctcaagcaatagctctctcatttctcttaagtttagtttagtagtacctagctggtggaatagaaatagaataggagtcaggattccgtaagccttcggaagagttcgggtatggctctagtagcttttctcttctcttttgtatgctttgtacttttattagaatactcttctatatatatttatggtattgaaatattctccgagtatatgagtacctactttatattatgttcttattatactaaatatacggctagcttatctaggagatgctttggtgcggatatagtgtttgcttatgcaattactctaggtcatgacgatgatattagagtggtcatgacgatgatattagagtagtatcgggtagtttagacgtggtgtctagattacgggatatcattatttggggttatatattgcggatgagaggtgggccgctgatggcgacagctcaatacgggtattcctccgcgcctatatataatcctaagttaatttcctggggagggtattcctccgtatttagccccggttgtatggtcatgacgggctgtcgtaaggaactcggcagtcaggggtgccttcttgaagtaccaggagggcatcggataaagggtattagctagtatatcagttaactagaatgtatgtatactatatatattagacgtataggaatagatttcctttctcttttctttccacttagcttagatgatatattatgaggatgagtagttaatgcttgtgtgtcactctaccctttgattatcttaacccctgcttaaaatatgattatcacaagtaatatataaattattagttgagttctctctacatgatcttcccacgggataaaataaatacgataccattggaatactctaaggtgaaatgctacaatggtatatccatgcgcttgcggatgaactctgtaaccataatataccagaaatatttctgcgccattgttgggaattatatttcttgtaatgccgttaagaaataccaacaagcaattctggcgccgttggcggggaagattcataatagagattacttgaactaatactttatatttacctctgtataatcatttcctttgcaggctaaccttggttgttttcactttttgttgtgaaaacagagtagtgcatgactggtttcaacttgccggaaaactttaaagaaaatccaaaagctttcttccggagcgttaagccgcgagtcgttgctccgcagaaaactctactg

SEQ ID NO: 39861 - DNA, 3866 bp, Oryza sativa
tgtggatttcgatttgaagtccagcctcatcacgatggcgtaggctagcccgttctgtgccaagcctaatgaggatgccaatgctcatatgcaacagttcctagagatttgtagcacgtacattatcaagggcgtcagtcccgatgccgtcaggctgcggctgtttccgttctcccttctcgagagagcgaagcagtggttctatgccaaccgtgctgctgtcaacacctgggacaaatgctttacggcattcctctcgaaattcttcccgatgggcaaaaccaatgctcttgtggaaggatttccagtttccagcatacaagggacgagtctattccggaagcatgggaacgactgcaggagtatgtggccgcctgtcttcatcatgggatggacgactggctgatcctgcagaatttttacaatggactcaccccaaagtcccgcgatcacctggacgcggcagctagaggagccttcttctctaaaacagttcaaggagccgttgaattaatagagaagatggtctccaatatgggttggagcgaggaacgactccagacccgtcagcgaggcatgtaaaccttcaaggagacggaattacttgctgccaagctgtacctcctcatgaaacgcttggacgaccacgagaaaaggccacaaggcaccgtcaaggccttggactctcacatcacgtgtgaggtctgtggcggcacggatcattctgggaacgactgtccggaaacctgtgaggaggcgatgtacatgggcaacaacaccgggtaccgtccacaaggaggtcaggggtggaaccaaccacgcccatattatcaatgaggtaaaaacaacggtaacttctctaaccagccctccttgaaggatcttgtttttgcgcaagatgaaaccaccgatgcactaagcaaaaagcttgctgctaccgataagatcctagagaacataaaattcaaattagatggctttgcctacgcatttcaaaactagatgagctttaataagatgaaagaaacccagttagctcagttagcatccttagtccctgcaactgaaactgggaggattcttgggcaacccgactcctccattgaaaatgttaaggcaatcacgacgaggggaggtaagtccactcgtgatccgccgtatcctaaccttgcaggaactaatgggatatcaaaagaagcgtcatctaatgactcggctgacaaggagattcagccagaaaagaccgtgccgcaggagtactgcgacacgcggttgctgctgtttccccaacggattaggaaaccgtcagtagacgagcagtttgctcgttttgttgaagtaatccaaaagattcacatcaacatgccattgttggacgctatgcaaatgccgacatacacccgttatctcaaggacatactcaacaacaagagaccgctcccaacaacggaggtggtgaagctgacagaacaatgcagcaacgtcgtactcaacaagctcccggagaagaagaaagatccgaggtgtcccatgatcacctgctcgattagggcacaacaattcgaccaggccttgtgcgatcttggagctagcgtcagcgtcatgcccaaaaggcgtcttcgacaagcttaacttcatggtgttgtcaccgacaccgatgcgcctccaactggctgactcgttagtccgttacccggcaaaatattcatgtggtcgaagtggagccacccaagacggacagcctggtgaaattcatgcaaaacttcctggagaaggaaacaacaatgcctaggaaccgctattggaggacgtcggtaaaatcacctgtaccggccaagaagttagagcagccggctcagaagaagccatcttccgcaccaaaatcaaagaaggtgtggaaggaaaagccgaaaacgcccgctccatcacctccagagacgggtagaaaatccgtgaactaaaccgaaaggaggtacggtcttgcacgtcggactttaaatgacgcgaccttcgccaacaggtaaattggtatgtatccgcatatttgctttcaacaatttgaatttttgcatcatcacatatttgaatttcatatttgcatttaggatttttgaattttgaggaaattcttcaaatgaatttttcaaagcaaacaaaaaataaaattttcaacaaaaattgactgtgccacgacaacactgaccgttggaatccaacggccgaaagtggggccggttgggcccaccaggggttcggccgaaccggccaggcaacggtcggctgcctcactttttgaggcaacagctagtgggccccacaggtcagttttgaccgttgtgggtgcactacttaagccaaccgaccgggagaagggacttcaccccatttcaacacattttcatcccctctccaaagtttgctatcaagttcattcaagctttgatagtttccctcaaattcaaaatagtttagttgcatatataaaagttgctttggtgaaactaaccggcgggtgaaactcttatcattcctaacccccgccgagtttgcatatgcaattactctatgttatgacgatgatattatagtagtatctggtagtttaggcgtggtgtctagattacgggatatcattatttggggttatatattgcggatgagaggtgggccgctgatggtgacagctcattacgggtattcctccacaccggtatataatcctaagttaattccctggggagggtatttctccgtatttagccctggttgtatggtcatgacgggctgtcgtaaggaactcgacagtctggggtggcttctcgaagtaccaggagggcatcggatagagggtattagctagtatatcggttaaccagaatgtatgtataccatgtatattagaagtatagaaatagattatatttctcttttctgtccacttagcttagataatatattatgagaatgagtagctaaaacttgtgtgtcactctacccttgtattatcttaaccactgcttagaatatgattatcacaagtaatatataaattatttgtcaagttctctacatgatcttcccatgggataaaataaatacgatacccttggaatactctcggttgaaatgctacaatggtatatccgtgcgcttgcgaatgaactctgtaaccataatatactagaagtattactgcgcaattgctgggaattatatttatagtaatgttaagaaataccaacaacgggcagcgacatgcaccaccggcgatgggtgctggcgatgcacgagcaatggcgggaggtgcggggcatggtggcgcacgcgggatgctgcggctcatgtagaaacaaaaggggagaggggaaagaggaagtcctgtccagggaaacagcggtgaccagcgcagagcgcgggacgatggcaacgttatgccaaggagcagacgggctacggcgagccgtagaggaggagatgagaagggtcaagaagaagatcacttgcaattgaagaagagtgggttccggcgacggggagcgatgaccgaacggtggccgaggggcagacaggctcgacggtggtggcgacgcagctaggtggtgaccctagcgctgtctagtggacaactggaggagagcgatgagtagtggagctctctcgatccggagtttgaatctcttcattctcgacggacggctgctcaggaaccttttcatcaatcgagctagcagaagtggatggttgagcgagtggcttcatcgttaaaggttcctctatcttggacactgatgccttcgactggttttcattggtttgcgtcatgaagatagtattttctagaatgcgatcctacattattcttcctt

SEQ ID NO: 39862 - DNA, 1501 bp, Oryza sativa
agtttcttgtttcatgccacgaatcttaaggcatgagcagacttgtccaaagtctcgcagatgattgtaggatttttctagatcaaagccagaaaaaggattttccctaaccatactgattagttgtgtaaatgggctccaataaaggaggtggctcatagaattcgccccgaggagcagacagctcaaaaagaggttgctccatggtcgagaagagtgacaggaatacttctctagtatagcagagcgaaggtagaaataaaaaaaataaaaaggatatgaggatgaactaggttcagaaatgatcagcaaccgttccccggcaacggcgtcagaaatgcttgttggtatttaatacggtcacagataaaatccgcaagcgcacggatataccgatgtagcactttccctacggagtattccaagggtatcgaatccaagggaacgtgtgtggtcaaatctttcttcggttcatccaaggacaccaagcaaatgataggctaggatagagaggatttactagtgagaaacagtgtctagggaaagcttaactttaatcctaatgcaatacttcaggcactggcaacccgctgtttccagatgtcgctctactacgtacccggacagggaggacttaagtgatctcgagggctgtcatcacctctacacccacctcaaacgttctgtgggacatgcagcaattactggataacaattacctaaacaccacatctaagcaattactatctactttagtgtttataactcaccaaagcaatcactatattttagttgattacagtgaacaataatcttgtatgctatttaggaactaaccaagagataattctcacaagataaatctaaatttctcaggaagaatattatattgaattcagagtaataaacagaataaaagaaataggagaagattaccgacaactctggaattcttccgacttcttctactctactttcttcctattctagtatacaatatagtacaatagagcctcttataattcagctcaagcttggagtgtgtgagtgaagtgaagaggtgatgtccttttatagggcagtaatgacggttgtgagaaggggaaatgtccgaactgccccgcaaccgtcattggagagcatttggagcgtccacgccaaaccccagcctggatggctgagattgtggctcggccgaaccccctggttcggccgaacctgggctgggcccaactggcctagctcttggcccatcttctcccctggacctcctctatccatttctcggagttttgggttgatttactggtatttggatcaagttcacaacccctccttgtatagatacatgattctcctcactgtagtctgattttcctcccaacatcggcgtttatcgtctgcatacaaatatataccaacacttgtggaatatatgagagtaagcacctatcactctgttggatgttttattatctgaactttatgcagatgttggcgg

SEQ ID NO: 39863 - DNA, 2056 bp, Oryza sativa
ctatttgtatctaacaatctattatgtgttttgatttcaggaaagtcagactttaagactttgtcgcagactctacaactactcgattactcgagaacggttgctggagtttgacaaggattacggaataaagcgatggtgtacctgccgagacgaaatttcttgacttcaatccaaattcttgattacggcaagataaagaattaagtcgtatactccgcaccttctcggtcatccgagaatgtcaagcgagcacggcaattgttattccaaggtcttcggtcgagaacatcaactcattcatttgcattgaagtcaggagctactgttagggttatggataccacatatccaatagtaatcgactaagctcggaagggcccaccatatatcaaatcatatatggaatcatacctcgtatataaaagaagttctagataaggaaggacgagtagagttctatatggaaacaataaggactactcgaatcgtatccatacttgtctccctagttctacttggacaaggggacatctatgggtataaatacacaaccccctaggaggagggaagacaaaaaacagagacaccagtcagaataaacaccaacacacggcgccaaacattgatattggagatagcctagatggactcaatatggtgcctgcggaggccgacaagaggaatctagtgctatataggatctcgacgagttcgtactcgaggaggaagactaccctatcgtcgactacgtgttggtgatccatgccgccaagttgacgacagctagataggttatcccaattattgtacttgtgtgattcaaatgaataaagagcaacatcggcttcgaccaactggagtagggtcgttaccttcgtgtgaaagggcccgaacctacataaaaatccttatctctatttcttttacctcgacctcgcatataccctggtaccaacgatccccataccatgcaaataccttagttgtgacccaaaacgtcgacagctactttatataaatctgtgatccgttagatcattggtttctcttctttggaacccacctaatgataactatcatgtgttccctttctatgggcaattaggattgctttatatatatatccgggtgaatcatagacccaaaagtgcacacgggtgaatttattcggcctcagtgcatcggcaaaactagccatattaaaatcacattgcctataataaggtttttggattcatatattgatttaatttatttcataaataaatcatgacattacatatgtaaactagcataatcatatcatacaatctttggaagatcggttgcacaacaggaatgactcgcggtatcgggcattgacgacaacaagcaacacccgagagaagaggaagaagagccattgtggaggaacagcaaccagtcacgcaaagcgcttgcaaaaacattattgtcatcttctcctggtgcaggacgtcgaaggcgaaggttctggagagttgctctctcgattgccggtgcacgccagcgagcgggatggagtagactacaagtgacggtgcaatactgaggaggaggcaaaccctatattgattttgtgtgtgttacgtggaggtggcggcgcctgcataatcttcactccgctcctcgcaccagattattcactgtgtttctaaaaacaaaaccgaattttgtgcagcaaaacaaaattacaaaagaatactgtatctgtgcaaaagtgagggaccaattttgacgaaccattcgacacgcatgtcaccacgtatgcgccgcgcttgtgtattcccgttgttctctccacctcacacggtggcggccccagggttttaaacttgtgtattagaaatggggagaggaaaattttttgttcatacacctaaaaacctaataactagcttgtatagtatcacacactaataattatataatatatagcgtatataacataaaattgagtattagttcacacaatgatagaattgatcatcatgtgaaattgtttaacatatagaaatactaataataaacatat

SEQ ID NO: 39864 - DNA, 1514 bp, Oryza sativa
gagtgccgctgcaacgcacgccgccgcctggctccttgcaaatttagggtttgggattggggattttgggagctgcctgggaggggatttttgtttcgaaatgggctcagttgcggcccaagtagaatgcgggccaagtgaaaagggggaaggagtagaaaatttagacccaacacagcagaaatggtaaaacaaggtccaaatgagtagtttaactctttttctttaactttttgcatacatataagaactatatagtatatattctttttgcatacatataaactttttgcatacatataagaactatatagtatatataccaattttttttccaaaaatcttgagtatacatatgaagcccgctgaatcatagctagacccgcctctgacctcacatgcctcaagtggctaggagagtatcatcccttatagggagatcttccactcctagaataggtaaggtggcataaaatccccatgctcactatcccatgagacgaacgttagtgattttttaaagaattaatatttgaataggctaagtcccacctatcaacaagctagggtcacataacaggtttattagattgggttcgaatatatgctagaaagtgcgcaacatatttttttcgataaccagttattaataatttattttttctcttttttttcaggacagaaactgaaggctagcttaggagcctagaggagtggtacccatacgagcgtggtacccccaataaatctgtggtcagatatataatattagccaaaatctaatccgcgtgcgctctccgttttaccttatcgcgcaacacgttcatcggcggtcggattccacaagtgctggtgcgtccgaacatagcctggtgattcacggacgtggcatcatctaaagggatccaaattggaagccatgtgatgttatacactacgccggcttcaaaaataattttctcttaaactaatcatccgatctacgatccgattaccgttgtgttggtaagaattgaatctttataacaagatctcacatgattatattttgatgaaaaaatagaaattatttttataatatatctaaattacttttagatttcactaaattacttctcagacacataaaagtatattcaataaagcctaaaagtaatttacatatattatagaagtaacttagaaaaaaagaaagtaactttatcatgacattaaaagtaaatcagttacggaggtaaaaacatgagtctatgtagaaactaaatttaatcagcataaattacatcattgactaaaaatgattatataataaacaactcataacacgaatgtatagatttctttcgatgtcttgacaagttacttcacttttgttacttctataatataggtaaattactttcaggttttattaaattacttttatgactaagaagtgatttaatgaaatctaaaactaatttagatatattataaaagtaatttctatttttttcatataaatatagtgatgt

SEQ ID NO: 39865 - DNA, 15321 bp, Oryza sativa
agaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaagggggaaaacttcagggcgtgacaaacctaccccccttaaacggaatctcgaccccgagattcggaagagctggtgaagaggtgcgggtgggtggccttcaactcatcttctctttcccaagtggcctcttcctctgagtggtggctccactgaaccttgcagaatcttattactttgtttctggtccttctctcgctggtttcgaggatacgagtcggcttctccacatacgtcagatcttcctgaatttcgatttgatccggacttgcctgttcctcaggaactctcaaacatttcttcaactgggagacgtggaacacattatggatgccaagcatgttggagggaagctcaagctggtaagcaacttcacccctgcgttccaaaatccgatatggtcccacaaagcgtggtgccaactttcctttggtttggaagcggtgtactcccctgagcggagtgacacggagatacacataatcccctacttggaaaacgagctcccttcggcggttgtctgcatagcttttctgccgagattgcgcgattctcaatctttccctaacagctctgactttctcttctgcctcatttaaaacttctgtaccaaacaactggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcagacctgctggcctttggtgttctgcctttactcgttgacagacgtcacagagtgctacgaactcagctatttcccttctcatgctgacccaccagaatttttctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccgaccctcatgttctttttgagctcggctatttcaggatcacttgcctgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtaactcttcctgctcaaggcatctgctaccacattagccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctgaaaatctttcgtctgatcaggcaggattaggactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccacttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgaccgaaggtctatcttagagaacacagtagctcctttcagctgatcgaacagatcatcaatccttggcaaagggtacttgttcttaatagtgacctcattgagtgcgcggtagtccacgcacatcctcttggttttgtctttcttttccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactgatccctggcttccgcggcactagagactggaaggttaccacctctccttttgcattggttaacttgatggtgcggctggcgcaatcaatcactcctctgtgccttgttaaccaatccattccaagtatgacatctaggtccttggattcgagaagaatgaggttggctggaaaaatcaacccttgaatttcaactgtcacagatgggcagtagtgagttgtggtcatgccacctccaggagtatgcactcgcattggtatcttaagcttcactaaggataacccatgtgcaccagcaaaacgcttggaaattaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcatgtcttggcttcgggcactttccaaccgtgtgtccgggtttgttacaattgaagcagagttcgggtttttctcccaacctcttgggctgttctggcagagctggctgagctagctgatctgactgatctgactgagctggaatcattaatggacttggagtcgggttgaggctgctgtgactgccactgttgttgttcttgttgaaattacccgggtggtagggacggtgctgccggataatcatggtggaaggtccaccctgatgtcccatcgtgaaacgaggcttctgacacttcccctggggagtcctgaactgggctgccttcctcttacggttcattttgttacactgctcctcttgacggatagccttgtccacaagcttctcaaagtcctcataatctctagagatcaactggttggtcaattcatcatcaagacccgacagaaacttctcctgcctctcagcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggtggtggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaaggggcacgcaactcctaattgaggcagtcataccactgacacatgatatcgaccgccgactaacccacaagcaacaaacctaaacacgaaaactagcaagcaaatagactaagaaggcgataaagctaagggcggcgactctgaagctcggggcggcgcttgcaaacgagggataggactgacatctaaagtagacaagggataggaaccaattcatgctcaaatccaaattaaacgaagcaacaaatgactcaaacgaataactgaacatgatgatttttatgcatagaacatttttcatgaacccaaataaagacactaatgcaactaaacaataaattaatgcatagactagttgcatggaaaatgatgcgcaacattgcccccatcgaatatagacacgacctaatgcataacccccaataaattcccgactgactgtcgaataaactccaactaaaatttttctaaagccctagactgagctaattttttttttaaaaaaaaatccgatccgaaagaacgaccaagatttttcccgcaaaccaaagaggcaaaactccaaatttttccaaaacaaaatccaagtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacctacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggggtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaccgtaacacccgttgcaaaaggcccaaccaaccacttgaactacaccagttcattaagctaaactaggggtgagactaatcacggtgaatctggttgatcgcccataaccgtgggcacggctattcgaatagttttactctggccagaggtgtacaactgtacccacaagacacgattccacacatgtcgccatgccccgaagtatcaccatgatactgcaaagggggaaatcgtgacaagaccctccatataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagctaaaccatgcacccacagcccaccactcagaatattttaattaactgacacccttgcggtggcaccagtccaaagctatgctaatagtcagagtctatttaataatgtgatccctttttgtgtgctagttgaactaagcatggctaagcatttcctaaaccaacatctaatcattttgatacccaagttgtcaatggcataaggtaaacaatatatggctgagtaataggacccattccacatgatattgtaaaagaatgcaacatttaatagaaatgcgggatatttgtaaattgggtacaatatgatcaaacgtattgcatgacttgccttgctctcgaactgatgggacctcagcaacgtcttcgagaaacttcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaatatggcccagggctgacgtcagcgaggggagggggcggctgcgccgacaggtgggccccactggtcagcggttcaagagagaggaagggggcggctggcaagcgggccccactggcagcggcacaaggggaaaggagagggaggcgccggcatgtgggccccacgggcagtggctcaagggggagggagtgggtggcggcatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacgggggagaggaaaggaaggaggaaaggggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttggattgccggccggagatggaggggagggaaaaactcaccggctcgcgaggggagaggtgctccggtgggattccggcgacgcgaggcggcggccgggaaagctcttgcagcggcgaagctaacggcggcggcggtttggcgcggcggcgactctagcggcggcggctcgcggccgaaggcggcggcaagcggcggagctcgggtgcgacggcgcgtgggcggtagacggcacgggagagcgcggcgagtgcgaaaaacgagagaggaagacgcggggaacgatttataggcggagggggaggcggacgtggccgggaacccaccctattgcgccggcgacgtgggaaggtgggggagagagagaggggtgggattcaaattcgaatcccgcccatttgcgaggcgcgcgagggcgggagacgcgggggagaggcggcgacgtgggagggggacgcgggagcggcgcggcgtgggcgcgggaagagcggaggaggcggcgacgtggcggattcggcggcggacggccgtcggaggcgggtggctggaggaaggagacgacctgacaggtgggccccacctgtcagcgtcccggagagaggggaaggagaacgggccggcccacaagagaaaggccgagcgcggggagacggggtggactgggccgacggcccaagaagaggaaaaagaaggaaaaaggaaaaaagaaaaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaagggggaaaacttcagggcgtgacaatacccttggaatactttgagctaaagtgctacagtggtatccgtgtgcttgctgatttatctgtgacaatatcaaataccaacatgggtatacgggaatataaaaggttttggattacaaaatttggataaataaactttaattttgagaaaaggtaaactatgaaaatcggaattagtttcattcaatttggaggaccggatctgaaatttgttagtggagattatgatatggattcttggatttttttttttagcgaaagacagaactaatcgtttgcaatatatatcaagaatttgaatctagaactccaaaatgaagaaaagggttaaatattattaacagtaaattcgtttagtttgataggttacacttgaattagtaagaataaagcatgttatagacttttgaggacaaaatttgctctaggacactctagctttaatttgtgacattttctatagggcattctaggttgtggttttcccatacgacaccgtagttttatagttctttgctaaaagacactccatctattattttaatatatcacattcaaatagagagataaaactttgtaaaagatgattttacctttggttcgccaagcataattaaaatttaaacactttttttgtacaatttaaacatatttttgcaaaattcaaaacttgatccaaaattactgaaatcaaatacattattttttaaaaaaaatgaaaattgaaatattattttctgaatttatacttttttgtaaaacattttgatttccagaaattgggacagcttttaaatttttgcaaatgtttagaaccaactagaatttgtttgggtttgaatatgctaggtgaaccaagggtaaaatcattttttgaaaagttttatctctacaattgaataggatatattaaaataatatattgaatgtcttttggcaaagtaccataaaactaagcaaacgccacaaagctagagtctcctaagctaattttgtcaattttgaggtattttatagagattggtgaaaataagaaaagtttgaaatccaaagaatttaaatccaaggatgtcacacatagaaaagaaaatgttgtatgatcgagacaaaaatcaagcctacaagaggggagggatgactggtaggaccaccaaaaaccaaaacttttagcggggataaaagttaccctcatatttgatgaagttcaaccgatggcaccattagattgccacggtctaaccgcatgcatgccgcttgtctgaccgccaccttgccgccggttggaccacctctgactatcacttacaccgccatcacgccgccagttaggccgcccaataaactctggtcaccgttgggatccagaaaaacatgtaccgacaaaactcaagaaagtaaattaactttattgtatcaatatgtgtttaaaagtgcatctaaagcaatcatctctcaactcttgacctagtgctaaaacctcgaaagaaaccctaatttttctctcccaaaaagtcgatatcttctagcctcaacccatcatctatttatacccacattgtggctgcccctagccacaaatccaactagaactaggactcctaatcacataggaaacctaccaaacgagggaaacaatatccccatacaactctacactccaatctttccaaacttggagtccaattgaaatttgactcctctttccacatgcacacaacaccacgtgtataccatatggaaaccttcacctcgacgtgcattattctgtaacctaagtatcccgcgtgatatccttgaccgtctgaacctcaacttctaccaagcctattcccgattcattaacatttatactcccatggtctcaagcaacacctacacatgtacaacaagaaacttcatatctgagtacaacttcacaccaacttgaccgtcgggctactaggtcagtccgcaccaacacctccggtctaactggtggcaacccccgatctgaccggcctcacaatgccgaccactacactattcactgtccaaaaacacatcaccatattttcaacaagcacttacatttaataattgttcatcacaaagattaatcatcacatgattctacaaaggtttaagattcaaatattcaaatcagagacattaaaaagaaggaagttctgaaattaactttttagagttcaaaaataatttatgtttcactaaattcaagaaatcataaaaaaaagttaaaaatagaaagtgaagaattgacatgatgcaatttaaaatctttggctcaaaatttaaaattttgaagaattcagacgtgggcatcaaggatttcatcttgtactgcttcccctcccaccatacattcgttcttaatatagcattggctttagtgattttggcaactcaatcatctgaggtggatactctccaagcagtgttgaggatgaggttaatttgttaacagcttgaatatctcttattattccaagtcctcctttaatgggacgacaaattaaatatacttccaagttctaagacaaacaggtttctttgattctcttcctgatgtcggctagggatgcaattagagcggataaacggttttttcccctcgcttcgaattcgccactctagttattttttttctctcaaattttatactagcaatttattttcttaatttttatactagtatatactaagcgggattgccactttaactcctgaaatcttgttgtctttggagtagtgcagtggcgagaatgccactccacgctgctagttcatttttgtggagcaatccggcaatctctcatgaaacatttggttgtgctctaacttgatcagaagtggatttgagagttgaaggtacaccaaacagaccatctaaaagctcaaatgatagaagttaattttgaagttaatacctcggtctcgaaatatagcaagtgcctagatttctatactaatttaaaggtagtagtagtgaatctgctaccactacctttagcactagcgtatggtctccttgtcggtgaaactcacatgctcaataaatttaaacgtttcataaaaaaataatgtctacacaaaataatgtccattttatttggtatggtcttacatgtagtgaaggaattcatatagttacaggggttggaaagagacagactagataatgtttaaatgatgagcatgtgcatagttaatgcataggtaattactagtatagctaaaactctatattttaagagatataatagttttcataataaaaaaaccatggacatataataaacaggatacatataaatagacaagggagagaaaactgatttaatgacaacaaaaagccttggacttggagcatgagaaagtttatcagccttatcatcagcccatgtgcacaacgttcttcatggcttcatgacatggacccaccagagactcggtcaaagtgtcatggaccgtacgtcaacaacgtctaacctttttggcgcgcccatgcatgcatgcaatccactcccatgcacgtacgtacacccccagtttagccctcacgttccttcccttcccaatttcactatctccacgtgcacgacggcctcctccgccgcggagagcacagcaaccatggccgccgtcgccgccgccgccggactcatcctagctctcgccttcgcgtcgtcgtcgccgcccgccgccgcggcggtcaagttcaacgtcaccgagatcctgcacgagttcccggagttctccgtgttcaacggcctcctctcgcagacgaggctcgccgaggacgtcaacctgcggccggccgtcaccgtcctcgtcgtcgacgacgccgccgccggcgccatcacgtcgctcccggaggccacgcagggggaggtggtggcgctgcaggtgctcctcgactactacgaccccgtcaagctgtacagcctcaaggcgaagacggcgctcctccccacgctgctccggccgaccgccgccggcggcggcggcggaggcgtggggctcgtgaagtacacccaggtcgccgacgaccagatggcgttcggctccggcgagcccggcgcgccgatcgggtcgcagctggtgaaggtcgtggcgtgccggccgtacaacctctccgtcatgcaggtcagcgcccccatcgtggcgccgagcttgggcggcccctcttccggcggcggcacgccgccgtcttctccggcgacggccaagagcgccgacgacgcgtcggcctcctcgatgacggactacgacgacgatcccatcgctccggcggcggttgatggtccgggaattgtggatacgccgccgacgaagacgacatcgccgtcgacaaacgggacaagtgcggcggcggacgggacaacaacgtcggcgggaagctgcgcggtggtggccggcgcaggcgttgggctgatggcggcggggctcgtgatgttcatttcagtttaatgttaattaattagaggcttagactccctttttcttttcttggttattaatgctgatttaattactgtagctgtgttaattagtgagaagagaaaaattaacttgagtcccgtgaaccgcaacagatgctgcgattccgcaactatcgaactgtgcaaccggccatacatgcgcgcggcgcggtgtcgtctttctccttttgatatcaccgccgtcggtgttgcaggagggcaggatcataaccctgttggagccgtcacgcacagccctagattcagttggagtttactatttgttttcgagatcgagcttcaatttttgaattttaacctgctccaaaattttcccgtgatgatcagttttttgaatggaggagactacaaattagttatccgattcttcaaaaaaaaataaatgatacctaccctcctaatgccttgtttagatcaaaataaaatttggccaaaaacatcacatcaaatgtttggacacatgtataggacattaaatgtaggaaaaaaaccaattgcacattttgcatgtaaattgcgacacgaatcttttaagcctaattactccatgatttgtcaatgtggtgctacagtaaacatttgctaatgacggattaattaggcttaataaatttatctcgcagtttacaggcggaatctataatttgttttgttattagtctacgtttaatacttcaaatgtgtgtccgtatacttcaaaaactttacacccaagaactaaacacaccctaatataggcctttcggatcccctccccacctctgttttctatctcccccttctctgatatatgtatatccacatttttactaaaattttaagcaagtttttctcctagaatactacttcatctgtttgatatcataagtacgtccacaatatgtgttacaagatgtttttactttggtcaaagtcaaactacttaaaatttgaccaagtttatagaaaaaaaaatagtaatattttcaatccaagaaaaatttattataaaaatatatttaattattaatttaataaaaactaatttggtaatgtaaatattactatatttgtctataaacttagtcaaatttgaagcagtttgattttgaccaaagtcaaaatatcttataacttgaaacggagaaagtacaaaaggaaagcaataagtaaatgaagccttactaggtttaatcaaactataagcattgtagaactaggaaatactagcaaataacaggttatagtgctattaccgagcaataaaggataaacaatatgatttatctctttccccctcgtattgctagtggattatggggggggggggggcaagtttgacacccacttctattgttttaccattgtagctttcgtaacaactagtaacaactaatctaaaccatactctttttcatttggttggtagtaaacattgttgatatcctaagatgttttgaccttttgctatcaaatttatttaattttgatcaagtttatggcaaaacatagcaacatttccaacaccaattaaacatataatcaaaatatattcaatgttagatttaataaaaccatatttaacttagagaaaagtcaaaaaaaatcttacaatatgaaatggagggagcatctgatttatgatccgcttaaaaccgttgtgtacgttgtaatttattctttataagaagatataacatgataatattttaataaaaacatatatgtcctaaaaaccattgttttatctcttatgaaacataatttcatcacttacaaatttttcaactaatgtttgagatagatgcaacaatgacaattaccttacgaaacattaagtctcaacgagtaaaacatgaaaaaaaatccatatatgaaacatataatgtatattcaaacacttttttattaaaatatttttatatcacgtatgaaacatcgagttgtaattattgaaacataaaaatacttcgtgaaacatctaaaagaaattttacatgcaacaactataaatgaccaggtgaaacatgagcaaatacttattgaaatattca

SEQ ID NO: 39866 - DNA, 7470 bp, Oryza sativa
ttaaattttcaggtttatacaggaattgacgatgttaatttggtatttaatagccgtcaaacagtgggcagcatgaataagcagccactcgtagcaagaagcaacacagtggcagcttgcatagccctatgggcgctagtgcgctgctaggcgtataggaggagcggccacagctgtccggcgcattgccttgcgctggcgctagcaaaggctagggagggtgagtatatgtggccaatggttgagccacccatgccagcccaggcacgtatcaactgttcatgatgcatgcacggcccggcccgtctggccgtgttgtgcttgtgctgccaccaaggctcgcatgctggcatgacatagcacggttgttctagcaggccgacatggtatggactgggcgtctgggccacatggatgatggtggtaggcaccaagaataaagaagagacggtgatgcttcttggtgtaggaatggagggcgagaagcttcttggcggcaaccggtgaacgtggaggttgtcatggtcatcaacgaggaataagaggatgcggaggcgtggagctggtaggaagcagcgaccaagcagtgcaaccgggatgcccattgttgagcatgcttcgagcaaccttgcaggcggcggcagtcgatgatacaggagtcgacagcagccgcagacgatgcgagagtcagcggcggggatgaacaatgcaggaggcggcagcaaacaaaaccctaatcatagccatctccatgatttcgtttaattgtttttcagcaatcgtccaagccttatacgagctaacatgcctttcttagcccacgtgcctaaaacaaggttgtgacggctccacactgcttggctccttactgtgcatagcctgggctccgactttggaacggctagcatgacactgccaatttgggcctcatcgtcatgggcccattccatgatgggccaggcctcgcctgttttggctagctataaggctgagtgatctggctaggctttgggtcaacttttttttttagaatttcacagtataaagcacactcacccctatgaacacacgcacgcaaaccctacccctatgagcatcttcgaagactgggccggcaaatcctagagattgacgaagtcaccataggcgcctcgctgttgacgggtacgtcgcctaccactgaaagcacaaatgccgttaaatcctggaaaatccgctcccatggagagtcgaacccaagacctaaggtgctacggaggctcttgtaaccactaggctacaggccctttcgcggctttgggtcaactttggataagagtggacatggatggagttgtactagggtttcatctagttcaggtgggctagaacctactactagaagattgatcgaaccattggcaggcatgaacagtgaagtttcacattatgtaaaacgtccaatgtaactccctcaacaataggtctataggtagaatttgtttcgcatccttcaagcacaagaacgggtttttcacacacctcaagtattaaaaccagtgcaaaattactccgtcaaatgtattactgacatggcatccacttgtctcttattattaaagaatacattaaaaagatgtgggacccacctgtaagtgattctctctatcttcttcgtccaccctccccctctcttctctttccccaccagaatgctagtgcctagcaccaccacaagaacaccgatctctaccattgccaatgactccatcctcctgtccaccaccacggctagcggaacagaagaagtggcccagatgcagtgtatatcaacatgggtgcggctaccggatgagttggcgacaaagcatgtggaggagggggaggcaggcaccgccacaaccgctgctgaatagagattagctcatctggcgaggcaacccaggatacactcattagaagagattattttgatttggttggatttgttctgattggtttgctttggtcattgttgcaccgtcgatgatgaagctgagcaaggtgaccctcgcagcaaggtggggccagccggatctggtgaccgaacatgcatctggtgatggtatgagagagggcagcagtggaggaagaagatgaggagagagaaagtcacatgtgggccctatatttatttctaaaatttcctttatgattgggctaccacgtggaagccacaacagcgatagcgattaccttcatttattgtgtacttcacaaaaagtgaggtaggcggcaggtggtgataaccctgtacccatcctttgtatccatccacattcaagtatatcatagagccgtaggccggactcagcttgacaaactaggggagagccggtgcccaaatcaatattaacccatagaaatcctctgtagcttaagcctaccatttgttgttgtccttggttgaatcttattcctagatatacacacacgttcccaatgatttgatacctgtcacgcccagaaattctcgaaccagaatttctaagctgaatgtgcattaaatccctgtccaggaccagccagggtacacaaacgacaattgttgacctacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggggtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgtgggcacggctattcgaatagttttactctggccagaggtgtacaactgtacccacaagacacgattccacacatgtcggcatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccgtcacgcccaccctcgccaccggtgcctaggaaagggtcgagctatacttcagatcaagcagttacccactcccgcttgtggtaagcacggtaagtctcccagggtttcccgtgaaccgatccttaattgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctaatcattttgatacccaagttatcaatggcatagggtaaccaatatgtggctgagaaataggacccatcccacgttacattgtaaaagaatgcaacatttaatagaaatgcgggatatttgtaaattgggtacaatatgatcaaacgtattgcatgacttgccttgctctcgaactgatgagacctcagcaacgtcttcgagaaactgcggatcgacgaaacggccgaaacctacgcgacaaacaaagcacacaagcaaaacatgctataagactacagaaacaggaacaaaaccatttttaatggattctttgcatttttcttgatttactgagacttgaatggacttaaacggagctcggatgaattacttatgaattttagaagataaactgtgtttttactaataaagaaaagtccttaatcactttattgcgcaataaagcccagggctgacgtcatccaagggggggggcggcgccgacaggcgggccccgcttgtcagcggctcaagagaggggagagagaggcgccggcaagcgggccccatgggtcagcggcacaaggtggccggtccaccgtggaccgggaccacgcgggtggtccaccgccggtccacgggaccgacggtccggatcggccgggaggccgatcggacggcacggcggcggctaggcacggctcggctcggcttcaaaaccggccggccggccatggcaaccggcggcgacgcgcacggtcgccggcgacggcaatcgacggcgtgggaagcgaccggaggacggggcgaaaagcggcggcagcggctgaaggcgacggcgcacgcgcgaaggacggcggcgcacacgggagagagggaaaaaaggggagcggaggggagcctctccggcgagcacggcgaccaaagcggaggatgaaaggcggcggtgacacggcgacgaggaggggcggacgggcggaggcgacacctataggaaaggaggagagggattaggggtggagaggacgaccgcaacgaccaaagtggccggccggagatggatgaaaaaggagagctcaccggcgagcgagggaaacggggtttcgggggtgattggcggcaaccaagcggcggccgaggagcggacggcacccgcgagcgcgacgacggcggcttcacggcgcggtagcggctttagcggcggtggcgcgcggccggagacggcggtaggcggcggcgtaaggggcgagcggcgcggcgacgataggaagcacgggagagcgcggcgaatgagggaaaacgaaagagggggctcgggagagtgcttttatgggcgagggaggggaggacgtggccgggaaccctcccgatttggccggcgacgtggggaggagagagagagaggggggtgggattcgaaatcgaatcccgccctctcgagcgcgcgcacgggccgggagatgtggggaaggtgggcggcgacgcgggcgcggagtggggcgtgaagagggacggagaaggcgagcggcgtggggaggtggggcgccggcggttggggctcggctccaaccggctagaggaggaagacgaccgacaggtgggccctacctgtcggcgcccgaaggagagagggagggagggaggacttcggggaggggagaaggaacgggccggcccaggaaaggggcgccgagcgcggggagagagatgggccgacggcccatctagagaaaaaggaaggaaaagaaaagaaaaagaggggaaggattttcctgggattaaaatattgcgcttgctcatttttaattggttaaaattatttccaaggctctgaaaattccactaaaaatcttgttaatgcattggagcatggggaactcaagaaaaattccaccacgccgaattcaattattaattgcatttattaattagggaattagctctaggttaattaagataatttcttcggacgatttatttagccaatttttaaagcaaggagagggggaaacttcagggcgtgacacacactcagctcatcatgccaaccccatattagatacttcggtggtgactcctcgaggttacggtatcaactatcggccgttgctattgccatgtgaactccactgtctttatcatagcccgccgccacatgcccagcttctctgaagtaagacgagcaacggaagagcacctgtagtgtcactgtggctatggtgacgattgagacaaatggtttgagtatttagatgaaggttttagattttctttttaattgattgaaagtttattatttatttagatgaaagttttatatattaattaaaagttctttgatttgattcttagagttttagatcttgaattgggatttcctccctctagcttgtctgtctctctcctttccttcttccccctctatctttccttttctttttattattatattggaataagttcatctaaggtcccttaacttgtcaacgaatctgattttcatccttcaatcacaaagccagatacaacgggtccctcaactatcaaaaccggtgtaaattaggtccctcggcggtttcgatagcagttttgactgacgtggcgcctacgtggctaatttgactcggtctcgatctgacgtggcactgacgtgacgcatacgtggcaattcaattcagaaaaataataaaccccgtgagacccacatgtcaatttcacacataaattaataaaaaatggcagggcccacgtgggccccacatgtcatttcacccctcttcttcctcctctctctccccatctcccatctcttcatctctctcccctttcctctctcgctttggcgctcgcgccgctctcctcgtccccaggcctctccgaccgcctcctcgccgcccgcgacgagctccacgagcggcaggagcacctcgccgctgcctcctcgtagcccgacctcgccgctcgacttcgtgctgcccgcgcctcacccgaccccctcgccgcctctgccgagctcaagcctctcttggtggatcccaagggatctgaatctagtccagacgaacccatcgccgtcatcggcgtctgggcacggttcatgagcaaaggcggctgcgccgtcgctggtccatcaccagcttctcgctgtccacgctgaccaactcgctcgtcgtcggcgtgcccatggcgcgcgccatgtacggcgagtgggcgcagcaacttgtcgttgtcagctctggccaaggattacagcaacacgcgcacttcaactagctggagcgaaaatctttgtggacaaacacagaagaatttctcgatgatgaacgccttatctagtttttctcattcacttggcacttaactcaggagattacatgacttctgtagcccagcagacacaccactaagaaaaaaacttcggccgcatcgtacgcgcacgcagcacgcgatccaattaattcggcagccactagctagccgcatgcacgaagctaactgccacacaaaaataatgctaacaattgtccagctctccgtcttccaggccatcgtctggttcacgctgctgctgttcgtgctcgagatcaggaaggccgccatcggaatgtacgtcgacggtgcgtcgtcctctgacgagtcgtcattgtcgtcgacgatgacgccggccagcaaaggacgtcgaggccagcgctggcgccgccgcatccacggtcatcgtcgtcaccgcggcgagcggcgccggcaagtcgtcgctgtggggcgctggtgaaagtagtggcgccgctccctcctctccggccgacgccgccgcgctccgctccctcctctcccgctggcggtcatcggg

SEQ ID NO: 39867 - DNA, 1280 bp, Oryza sativa
acactcttggggtgggcctacgctcccgaaccggccgatgaccattgcctgtgagatgtcgctttgagaagtctgaccgtcctcctcttcttctgcattcagatccttcccgccaatggcaccaccctcaacagttgacagtggagagtccctgacaagccccacccttgagaattggcttgcccccaagccaatgcagcaggaaatcgagcatgcaattcttcatagtcttcccaagtggcatcttctggaggggactcagaccactgcaccaaaacttgagagatagtagaattacccttcttagcaagccgcctgtccagaatgcgccaaggaacttgcaaggcagagatagacgatggcagatgagactgaacatgtcctgtaaagccagtagcagatttcaattgagacacatgaaaaactgggtgtatagaactggtgggaggtaactgcaatttataagcaacagttccaatctgtgctgtaatttgaaatggcccaaaatatttgaaagccaatttgtgattagctctgacagccacagaagtttgaacatagggctgtaatttgaggtacacccagtctccaatagcaaaagtacgaaaactccttttcttatcagcaaaatgcttcatctgctgctgtgctctgtgaagatgctgttgaacaagcttctgcatcaactgcctttcctttaaccaaacatgtaaatcaggaatggcacaatcttgtaaactgatgccaaaatgacaaggggaatgaccatagagcacttcaaagggagtagactggacagcagagtgatatgaggtattataccaatattctgcaagatgtaaccaagctgcccacttgctaggagctgaatgaacaaagcacctcagatagatctccagacattgattaaccctttctgtttggccgtctgattgaggatgataagcagagctaaaatgcaattttgtaccagatccttcaaacaaatgttgccataactgactggtaaatactctgtccctgtcagagattagtaccagtgggagcccatgcagcctgaagatatgcttcataaacaatttagcaactccaagagcagtgaaagggtgatttataaggaagaaaatgagcatatttggaaaacttgtccaccacaacttaaaatacaagaagcatgatctgaaacaggcagaccttcaataaaatccaaagagaccacctgccaagcaccctccggaacaggtaaaggctgaaggagacccggatatttagctctatca

SEQ ID NO: 39868 - DNA, 9622 bp, Oryza sativa
  unsure (1)..(9622): unsure at all n locations
gaaatgtggcataattcttcctcatcatgctgaaatttcctagataaagcatcagctgccccattatgagacccccttctgtaacaaatcttataagatagacccaggagtttggtaaaagctttatgctgccatggtgtatgcaaacgttgatccgagagatgcattaaactatgatgatcagtgagaataataaagtcaccaagttgcaaataagatctccattgatcaactgccagtaaaactgccatgcactctttttcataagtggaaagacctttagttctgggacctaaagccttactgatataagcaactgggtgtccatcttgagagagaacagctccaatgccggaatcagaagcatcagtctcaactgtaaacaccttttgaaagtcaggtaatgccagaacaggagcagaaaccaaagcctgtttaaggttatggaaagcagcatcagtttcaggagtccaaatgaaaggaactccttttcgcaagagattagtcagaggcttactgataactccaaatcccttaacaaatttgcggtagtaaccagcaagacccagaaaacccctaagttttttcacagtagtgggcaccttccagttcactacctcctgaatcttaccttggtcagtatgaactccagctgcacttatagtgtgacccaagtatgtcagttgtttctgtgcaaaagaacacttggataacttgacataccactgatgcttggagaggagtgagagaacttgagcaatatggtccaagtgagatgagaaatcagggctatagataagaatatcatcaaaaaacacaagtgcaaacttcctaagcacgggactcaatgtctcattcattgccccttgaaaagtggcaggtgccccagtaagcccaaaggacataacggtatactcataatggccagtatgagtctgaaaagctgttttatactcttcaccaggagccatgcgaatttggtggtatccagctctaaggtcaagcttagtaaaccatttagcatgagcaagttcatcaagcaactcatctataacaggcataggataagtacctttgacagtgatagcattcagctttctgtaatcaatcaccaatctccaagtaccatctttctttttgactagaagggctggggaagaaaaggcactatgacttggttggataaccccagacttaagcatatctgaaatctgttgttcaatttcatccttgagagctggattaaatctgtaaggtctcaagttaacaggggctgctccagggacaagaggaatggtatgatcacaatatcttttaggaggtagtccattgggttcagcaaaaactgcctgaaatgaatcaataagttgctgtacagcagcaggaatgggttccttagtcacagggtcagaagaagtgagttgaaccaaatacatgagagatccttgtctgaccatacccagacattgttctgtggaaataggagagcaatgagaaacctgggatacaataccttgcaacctgacaggctgtccagaaatagtgatatccatccatttgtccacccagttaacctgcattggactgaattgttccagccaatccatgcccagaatgatatcataaccaccaaggttcaggagcctgaaattgttaataaagttatgtccctgcatccaccacctacaattggtaacttcatatgagcaagaaagagtttcgccatcagccaacttaacagataacttgcttctcaagggtttaactccagccaatttgagaccaatactttcctccataaaggaatgggtactaccagagtccacaagcataagtaattcagtaccctggacccatcctcttaatctgaatgagttaggagattctgtaccccagatagcctgctgagagatagccattaaatcactggtgtcctcacagtgcagaaactgttccccatcagacacctcaacagttttaacatcttgcaaggcatctagcaattcttggaccacatgtaattgcacagcagtactacacttatggtctctactccacctttcaccacaagtaaaacagagtcccttggatcgtctgtaagcctttagagcagagagcttatcatctcttgctcttgctgattcagtgcccctcctatcttcagattgtggtgataacaattgtttaggtggcaaggtggatggaagaaccccagcacccttgtgactattgcgaataggtattgaggtgtcaggttttttatactgagtagactgaacaccctccaaggcctcttcctgaagtaaggccacagcacaagctgagtccatatcctggggtctctgaactaggactacaactctgatatcacttctaagcccttccacaaatttagtgacaaaatagactggcaatagagaattatcataagcaaggagctgatgcattagactatcgaatttctcaacgtattcagcaactgaaccatcttgtctgatatggaaccattgtctaataagagcttgttgtctatccttagagaatctggaacacactaaatcacagagacccacccaagtaataccaccaagctgatttcggacagattgcaaccaaaatgcggcattaccacaaaaattgagagtagcaattttaacccaatgaatttgctggataccaaacacatcaaaatattgttcgcaattaaccttccacatctgtgggttgtcaccacaaaactgggggcatgtcatgggaggaatagtgctactcaaattgtaactagcaattccactgtcaagagaaggtgttctaggttcaaatccaaaaggagcacgggatagagaaaaattttcattcataccgaaagaaggggaagtcagatctgtgttgggttggttctgctcttccttgataattccagatcccccagtcttggcagtactagcatctggctccaacttggtgtgacgcatcagactgccctcgaggtgctcgaccttggtactcagcgactgcagcgaggcgcccagatcttctaccctcttctccaccgccggaatacgagattccaccgacttcttcagatccaggtactccgccctggttcggacctccgcttcctctctcttcctttcattctctgcaatagttttgaacaagagatcgaacttggcgtctaaatccattggtgtgtgactctggatcctaacccgcgctagcgctccgaattcagccaaccagattgagggagccgaagcttttgtggatcacacgccaccaaggtagcaggatcccacctctctcccggaaattttacggctaaaccaagaggattttgcagcgcgaatggctctgataccagattgttagggactctcaagaacaactcagatatatgcgaaattgtggcaactatgtggtatttcctctcagatccgacaggatcgagccgccgccgcctacgcctccagttgccaattcatcgttcatacaagtgttcatcgtttgatttaatacatccctctccctcacgtgacagctcacaggcgagctggtgtcttacgccacccattcagggcctaacactcttgggttgggcctacgctcccgaaccggccgatgaccattgcctgtggagatgtcgctttgagaagtctggacgtcctcctcctcttctgcattcagatccttcccgccaatggcaccaccctcaacagttgacagtggagagtccctgacacggcagccatcggggacaagggcgacgaccggtgggaaggagctaggcgagctccctagtcttaccggcgagcgcgtgcaagagcgagatggccggcggccactcttctccattttcgccccgccgtcgtcgcaagagagagaaaaagaggggagatggggagagaggaagcagaagaggaggggtgagttagactgacatgtggggcccgccattcttttattaatttgtgtgaaactgacatacgagtcttacggggtttattatttttccggatcaaattgccacgtaagcgtccacatcagtgtcagatcgagaccgagtcaaattagccacgtagatgctacatcagctaaaaccgccattgaaaccgccgagggacttaatctgcaccggttttgatagtgagggacccgttgtatccggttttgcggttgaaggacgtaaatcggattcgttgacaagttaagggaccttagatgaacttattcttatcatatgggctctggttttcctggccacagctatggcccatttccctgtctctgtggccggcccaactcgcgctgtgctcccaggcccccatgccacgctgtccgtacccctgcctgcgtgcgcaccgtcgtgagcgccatggctatacggtcctttccttcctcctcttcttcttcgtcgccggcggcccggcgccatctccgttctgccgccgcaccgtcgaacagaacaccacctcctcgaagacattctgcaatggagtacggcctacggcaacattggagccctccctctcaatcctttccaattatggacatataccgcctccaactccaaatcggactcggactcagcgttcgagttcgactcggattcggagtcggagtacgtcgccgctccttaaaagcacggcggcgctcaccagctagagaccatccaacgcatccattccgtcctcttcgattgctgctttcccgtcgcgaccatggctcccgccggcgactacggcgcctcggtgagcatgatgatcagctacggcggcgcgatcgtccaggccgacggcaaggccaaggcggcgtactacgccggcggagtccaccgcatcgtcaaggtcggcatgtccgagcggctgcccggcctccgcgcgcggctcgcggcgctcgccggctgcgccgacgtgttcatccgctacgcgctccccggggagggcctcggcgtcatccgcgacgtggcggacgacggcgacctgtggggcctcgtgtcgctgctcttctactacaaggaggtgcccgtgtcgtccaagcccggccgcatcagggtcttcctgttcgccgccgatcacgacgcgccgccgcaccgaaccgcgtcggcgccgtcgttaccggtgctggtatctggaagtgcctctgctgctcctcccgttacactggggttgccacgcagcgcgtcttcaccgtcgctggcgacgtcgggctcgggcaccgccgtgaggatgaaggtgagctacggcggggagatcatccagcagcagcgcggcggatcagcggcggcgtcgtgctactacgccgggggagttcaccggatcgtcagggtcggcctgtcggagcgcctcgccggcctccgcgcgaggctggcggcgctcgccggcttctccgactccgacgacgtccgcatccagtacgcgctcccgggagaggagggcctccacctccacgacgtggcgagcgacggcgacctgtggagcctcgtgtcgctgctcttcttccacgaggcggtgatggcctccagcaagcccaagcaaggccgcatccgcgtgttcctcttcgccgcccacgacgccccggcgacgtcgtcgacgtcgcccaccgcggcgccgctcaggaggagcgcgtcgtcgccgttcttgccgacattggtggaggaagacgaggacgacgacgacaacgacggcaacacggacacggcggctgcaactcagacgagcactagccgtgtcaccgccaccgtgggcatgcggcggagcgcctcgtcgccggcgctggcgacgacgtcatcgagctcggacgcggcgactgcctcgacgtccggtggtgcaacatccggttcatcaggagacagcgacacaccggcgatgacatcttccacggcagcggcggcggcggtgcagttcggtccggtggtgcttgtgccggtgatggtggtgttcccggtgatccccgtgtacgcgattggcgtggtagattatcgtagtgtgctccttgtagcgtagtgaaacgccttgtttcctactgccaatctgagctatgtacttgtctacttgattttgtacaattcattcaaggttattattgtaaaccacattaccaatgtactcatcgtgtgttcactgttcaacggtattatatttcattcacagaacagattgcaacctaatcgccattagcatcgaaataaagcttatgtattgtagtgataaatgaatatatagcacagaaaacgtgaagtaaagcgtagctcaagttcgttgtgatggaccgggttcatccgggtcaaatcctggaccagtttcagcccacccaaatttaaattctagactttaaaatcgataaatatgctaattatatttttaatgatatgtatgtcaatagtgatggcttcatgaatgcaagatataccagtgaaccagtccagtttttcagaaatgctcagaggtagcttgttgcacatgttgtgaccacatgcgtttgaaaaaatagcacagaaaacattcgcagaatattagcaccatgcaattacaacgcaaaatgttgtaaagaatacgtagggctacacattggtgcgaggagccaacaaaatgctttttgccgcactggacttttttcaacgctttggcacgaacagattacagattgtgtccgggcctgctagttgcagcagaagaggtatcaacttcccagtgaaacttcacacagttctctagcttagctacacaaatgaagcaaacaaaggaattgctgcatggtagacagatacgacataaaatcgaactgaattggcgagaatcgaagagatgtccccattgacatatacagatgtaatccagctttttagacaaacattttactaccgagttccttcggcttcgcagctttccctgactccatatcctcaatgcagttaaagggggaaaattaaattcaaatgaaaagcccaaaaaacccagttgtctaaagaaaaatatagcaacacttgattatgctaaataacagtgaaccaaaggattcaaagccaaatatttaattacaagacaagaatgtctcctagaccagacaaactgcatgggtaaataaactcagcgacattccacttcggcattgatgtcagattgtcaggtcaagtctgtctggtgtgctcagtgtccacagttcaataatgcacgaattactttctttgtgactgtcacaggctcacagcacatagatcagaatgcagagcggctctggtcatacagtagtgttgtaggcaatcactgaaggtagataggccactgaaaattaagaacaagccatgtctgcatccaacacgaagcacatgcctaaatgttggcagtttggcacctacaataacaaaactataaaagttcaaagtgataaagaattaaagagcgtggcatgtctattttcttaggttgagggaagtatagactaggcaattaactttaagcctaaagagatactaacatatcctataatagcaaaattcattttccagatgttaggaactggggttgatccaaagctcctaaggtagtaatggtgctccatgggagggcgaggatggtgcatccaccgaaccatgacagtgaacagctgaacaagagagagagagagagagagagagagagagtttggcgataattctacttatccttcttattgatggagttctgccttctaaaatcgattaataaccttgctaacaaacagaaaatcttaggagctaaatcttatctagcttaacattgaaattaatccaaagctaatcctgattgaacgaaaagacaaggatgacttctggcgcacctagcacctggcatagggaattcccaaaataagaccagatctttccacaaagttttttcctaatttggatccccaccacacaatagtgaatttttcttttgttcaaaagaaaacacatatctgtagatatatgttctaataagaagtctggtaagaaatgataggacctgcgtgctttggcttgataaaaataacagacgatatgtctgcaactgcatgttcacacaaccttgtacgaagttacaggctatatgactggtgtcaataaatacttctatattatgttaagcattttttacaataatcagatctcttttgtccatgttagcaagaaaatttgatatgtacaatggcatgtattgccacgccaaataaattttataccagcttcacaaagaagtccaatttgataattggtatggaaagaccttttctttgcggggatggataaaaagactctgatctacatttagctcatcatatccagatttttaaatgtaaaattcgtgctcatgttagcttttcaaattttgatttcagaaaggtattttggaagcctggttctttcaatgatggaatccatcaatgtcatctgagactttttattggaacacactaattggtacatcatagaaacattatgaccaacactagcaaaagagtgtgttaccatatcacagtgaagactaattgtgaaaaaatagaattagtatggtttgctgctatataaatacacaataaataccaatacttaggcaatgacagagtacaggaattttgaagaatctaatattgcaaacagttcaattcctaaaagcacgaggtacctgtccctctgcattctaaatagggacttaactcttctacatatcccaacatgtatgctttaaatagaagaaattgaccatccgtaattaagatatatagtctaatccccataaacaaggtgataaaatgtaattatgtgtaggtgacaaatcccaagatacatgtggagattgtcaaaggaatgaaagtgtgcaaacaaccaatgcaaattactacctttcttattaacaaaggcagtcaacaatatctacaggggggaggacatagatgaatctaaagcaacatttcaacttaaatctaaatcagtttcaccatacaaacatatttaagaaccaatttagcaagaactaataataatcagccaatcaggtactagtaagtaacacatccagtggcaaacaagttgtgcttccagtactgaccaagtgaccatacattacttaatccagcccatgcatggtagaccaccaagaaaagaatattaggtagatcaaaaggggaaaagatgatgtgcaatgcaatacatgtgtcagaaaacaatacggggaatagggagatgcatgatattttagtgcagtacatgggtcagaaacaatacagggaaagaaaaatcacaattgactagcaccaccaccatccaaaaactacattctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39869 - DNA, 735 bp, Oryza sativa
gaatatgatcgttccatgtaggcggcggaaaggaccatatggaatgattattttcacatgcaactgattaagccgacatcttgcacaaagattatctttccatgcgaccacatgcgggtaccacatcaccatggaggaatatttttctacgcacgctcggatgaatctaggtcaacaacctcagtaccaaaggacatgtttctctctttgtaccgacttgtttcacatgttgggcaaccgtccaagtctgcaaattccttatggtacaatacatagtgatttagacaagcgtgaatcttttggacacctagagataatggaaatatgagtttcttcagttgatacgtgttggatgacaaaaagttaggcttaggaagcaaaactctcaagagactcatcaaatcattaaaactactatcggaccatccatgctttgccttccaagtaagtagtttaagcaccgaacgcaacactgtgatgtccttaccacatccattggattcatcgtaaagaagatcttttgatgacttctttaatgactcccaattctctaaacctcgtgctctacgtagtagtagctctggttcaatgtgccatagcatgtcctccagatcgaaaacggcctcaaaatcatcattaccggtggaaccatctacatccatcctttctcaggagacatatatatccatgattgcaaaattatgtctcatccatctggaaattgaactcttcacc

SEQ ID NO: 39870 - DNA, 5511 bp, Oryza sativa
  unsure (1)..(5511): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagctcagcaatggtggtggtgcaaggagaagggagaggtagtggctagcttatatacagtggcgacgaagaagacggctgctactgttcggattcgtgtccagggcgatcggctaaggtggggcccagcgggtggtgtcattgggaatgggtagtgtggggcccggggaatcacagcgcctccaaccatagaacatcggtggaacattccaagagaaggggagccttgggccatccgatcagcgagccgacggcgctggagatgccctcgtgtcagagaagaaaaaaaaagtcgaggatgatgagcttgacctttcgtctggtcagaaggaggggtgcaaaaaggtggctaaaagtggagcaattagctaattaattaattaactgttagttttaggtcactcctatctcatgtgattaagggaaattcactgtgtatgtacagcaaataggctgcagtttttttcagtgatattgtttactggccatagttcacaaaaatgttattttgaattgaagtttgaaattataaacgcctttttcaagtgattaggtacttttgtgcaatgtctgtataatccttgtaattattggtgtgatatatcagaactaattcctagaaattaagctatgcgtataagatcttgctttgtgttaacgatttttcattacttcttaatacgattaaaacggattagagagacaagcctagagctgttagggcttgagcatataggattgcactctatccctaactggtcatggtcctcttgatgccactttccctaaaccataaaaggatgaggtaccagttcagctgtggaggaggttgtggagatgaattctcataatccacaagtaattaaaattggtaaaaatttgcgtggggataggtaccatttcatctttttttaatgaacaccatttcattcttattattgtgttgttctatatatggatggttgggttgaagttacatttgcaattaatatattagtcaaatcacttcacaatccaactcaatttatttataatagtagtttgtttgggaggtgatacatatataggtcattcaatataatctaaggtattttaatttgtttgaagcaatctagagggccggcccattcagctctacttttcatatataggtcattcaatataatctaagatagtctaaataagttttccgaaagggcaaatatgtcaaaattttcatatcatttaacctctgaaatctacacacacaaagaaacagtaaaaaataaaattattaccttcattttttaatagataacacgattgacttttaaaattattaccttcataattaaagtttctttaatgataagacagttcaaaacaaaataaatcaaatttattttttttaatacgacatatggtcaaacgtcatgtccaaagtcaacggtatcatctattaaaaaccggagagagtatttaatgtcaggtgaatttgaatatttattttctaaaattggtggtccggtaccatgcatgatgccccttttcattgtcctcttgcaaaaccacatcaaactaacaatttgatgatggtgtggatgaattttaatttagcactttggttttgctaatttcactagtacggtaacctccatagttgccggttgggaactggccttaggtgtcggtttcccaaccgacaccgatatattggcacctatgtccggtatatgtgccagttttggaatcgacaccgatagagattatacgtgccggttcttaccccacaaccgaaacctgtagtattcaatgtataaaaaaaaggagaaaatctattctataccactgagtttgttcgagttcaacaatttaccattgacattgtccctttttataatataccggcgattttatcaattgttctataatacaacattgggttgagccttctttccaaaaatacccaaaataacctttatctcactagaagtttcaaaaaaacataaaaacttttatgtggcctccttacacaacatggaaatttgtatagaacttttatgtggccaacataggaagatgcgcgtctggatcctcaccgcgatggtcgccaccgtgttcgccatcttcatcacgctcgccgttgccctcatctcccgccgcggcagacggcggcggtggagtgggggcggcggcgaggggaagaggagctcgccgcctcctcatcccccaccgccgccgcagcctccgcgtcacccgccgccgccgccgacccgtgagagagagagaggaagagtgagagagaagagagaggaatagtggaaaagaagtatgacaggtgggtcccacatttttttataaatagaatgctgactggactgccacgcgtacgccacgtagaccaaaaccactgcggattgggtcgaggggggtaatttatccggtttgcatagttgggggtgaagaatgtctggttttgtggtttagaggggtaatttggtcgaccgcgattgttgggggggggggtaattcgtactttttcctttcttttaacatatctgtgttatctcattcgtgactaactacaccatcaattccttaccatgtagcaaccattacatatgtttcattatcaacccaaagcacggctccgtggcagtccttgacccccttgattataatcacaagacatacaaacaatttccaacaatctgttattctgatactattgcatgtctaattattaatgcattacaattaaatctcctccttaatacgaaacggtaaaaaatccatactgtgcatacaactactacaagaagggtggagagcggattcaaacaagggagaagctgctagtacatacatattggccggtaatagtctacacagtttatgtattccaattattttactaattagaaaatttaactttttccttctatgatatgtcatcaagtatcacaagcaacctagaggctcggtcctctgtgggtattactcatgtgaattcctcagggttaatgggagatacagggttaacgcagaggatgtaagtctctcgactcaacgtataagtgcattggagaactgcacatctataacctactaatatatatattgtgcttctttcatgcatgcagcttcctagaatagaacatcgaataagcattgacgatacaactattacaaatgtgcagcgcgatctctgttacttcatccaccgtgagtgttttcatgtcaaaggacggttcttcgacctagagagtatcctggatacaagcgaagaatacaagaatcttccggagtggaacaacacgatgcgataatgcaactagatagtgtattcgaagtgacaatgttataaatattgtaacatcttgacgacacttttcacttatacaatatatttatatttgtcagtatcaaatgtttttctagttactaatattttttatgcataaattaattaattaattggaacattatttatcacaaattattattgtaaaatttttttttcaaattcttgtacctaattaaataggcggctctgtcaaattttcttagacgcactggtcctatcttcgcaggcggacgcctttagctctagtccgcctgggaaaataatcttcccaggcggacctcccgaccgtgttgatcttcgcaggtgttggggtccaggtggagcgggcatctgcctgggaaggccattttcccccgcctgggaaaatggtttttctagtagtgatagttaaaaaaggtgcacatgctttggaaagtgacttgagtttggacttgcgaataatagaacaagataagttgataaatgggaccatatatgttccgctcacatcctgttgcagcttgtgcacactgataggcgactagctaattggcgccggtgtttttggcccacaactaaactgaaggattctatagctaggagtccaggactaatatgcatgcaagtggtgaatgggatagaggaatatatattgttctgccaagcatatgaacagatatcacctttgtttttcgaaaacaaaattaaagaactttgtttgaaattgtttaccatacataactaagaaataagtagtgtgcacgagagggatatgctagggactgtgcacgacgttgatttgtcctaaactcagtaggggcaagtaagatgtctctaacagtgtagaggcaagagacaacgagtaagacatgaatgaaaaatgataaataagagatagatgtaggggtaatagattaattttaacgatttatggatggttcaaacatttctggaacttcgttaattaaacagagcctaattaatgcatttcctattaggctgtgatgtattagactcgaaaaacccaggcctctaagcaagtaaacacgaaaatacctaaattgtgatcaaatgtctcactatttcgaattaatacctgcagtcagatagcagttaattgcccattctgacctctgaacacaccagcctttacacgaagactttaaccctttccaaattttcttcaaatttattccaaatctaaagtaaggccaaatttggtcgtcacactaactagcagaagttcaaatcaagctaccatatccagcagtatataattaaagaagttcatctctaggaaaataaaatataatgaaacccatccttaagttagttctaaaatcatcttttttgcaatgtcattttttttggtgtttttcgtgcattttcattctttctgccacaaatatcgtatagcgtgatacatataaaccagatatcatcaaataaaaagatttttgcagacaaggctccctagtcccaataggttgcaggcaggtattaactgctcctgcatgaaaaaattactcccctcgggattggttatagggccgcctgcgaaatgcactatcacggacggccgcttaagaccattgcaggcctctgcgaaaatcgccgttgtcatcacaggcctaaaaccacgaatagcaggttgacaacggcggcggtagactatggcaagcacgatgacactagtggtggtggtctagggtagccgatttggtgttttgaaattattttcacaagcggtcggtataggtgaccacatgtctcacatgtggttacgctagctgcatgcaaaaaaatgggattttcgcatacacgtacacctggtgtaggtggaccgtctggtcatctgcgaaaatcgattttgatcttatgcaaaaattgattttgtagtattgattgttactcgtcataaaatttaggcaattatgtttgttttggtgacacttagcccgtctactacttaattggatcattatgttgtcgtatatgtttgcatgtacaaacagt

SEQ ID NO: 39871 - DNA, 26588 bp, Oryza sativa
  unsure (1)..(26588): unsure at all n locations
ctgactgcctccttgttgtccctttcctatttgcgtaggttgccttgtccacgccataggctgcgacctctttgttgccagttgtcgcctcttagtcggactctacgaccatcgcacctcttcgttgagcgccccatggtcgtctcctgatccgcgttggctgccgctctcgtctccacctccctcctcgctggccgccatcctcctctccacgtcatcctccacgtcggcggtctcgcggacctcctctccaccgtcctccagcttctgcgaaaatgtaagattataagtgttattttatgtgatttttagctgataatgtgaaaacattttatgtgagataatgtgaataatgtgaaatttttttgtgatataatgtgaaaacttgttatgtgagataatgtgaatatttcatatgttatatttatgtgattttttctgtcgtaatgtgaatttttttatgtgagataatgtgaaaaattttttatgaaaaattggatcacgtgcgagcaagaggattaatgggtccacaagtcagcgcaaaccgactttggatcagaccaaactacaaggaaccgtcataggggcccacatgtcatcctcccatcaaaggtggtggctagggttcagccgaaccaggcttggtgcccccgccaccgatgctagaggtggcatttgccgacagaagggatgtagctaagtttaggacatggtgtagtgcatggtgactctacagcaactcctgatggtggttatgcatggttagcagaccaataaccgtcatacaactgctattgagaggctataaatggagctctcttcactttgtaacacacacatcaaggatcaattctctcttccactttattctctatagtttctagtaggaaataagcttaggagcctcagtcctatagtcttctcagagttctgaatatgtctctagtactctcttctttgtgtaagactatagtcgaattaatataattattttctttatttatttatgctcatattttatataattctttattgagtatatttgttatgagtagtatatacttcgtatatctacttcatcctagggtagtcgatccatgctatggtaatggtccaatgacctttataggttgcgctagctccaacttgttcttccgaagggtaagagtcctaggggagttagtgatattgtttactagcataaacgtggtgtttaggctagataaatatcgttggatgtgggtgtatcctatggaaagtgatgtaggcggcaggtggtgacaaccttgtccatcctttgtatttctccacgtctaggtttgatgtaagagtgcgtaaatgccataaccacgctggcaaaccagcagggagtggtctctcggtagtacttgggtgcttggaactaagttctatgttgtaagcatgtatatattaagtatgtactagacatgattagtttagaagtatagttgtatcatagtatccttagctatttactactaggcactcttttagaggtgaatctcttgtatgtgtctactaccctataaatcattatcctaacccctgtctagactatggtgaattaattatagattgattaaatatatataagtatgtcttcataccgccgcctccctgtggaaatattaatacgatatctttgggaatactcatgggtgaagtgctacaatggtattctgtacgcttgcggatttatctgtgatcgtaaaaaataccaacaatgctagccgcatttctccttcactttgatatagaattcttgcatccaggttaattctccaattgcaatacaactacattattttttattagtatacatgtaggaaattataatttccctttattaattgtgctagttggcagtcgaaagtggtacttaacgactgtcaacacccagctccatcgcaaccaacgacagttgttgctccaacaccactttcctgttaacagggaaatttggtaagtcccgaagttatcatcgacctagagtcagtattggcttcattgtcctggaatcggccgacgagaattatcaagtcgctaatagtcggattcttgctatattcggttaaggaaataaatctattagggaagcttatccagaagtgaccgagttcaaggaggatacgtcatggcaagtttatctattaattaagaatagtctattagtttccttttatctttaggaaagtgtgtttagtgttcaataaggactttatgtttccttttatctttagaaagtttctttcttgacctacaaggactagtatctaccgatgggcataaatatgtacaccgaggtcattgtaaactatctctcaatcaatactactctcggcgtatcgccaccctcttttctgaggttttacttatcaaccggcggaatttggcacctgacgcggggcagcatcagttcagttcgatctctggcggaggggtaagtcctacgttccgtcggccctgggaatctatcagctacattggtgttgttcaaggctacatcacttcgatctcttgaattgctctggtttggttgatatatttgcctacctgatatctcaattctatctctaattgcattgtgtttagagatgcatcgatttagatgggactgtcttggttaggcccgatctactgtcttagccgatatatctctacaatcacaatgctgttataaatagatttattatatccatcacattagacaaactaaacaaactaaaggtttcactgtttatctaaatcaattggattttatgacatcagacttttagccgatgtatgttttaaccatcggatcagtacttatcctatcatattattattagccgactggtttctattggattatattattattatatcttattatcatcagtcgattgtctttgtatcattatctatgttggacatatagccgattgctcaaaaccctatcgacatcggctagaatcggcatcggctaatgtcggctatcggctggaattactccatcggcttgttagccgatcggctgttttatctgctgtttacataccttgtcagttgcaggatcaaactgactgactgttaggtaattcttacagtcacagatagaaatccgcaagcgcatggatataccgatgtagcacttccccctacggagtattcgaaagggtatcgaatccaagggaacgtgtgtgatcagatcttcctctggttcatctaaggacaccaagcaaaggataggcaaggatagagaggatttactagtgagaaacaatgtctagggaaagcttaagtttaatcctaatgcaatacttcgggcactggtaacctgctgttcccagatgtcgctctactacgtacccggacagggaggacttaagtgatctcgagggctgtcaccacctctacacctacctcaaacataccgtgggatacacagcaattactgtataataattacctaaacaccacgtctaagcaattaatatctactttagtgtttacaactcaccaaagcaatcactatattttagttgattatagtgaacaataatcctgtatgctatttaggaactaaacaagagataattctcacaagataaatttaaattactcagggagaatattatattgaaatcagagtaataaacagaattaaagaaatgagagaagattaccgacaactccggaattcttctaacttcttctactctactctcttcctattctagtatacaatatagtacaatagagtctcttataattcagctcaagcttggaagtgtgcgttcaagtgagtgaagtgaggtatatttataagaccttgtccgaagagccccttaaccatcattagggagtgttttatcggggtgctagccgataagttatctagacattgcatcggcttacaaggattacatacaagttggatttagccgattgcaacaaaagcttcactgtttatctaatcttgtggatttaatgacatcggtcctccagccgatgtatgctttaactttcagatcagtgcttattctatcatatcattattagccgattggtttctattggattatattattggtatattttactatcatcagccgattacctttatattgctatttgcttcaagtgtcggattctacatcaaaattatagccgatagttcaaaaaccctattgctatcggcttgtatcgacatcggtcggaatcactccatttgcttgccaaccgatcggctctttgatctattgtttacatatcttgtcagttgcaggatcaaactgactggcacgcccgcatctcatcaacctttggacctacactagagctaagcagatctcctaggctagtgtgtgtttttcgcgtcaacactagtccaccttccccaactctagtgaggtcatcacccgcatctcctgctcaagcgccgactcctccctctccgcctacagttcaagcttcactgctgaaagtgcatctaggacccctcaattgttttggtgttaatgacaacacaattagaggttcactaatgctttttgttgagatgaatgcaaggataaaaaggagtggaacttgagtttaaaagcattgcagcatgttttgtggtaatcgtcttctaatccatgtatatcttgtgttcttgagtattaggatgccgtactattaagagggataccacatgcatataattggtagaacactagtgctcaaaatcctttgtttgaagtgttcttgttttattcttgtgagactatccgatcctgatcggactatccgatgctcagactatccgaaatttcatagaactttgctctctgtctttggtctgagtgttggcgaaaaaatatcggactatccgatataaggtcggattgtctgatacatcggactatctgaaatttctcagaacttcactctctgttttgaattgtttttttcctcttgagtgattttgaaatcagattatccgatgtgatcagagtatccgatgacccagagactccgaaattcaatggaacttgagtctctgtaagaggatgaaattcttgcttcaaaaataacggaatatccgatatgacatcggactatccgatcgatcggattgcccgaaattctccagaatttcgttctctatctgtggcttgcttgggggtcaaaacatcggactatctgatgtcaccttggactttccgaggtgggatgaaaagattctctctcaacggccacattttgggggaatctataaatacccctcacctaacccttttctagggttacccaactcattcattctcattcactttgggttgagcttggtgctaaggtgctttggatctttgagctctttctccctcctcgttctttgtgtggtggatccatgtggttgtggatttggtgtttgagggcctagtgtgtgtttcactcgatcttgagcactagggtttgaccaagagttgtgtggtgtcttttactcttggaggttgaggactcctagacggctaggtgtcactcccgagccaccgctctgcgtgtggttggccgggagaagtttgtgaaggccggatctcatctccgcaaggacagagataccccttagtagaaggaggagtgcttagtgcaacctcttgaggaaagggttagcaaagacccggctcttagtgagctcctcaacggagagtagaatcccctcaaggatttgaactccgggaacaactccatgaacttcatcgttggtgatctctcttcatcctctctttagctttgcttaattgtgctgctatagatctagtcgctgtttgcgctatactcttgtttgtgtgctagatcttcttgttgtgactctttagtagattagacagtctgatccaacatcagactatctattattttcggatagtctggctgtggatcaaactttccgaccctaattcagttttagcttctgcataaagttttaaattagcctattcaccccccctctaggcctaattgaccctttcaactggtatcagagcctaatctcctaattagccttaactgcttggagagatcatgtcgggccaaacgggggatggcaaagatggtgataagggagatacgtttccttatgactatccatccacatctacttcttatgtgagtacctatagcggcaaagctccgtacttcaacgatacgcgctatgtcgcttggaaacataagatgaagatgcatttgaagtctattaacccatctatttggagaatagtcgaaaaaggctatgttttgtagaaacccgaggatcccacgaaggaggacgacgagaacgagcacaggaatgctcaagccgctaatgcaatacttagcgccttgaggaacatacttggcactagcgatgttaattagtgcatgccgacaaaaatgtcataacagtcccttatgcttttacataagcagccgctcgtaaatctaagtattttttttccgcagtaatacatcctttttaacaattgatgtctctaattcatctttcttgtttgcagcgatcactatatactattcctagtatatccaaaggaccatttgttcgtagcattggacccaacacactacgacaaggaaacgttcatggagttcctcactattctgattttgtaagtaatgtaataatccatatgtgcataattgctattatgaaatttctaagtaactataacaaatgttttgttcgaacaacacacatatgtattaccgcaaaagaggtgggccagtaaaagagccgacaaggaataatctacacgccaagacaggcttgtcagtactgacaaatgatattaacacaatttttcgtagaatccttacttgttagtattgaccggtctcttattattatgttcacagtgttttaaacaaccccacagacttccctatgtaaataatacatgtgcgagatggttagagtcaataagaggtacacaacaaacagtgatgaagtaagtccggatattgcactccatacagggtattctgtcgaaaattactttgtaacatttattgtccactttgtccatagatcccgtcaatcccttacgtagcaaatcggttcgacgacacaattatatggaacatgtgcgctgagcactgccgtttcacccatcatgatgcctacaatgcacttgggctattctacgaaaaggagagtcaaatcgcaataaaagacatattcaacccactaggagagtgggaggaagaacatatatagtgaaaatataatatttttgttcgtgatgaaactgttgtttatttgtaatatatgtatgacacgtccataaatgttttgtgttatttattctaagactatttacatgtcaatgcaatattgtagttagaatgacaacttggttagctcctatgcgtagaatttcaaatttcgattatgaaattgcgggaaatgttgtattacatacgagacacgatcttcccaaatggccagtttgggaatgggcctcatggagcatgcggccggcctaacttgtctgcatgcgaaaaccgatctttgcatgcgggccacttaacccagttgcatgcaaagatcgattattgtatgtgctgattagggtgagcgcatgcgaaaatagtgatttttgcagacattttcgtgcatgcgtgctggccaaccgcatgccaggaccggttttggctcccaggaaaaatgaatttttttggtagtgggtgtaaattgtctagatataatggttgtcatatagtacaaccactattttaaaatgaagatgttttggtttttctaagtcaaatttctccatgtttgagcaagtttctattaaaaccattaataattaaaacatttttttttaaaaaacccccttgggggaaaaaaaaccccaattggggaaaaaaagtttctattaaaaccataataattaacattttaacctgaaacatgaatactatacaatagtagatttattttattaaattaatttaatgttggtgttgtatatgtgttgatgaaaaatccgcgctcggccgatggtgccagatctgtattggcgcgaactaactcaacgaacacaatagcctgggagatctgcttaactccagtgcaggtccaaaatattgatgagatgtaggcattccaatcagttttatcctgcaactgacaagacgtatgaaatgaagatcagagaaccactcggccaataagttgatagcaatgctagccaatgccaataccagctgatgtcgatatggttttgagcaaccggctatatgtccaatctagattatgatacttgagtaaataatgatataaagacaatcaattgatcacaatgtaataaaacagtaatataatccaatagaaaccaatcgaccaaaaattgaatgatagaataaatgccgatttgatgtttaaagcatacatcagctgatatttcaatgtcaaataattccacaagattagataattagtgaaacctttgttgcaattggctaaaaccaacttgtatgtaatccttgtaagccgatgcaacgtctatataactcatcggctaaaataccaatgaaacccttattgtcaatcaaaggcagattagcttttatgattctaagcacgactttgtaggtcaaacccaattgatgcagcattaagtctaaacaataaggcctttgactgattttcagggtggtggataccttaactaatctagatcgatgaaacaatttaactaataccaataaaaccctagaaaagatctagtcgatacaggtaaattcagacattgacttaaattaactaagatatataatgaatagatgtttacatcgacaagattatagtatcgaggccctagccctgccgatcaaacatccttaacaagccttacccctcatcggagatcgacgccaatgaaacctaacttgaaacaagaactcgttgagaaagaaggaaataaaaagggtgggatgcgccataattgtattgatcgagagatatattacaaggatacgggatgtacatatttatacacatgggtagatattagtccttgctggaaaaagacacaaactttcctaaagataaagtaaaatatacaagtcctgatcagactctaaacaatatttcctaaaaataaaaggaactaactgactctatctagttaatacaaaaattgccatgccgcatactctttaaacttggtctgttctcgataatcttcctgtaattgccatgccccgaatccactaagaatctgaccgctggcgagtgacatttcccattagccgattctagaactctgaagccgatacggttcctaggccgatgatgacctcggggcttaccaaattttggcgttaacaatttgtttctatattttcctataagctgggttaaacttacagaaagtttaatacaggataaaaccaaaacaccttatgttctaaaatggagggaatattaaactgataagaaacaacttaggtggtaaaatagaatttagttttcttttaatgtgtcaaatcatatcttactataaagttgatgcccactaactactaaagctccacatgcaagtgtaacacattatcatccactagcaattattatctagagtattttaaatcacatgcaagtgtgacagatcatcacccactagcaattattatctagagtattttaaatcacatgcaagtttgacacatcatcacccactagtaattattatctagaatattttaaatatcatgccaacataacatatcatttacaattttgttatatttttagaactcaatatgcaagcaatgtcaaattattatctccacatcattttcatattatttaaacatatacatctatcattcctataacgtataacatgcattcatctacatatcctgcagcaaagcatggggcataaactaattacacggctacagaacattacataggttagcatacggcacctatgcgaaaattagaactggcacctatagattagcatgagccagaaaagaaaaagagagccagctcgaatcgagccgaactcaccaacgtttgacaccgcgccatccccaaatcaaattgaaatccccaaatcaaaattaaattgtgaccatgatctattgacatcacagaatgaacatactcaacaacaaaataattcacaaaaacatttacaaaagagactggggattggaggggaggggagggcgagggctggccaccgggcttctttgctccaccttctgccccctcgccagcggacaagggagggcgctgcgccgccaccacggccgcctagtggggagcccactcccccggccgcgccctcccctcccgttggatctggcggaggggaagacgctgcagccgcccacgaccggatctgccgaatggggcgctgccgccgcccactccctcccctcccgctggatctggcggaggggagggcatngccactgtgtgcatacagagaggaagaggatagataaagaaggaaggggggttgtaggaaggaggaggaggaaagggattatagcacgccgggtagagaataagatttgggcgagtttttttatgtggttggcgcactgatcgatcgtctgggctgggtcaattttacaaaacggtcacctacagtttagtgccggtttttcctctagaaccggtacatatagtttttaaaggcacatgttttttatttttctcagcgtgtggcggtaaaaaacggcccttaggtgatggttttaaattaaggggcacctataagaccggtccctatgagggtttttatagcagtattaccttgtaagtggtggtcataagcaaatcaactagcctctcttgtgtcaagcttccacagactgagcggctcgatcggctcgtctccaccctactagatcaaatacgtaccatacatatgcaactattattaaatgtacttacagttattaagaggtggagtaatgtggaccgttgatcaagagaggggtaaggtatggaataaaaatatattgtaaccaatggtagaggagtaattaactagtgaaatattgccattatcgccgaattgaataccttgctccgttgatcggtactgtacgcttgtcgaaacaagatttcggcaatactaaaaggggtggctatcaagctggaaaagtggatgggtttagagacaaggaattttatacaggttcaggccttcttaatcaagaagtaataccctactcctgtccggggattgatccgccgagtgtattattgattatatgatatgggtgaaagtcgtgcccctagaggcacccggacccctccttatataggggaaggagtccgtattacaaaatacagtccatatccctaacggaatatgtagttacagataaaatacaatcgtaaccaactaggatctcggatatttccttgacatacaagtttagaatttaaccctagtccttttaaagacattctatctatacacggcaccccatacccagtcagactatacatgccgtgtaggtatggggtatccataaactccacagtagcccctgagacctttacagtcgacgaaacaatctcttctcgtagcacagaatgataatccgagtactccgacttcttctgccctgatctcccgagtaccaaaaatcaaagactgtgaaggtctaaaaatagaaaaaaccgggtgcatcgactagatgcacataattaggtgtagcccccgactacgtgattagttaaaaaactaaacatatagtcaagatgcaaactacattcaaccgagtggtttgacaaccgaatatcatatagtaaagcatatgcggcgttcaataaaacatccagccgactgcttttagctttaatataccaaaaatggagatatgaaaaggcctgagtgaaaaacactctaaagatccataaattcacacacttgataagaatccgagtaaaaactcttaaaaagatccatcaaacgtgatgtaaatgtgataacacaacaagtgatgagtctaaatagcctaggctatgactctcaccataaaaataagcatataacatgccgagtgaatgactgtattaaaaccagtcatcccaataaaacccaaacagcctttgcagcctaataaggcctacaaaattagtataacacctttctgtcgagtaccttttttatttgcatcatagtaattccaaggaatcatctaactgcgtcaaaaaggattttaacatcattgggccatactgttgtgagcaaaatttgccaaagcaaaaatgcctaagtccctaaggatcacaactagccacgctggcaatagcattgggctgaagtactgtataggcccaggtccatcaccactcctgaaaccctagcaaaataaacgccgaagtcagagcgtcgtttcgtcttccctgccaaaactctcgccattttccccattctctgctacagtgtaaactacactggcggaagctagggttaacaaatcctctccgatccatcctcctgagctccacaaaaaccttccgcgcaaccaccgcatcgattccccatccatctccagccatatcttggaccaaatcacaccatccaattcgtattcatggcagaagagaaagaaagcttcgagtgtcagtgggcgccctccgatgtaacagaggaaaacctgaaggagatggtggcgcacggtgttcttccggcgaaggagatcattggatggcgtccagcattcggcgaagcattcccgacccccgacacacatgaagtcgtggtattttctcatttcttctatggaggattttctcttccaacctcaagattcttccggggaattttggatttctacgggattagtttacatcacctaaacccgaactccatagttcgtattgccaacttcatacatgcctgcgaagcttttttgggcatcaggccacattttgccctattccgtcgcatcttcttcctcaagccccaaccgaacaaaagcaagccatgcgtagttgggggagctggatttcaacttaggggaactctgagccaaaagtatttctccatgcccttcaaaacctcaaacaaaggctggcatgcaaattggttctatgtacaaaaccccgagcctgcactccctgagtactcctgtcatcctccagtttatcaggacacttggaattcactaccaatgggagaagaagccgcccaggcgcttgccctgatggaccatatgctgaagctgaaggagcaaggtctgcaaggagaacagatcacccggcattttatcaagagccggctggccccaatcaaagaaagatctcgcacggccttcgaattcgacggcaaacatgaccctaaccgtgaagatcctgaatctcttgaattcaaggttatgaaggagagaatgtataagatcttctcaaatgcaatcgcagtcagctattcgcacttgctgccagtggtgccatacaatgccttcaacccccctccaccgatatgtatttaaaatcccagcctttctcaaaagcatgcttttatcatctacaaagttgatggaaaacttggatcatcatgcccaggaattcgccttgatgaagtcagaccccccaactgctcaacgccactcaccccgtcggcaaactagtcaagctaacggaggaccaaaaatccgatctgactctcaacccagcaccactcaatcggccaaccaatcagacttccgaaagaggaaattggttctgagtgacgaccaaaatgatgactctgaaaaagctggcagcaagagggtgaccggaaaatcaacaaggcaagctaacccgaagaagaaaacatccagtcgtcctatgccaaaaatcaggaagttctccaggtacaaatcatttagccattatccttgtattgatgcgcacttcattattgaaatagcactgatagcataactcaaattcgtaggaagccatctgacatagatccttctggaaaagactctgagccaactgacatggagatgggtccttcaaaagaaaccgggccgactgcagaagatcatccgagtgacaatcagtcggcaaccgacaatgtagaacccagcaacgagcccctgactggaaaccagtcagccgaagctagagtcggtgctaatcaggagcccccggctggaaaccagtcgggtgcagaactaaataaagatgtccctgaagtagaagctcaaatggacagccctcctagaaaggatactagtgctgatccagggtccagctctcctgttaaagtacaagagcctgctcgtccctgaccggaaattattataggtaaacacatcctctgaacccattttgatctgacaggctttcttcgattgtttcacctttattcatgaatatacaagggccaatgattggtgatgaagaagaggtccttcagatacgatcggctgaagattctcgcccacccattcaagtcaagtggtgggatgacgacatgcaacctcagggaatcatgataaacaagcaaaaggaagacgaggaagtatgtctgctgaaaaaggcactcgggcaagctactcgtatcgtaaacgtaagtctccctatacgcagcttcaaccatcctgtttgccgctttgcacaaatgccgacaaactcgccttgcagagaatccatctcaggaacgaggcgaagactgcgactcttgaaaggctagttccccatcttggaaccattgaggccaccagaaaccagctgcacgaagctaaagagcttgctaggaaaactgagcatgatctaagggatcggattgccgagctgcaagactccaactttgaactgagcggttcatgaaaaggtaaatacaacctctatccaacctacttatgctaccatccttgtaatatcaattaacaagaagaatacagtgcaagctgccaagatatttgaattggaaaagcggatccaagctctggagaatgacaaggccgaattggcgagacaaagggactcggctcggaaagacgttgaaggtactggtgactaatactccaaaaaccattcctttctttatgcccactcgttgatataaatctatttatgcagatcgcaaaataaagtcttaggctcaatttaatgtcttggtcaacaaaatcaagaggcttgaaggggctagggatgaagtcgccaacgctgctaccccactcatccaagccatgtttttcaataacaatggtccgagtacatttgatgcttctgagattttcgacaagctgagaattgctccggatacatactttaagaatatcaaggaagctggaagtatgggagcaagcctggcgttggcaatgaccaagtctttatacccgaagattgatattgacgccattgatggctttgcagatgggacgagcgaagaggccgcccttgacctcatcaacgatgcgcagaaagccgccaataagatagccgttgatgtagttgagagattctaggacaacgaccttcggccgactggatctgataattccaatgataaaaaaactgacaccgactgatgttgtattataacaatgattctgatgatgaagatgatggaggcacaatttgtacaatactgatgaatttatgctgtgcttgatatttcaaacttagctcctgatttcttaaaagcttttgtcaaaccttattgagcctaaaacccgcaaaagttattaaaaactttcagtcctcattgactaagccaaaaaatcaaacaaggcaatgataaatcaagtaagcaaattgaattgataaaaatcatactctattattattatagtagccctcgactgataactcaaggaaaaacatgatgttatcagtcaaagagggaaatacaaaagtaatgcctaagcataaaattgacgaagatgttcgatattccaagaattgtcgatggtagtaccatcttcacgcttgagtcggtaagaacctggccgagtgacttcggaaattatgaatggtccttcccacaagggagataacttgtgtcgatcccgtgtagtttttctcagaaccaggtcgccgactaaaaaggctcgtgattgaacattgcgattatgataacggcgcaacccttgcaagtaccgagccgactgaattaaagctgcttcgcgggcttcttccagtcgattgagatcatctactcagttatctccgtagcgctcttcgttgaagttacgaaaacgtaaagattcaaattccacctcattgggcaacatcgcttccgctccataaactagaaaaaacgtcgactggcccgtggcccgactgggagtggtgcacagggaccaaagtacagatggcagctgttctacccacttgccggcatagggatgcagtcggtcgaaaactcgcgcttttatcccttgaagtaccatgacattggcgcgttcaacttgtccattactcatgggatgcgctacggaggcgtaacaaatcttgatgccgaagtcttcacaaaagtctttaaatactccgccagtaaattgagtgtcgttaacagtgatgatccgattgggtaccccgaaccggtgcacaatattgatgaagaaatctctagccttgtctgccatgatagtgatgaccggtttagcttcaatccacttagaaaatttgtcaacagccacaaagaggtgagtataaccaccgactgcctttttaaatgggccgaccatgtcaagcccctaaaccgcaaatggcgaagacaacgggatggcctgcaactcttgagctggtagatgagtttgtcaggcgaaaaattgacaaccctcacatgtccgcacaattttatcggcgtcggccacagctgtgggccagaaaaaaccctgccgataagccttgccaacgatggttcgtgcggtagcgtgattaccacagatgcctgaatgtatatcttttagcaattgcctaccctcttccaaagacacacagcgttgcaggattcccgatggacttttcttgtacaacccggtctcatgaatgacatagagtctgctgtacctagagatccgctcggcttcatctttgtcttgagagagtttttgtttggtcaaaaatcttatgaggggctccctccagtcggcttcaatcatacttacgtcttgagtgtccgtggcttcaataaatactttcctcggtacggttggttcgtaaagatgttcaacaaatacgtcggaaggagctgcttctcgttttgaaccaaaattagccagtctgttggctgcctcattattatgtcgaagaacatgggtgtgttcaagtccgtcgaatttgtcttccaacttgcgtacctcctgtcggtaggcggtcatgttataatcaaggcaggaccactctttcatgacttgattaacaaccagctgagagtctccatgaactatcagacgccggattcccaaagaaatcacaatccttagtcacgttgtgagacacagaaaaatgtatccaaaatacgtagctcagtctttctccagtcggggaaattagaacaacccccgctccagtgtttgagagcctcttcgacccgttaaaatgcatggtccaatactccatcttcttctcaggcatgtcttcttggcactcagtccactcgtcgatgaagtcggctaaagcttgggacttgatcgaagttcgcggcttgaaagatatatccaaggacatcaattataaggcccactttgcgatccgcccatttgcttcgcgattatgacgtatatccccgagtggaaacgatgtgaccaccgtgaccgagtgaccttgaaagtagtgagatagtttcttgatagtaattaaaacaccatataatagcttttgaacctgaggatatcttgtcttggaattagccaaaacctcgctaacgaagtaaattagtcgttggactttttggacatggccttcttcttcacgctcaacaaccaggactgtgcttacaacctgggaagtcgccgacacatataacaacagcggctctcggatgtggtgaagctaggactggtggagtagtgagaagttgtttgaagtcttcaaaggctttttgtgcttcgggtccccactggaaattgtctgttttcttcaacagcttgaaaaagggcatcccccgctcgccgagtcgcgaaacaaaccagttgagcgccgccatgcaaccagtcagcttttgaacatctttctgggaacttggcggcttcatgttgaggatggcattgattttccccgggttggcttgtatgcctctatgagacaccataaatccaagcagcttccttgatggtactctgaagatgcacttttcagggtttagtttcatcctaaaagcgcggatgctcgcaaaggtttcttctagatacgtgatcaaatcatccttctgtttggtcttgacgactacatcatccacataagcttcaacattgcggctcatctgagttgaaaaacatctctggatcatgcattgataagttgctcctgcgttctttaatccaaagggcatggtgatgtagcagtaggccccgaagggcgtgatgaatgaagtctttaagcagtcggattctttcagtcggatctgatgatatcctgagtagcaatccaaaaaactgagtagctcgcagtcggccgttgagtcaactacctggtcaatgcgaggtaacccaaagggatctttggggcaagatttgttgaggtcggtgtaatcaacacacatgcgccattgtcccgtcttcttccgaactaagactgggttagccagccagtcgggatggagaacttccttgatgaagcctgctgctaacagcttggtcaattcctccttgatcgcatccttcctatcctgtgcgaagcggcggagtcgttgcttgattggtttagcgtcttccttaacatgtaaagagtgctcaatcacctctctaggaatactaggcatatcagattgttttcatgcaaagatatctttattattttgaagaaaggtgacgagcgcgctttcctatttacaatctaactcagtgcctattacagcagtcttagtaggatcagagggatctagaggaattttcttggtcttggcgtcgctttttccactctttggcatcttggttgcaggcacttctccttcgcttgctgtggacgcagccagtcggatttcttctcgggcgatcgtgatctcgcgggtctaggccatctcacagctttccttgtcgcatgtgacggcttgtttgatgtcacttcgaagggatatgactcctcgaggaccaggcatcttcatcatcatgtaggtatagtgcgggacagccataaacttggctaacgccgggcgtctgagtatggcatgatacgctgtcttgaaatcagcaactttgaagcaaacattttctgtgcggaagttctcccgagtgccaaaagtaaccggaagagtgatctggccgagtggtgtagcggatagccctggaatgactccgtgaaagggcgcattactcggctttaattccgtgcgagggatctgcatgtcgtccagggttttggtgaaaaggatgttgagtgcactgccaccatcgatgagggatctgcgaagcttgacgttgcgaaccactaggtctagtaccagggggtaccgccccgggtagaccactcggtcaggatgatcggagcggtcaaacttcattgttgtctccgaccaccaaagaaattggggcgtatcgggctgagcagcgttgatctctcattcggtcagcttttgcttactcttagattcataagccaggggtccgccaaagatgtggttgagttccttgtgatggtcttgaaaaccagtcggggcatcatcgtcatcgtccttcttcttcgacgtgctttgatctccgtcggaggccttacgtgcgttcttggcgtattgttctgcaaactgtttgtagatgaaacaatcttttgccacatgattggaattgggatgatgcggacattgggagttcatgatcttgtcaaaagtgttgacacgcgaacgttgtcagaaggatggtgttgtagttgtcacaagttcctcgggcttacgcttgcgatccttgtgattggcacttccactcccttctgtagtcggcgtatctttctttggcttctaagtggtgcccgactgcttggacgcgataatggcatcttcggctttggcatactcgttggctttttcaaacatctgtttgaccgtcttgggaggcttgcgcccgaacttgccgactagatcttcgtgacgaattcccttggtgaaggcggcgatgataacgtcgtcggtaatgtcggagatcttgttgcgttgctcagaaaagcatcggatgtaatcccgaagggattctccagacttctgaatgacgttgtagagatcaaaatgtgtatcagggcgttcaaatgtgccctggaagttggcgatgaagtggtcacgaagctccgcccatgatccgattgtgccacggggtaacccatgaagccaggaccgggcagaattcggtagagccacaggcaagtagtttgccatggctttgttgtctcctcctgctacgtgaattgcgagaccgtagacggtgagccaggactctgggttagtggtgccgtcatacttctcgattccagtcggcttgaaaccggctggccaatccactctgggttagacagcgactccatccacatcgtcgtcgtgatccggtgaatggtgggggacgtagcctcgtgccgcgtggcactggttgattgtatcgcgaagatcgacggggcgcctgcgaggtggggagcgtggccgttcaactcggtgctccctgtgtcgttcgggaggcgagtggacagatcgcccgtcgtgacccctgctcctgcgattggatcctgcgccggcgatgctgaaggctcggctggtgatagtcttgagatcgaagatggggaactcggctgccagtcggcgtgcggacgcttgcggagttaaccgggaccgaggcaacgatcatggtcttggtcagggtcaagatgttgacgacgtgattagcttggttgagtgcgtcttccttgaggagggtgtcgagaagggtgatcgctgcaaccgcgttctattgaggggtgcgaaagaccgcagttccctcgacgtcttgctgcacgataagttctcgtgctcgtcgcccggcgtccaaggcccgttgtcgtcggtcctcagcctcctttgcagcccgttcgcgttcctgttgctcacgctgccgccgttctcgctcttgtgcttggcgctcctcttccagtcggcgtcgttcggcttcctgttgtacgcgtagctcttctgcttctcgggctttgcgctgttcccccgtctcgttgtcagccatgaagatgccgaagtagagaggcgtgtagttatcttcaaagcccttgtcgaagtcgtcgaggttgcggttgtcgtagcgatagccgaagttgtcgtactccacgatctctgttggtcgtgagtcgacgccgggggagctgaggtagccgtccagttgttccgtcgaaaccgtgccgagcggctggagtatgacgccgacttccctggagctaggccggaccggggctgaagccggatcccgcctaggcctatggggagaagacacccttgtggtgaagacagtagccaaatcatcggggagtttcatcaggattggcggataggcccaatcgtcttgatcgggtcgtgttgaagtagattggatctcgtccaagtggtttgaagccaactcggtagagttgatcttggggtagaccatggccgagttcgggatgccgaacggagcggagatctggcctcttcccgactggttcgaatccgagtcgaggagagaaatcttaccgaagtcgttggtaatgaagtcgaggctgccgaaacggaacgcctgcccgggagggaagacgaagtcgtcgatgccagaaatgaaacccatcgcactagtcggcgaagaacttgacgctacccctagctggcgcgccaactgtcgaaacaagatttcagcaatactaaaagggggtggctatcaagctggaaaagtggatgggtttagagacaaggaattttatacaggttcaggccttcttaatcaagaagtaatacgctactcctgtccggggattgatccgccgagtgtattattgatcgtatgatctgggtgaaaatcgtgcccctagaggcacccggacccctccttatataggagaaggagtccgtattacaaaatacagtccatatccctaacggaatatgtagttacagataaaatacaatcgtaaccaactaggatctcagatatttccttgacatacaagtttggaatttaacccgagtccttttaaatatattctatctatacatgacaccccatacccagtcagactatacatgccgtgtaggtatggggtatccataaactccacaacgctagagaatgtaaatctacctaggcatcgatcatatctacacgggaaaaaaatcaggttgtgctttctttctcttctcccacatcgcttcgttcttacgagggtttgaattggttcactagaaaaatatcggagggagaactgccgacatggtcgaggattgaagcggtgatgaggtcagccggtcaatggcatggtgaagcgcatctgctaagattccatttacgcagttgattagtgatttacgtagctcacaatttcattcatataagagactagatgagttctcctcctctattcttcttcgagggtttgaataggtgcactcgcaaggagacacggtcatcatggttgagcatttttataatctacagctctgataaaaaacctataggaggcaaaggcgaacatatctctggatatttgtgttgggatacgcgtaggctacaatagcataaatcaaaattttctatcgcgtaaaccaggaaccatgcaagtattagatcatagatcgttaccactcgacgcgctgcgcagcggaagaagacgctgcaaagtcgaaggaactctcgcgaagtagcgcgcgtcgatgtagaggaagtagtcgatcgcaccggctcgaccttctcctcctcgtgcgttctcctcaccgtactcccacaccgatcagcaccgcaaaccagtggcgcctctaccggtatccacacgtacagggacacagaacgccgcacggagatgtgctagcacccgcgcgcggctagggttttgtgtggggagggaagtgacggcttaggtttctcacgtgatgcaatatctccgtcgttcgcaccccttacgaatatataggatccatcactcgggcctccaaggcctgtaggactcctattcggatccctatccgaattaagcttatattggatctccatccaatcgccttattccggcccattaagcgtgcgaccctgtaggttcatgtatactcggctgtaaaccaaaaactccttttcggtccacacatcaacagcggcccctagcagaacgtattgacccaccggacatacataatgatcatatcgactgaacctgtagtgtatacttgtatgaacccatttgcctcacgatatcgattaagctcaaggctagatatgtgacatcctctaatagctcaatcattcactcgaacctgttaatagattatataacttgtgattgactcctcattcacctttcgcatggccatgcacttccataatctacaacatcgaggggcccagagatatctctccataggaggggcaaatcccatcttaattattcatatcccactgcatgtttcatagcatacccgaaaactacttttataactacccaattacggagtagcgtttagcagtccctaagtaagctactacaaatgttgagaaccatgataatctcaggtctaaggattcaacaccaacactaaatgagatcactgatgacacaacacatatggctcttgcagtgtctcatgttgggtctatccaacaacatgttcaccaacatgtgtccacattattaatttggtatctctataccatgatccatgagacatgatcatcaattaatacatgtgctgataatataaacatatttattccacatatgatatttgatcagggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcctctagggcatatcactaacagtctcccacttgcactagagtcaatcatgaatgtatcttatacccattgccctagtgtgtgcctcatgcttagggtgagggagtggctttgtcaacggatctgcaacattcaaatccgtatgtattttgcatatcttcacatctcctctacccactatcttgcgaatgaggtgataccgccgtaaaatgtgtttggacttttgatgcgatctagggtccttggcttgtgcaatggcaccactattatcgaatagaggtccatagggctagaagcactagtcatcacacctagttaagaaacaaatttctttatccaaacagcatcctttgctgcttcagaggcggcaatatattcggcttctgttgtagaatcagccactgtatcttgcttggaactcttccaactcacaacgcctccattgaggcagaacacaaatccagaccgcgatctaaaatcatctttgtcggtttggaagcttgcatcagtgtaaccatttacaacgagctcttcctgtcctccatagactaggaacatatcctcagttcttctcaagtacttcaagatattctttacagctatccagtgactctcacctggatctgattggtatcggtttgttgcactaagtgcatatgaaacatctggacatgtacatagcatagcatacatgatggatccgattgccgaggcatatggaatcacactcatcttgtttcgctcatcagtcgtttgaggacactgattcttgccaagattaatgtcatgtgacatcggtaagaaacctttcttagaatcttgcatgttgaacctcttcaacaccttgtcaatgtatgtactctggcttaatccaattagcctctttgatctatctctatagatccttatgcccagaatatatgctgcttcccctaagtctttcattgaaaaactatttttcaacaatgtcttaacggattcaagaataggaatatcattcccaatcaataatatgtcatctacatataggattagaaacaccagtgcgcttccactaatcttcttgtatacacaaggctcttgttcgtttttgaaaaagcctaacaccttgactacttcatcaaaacgaatattccaactccgagatgcttgcttcaacccatgaatggatttctgcaattagcatatctttttagttgattgtggatcaacaaaacctttgggttgtgtcatgtacatatcctcatcgagatttccattgaggaaagctattttgacattcatttgccatatctcaaagtcgaaataggcagcaatcgctaaaacaatccgaatatattttagcatggcgactggcgagaaagtttcatcataatcaacaccttgaatttgtctgaaacctttcgccaccaatcttgcctggtagatgtgaacatttccatctacatatgtctttttcttaaagacctatttgcactcaatggcttttacaccatcaggtggatcaaccaagttccaaacttgattgacatgcatggattctatttcggatttcatggctccaagccatttctcaaagtttggtcccaccattgcttcctcataggtagtaggttcatcgttgtctaacaacaatatatcacgttgtcctgtagttaacaatgcatacctcgcaggtgtacgccgtatcctttcggaccttcgtgaagcccgtgcttccacaactggttcaacaacaacttgttcaacctgttgaacaacatcttgctcatcttgttgtggttgtgtggacgttgaaccgttttctggtgtttcatgaatttcttcaagtcgcaccatgctcccactatcctttcttgaaataaactctttttccaaaaaaacaccgtgtcaggcgacaaacactttgcccttttcccgattataaaaataatatcctttcgtttccttaggataccccacaaagaagcatttatctgatttaggtgtgagtttgtccgattgcaaacgttttacatagacctcacagccccaaatcttaaggaaagacaaactgggacgcttccctatccatatctcatatggtgtcttatccactgataaccccaaaagcttaccgacagatcagtttggctcattattgatcgcaccatgtccaacaatgtacgattcctccgttcagacaccccattccactaaggcgttcctggcggagtgagttgtggaacaattccacactcctttagatgattaccaaattcaagtctcaggtactctccaccatgatcagatcgtagatacttgattgtcttgcccaaatga

SEQ ID NO: 39872 - DNA, 2422 bp, Oryza sativa
agactgaacatccatcaagattcacaatgtataagccattcatcatgggtgcatggaaatagaaaatgtcattataatagactgaacaaccattgtccacagatctaaaaccataaccctctgcttgcaaacaagaagcagagataacgttcttacacaaagctggaatgcaataacaattatttaactaaaaaactaatcctgacggtaaagataatggcatagtgccgaccgcaacagcagcaactcttgatccattgcccacgcgaatgtccacttcgcctcttgctaagctcctacttcttttcagccctgcaacgatttgcatatatcagcaactgacccggtatcaaatgcccaagaatcagtagaggaagtagcaagattaatttctataacattaatacctgaggtggaactctttccatcctgctgcttctgcttgagctgctctaggtatttcttacagtttctcttccaatgacctgtctccttgcaaaagaagcactctgcatccttagcgggccctgtcttttgaaccttggtcttacagttgctagtactcgtgatctcatcagagtttagctttctcttttgaccactcttcttgttgttgggcttgagcttatgcataaccatcacatagttggagtttttcttaatgctttcctcggcagtctttagcatcccatgcaattctgccaaggtcctgttcaggttgttcatgttgaaattcataatgaacggctcaaagctgggagggagcgactggagaatcaaatcagtagccaactctcggctaaggggaaaaccaagcttatccagactctcggtgtaaccaatcattttgatcacatgtgggctcactggattaccttgtgcaagcctgtacgcaaacaagaactttgaggtattaaacctctcagctcttgcttggtcctcaaacatgttacgtagtcccgtgattatcgtatgagcatccaatgcctcatattggctttgaagctcaggggacatagtagcaagcatgagacagcttatatcaaggtaatcattgcatcgcctttcatgcttcctacgttgagcagcaggagcattgttgggcaagtcagctggaaaaggctgtataagcagaaactctttgtgctcttgcctgagaacaattctcaggttgcgataccaatccatgaagtttgttccagtcaacttctctttctcaagaatagaccgcaagttaaaattggatggtgcatgagctgccataatctacaatagaaatatatgtatgcaaaatcagcaccatgtttacatttaacctttcatcaaacaatttaacaaaagatactcccattatgtattgtgaaacaaaattccctctagtaacatagtgagttaagatcctcattttattagtgtctagtgagctttggcatccaagctagacaattatcaaaacaggtaagcaacaccttgctaatcacatcatatgtgactcttgtgctgttggggtgacatctccatgtccaacccaacctatgccccaaggtccaataaccttgtcaagtaaaccaataatctccgcatatagatgtccgacatctatcctattttatcatgataaaaagtgacactttactatggcaaactgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattgagaagaaataaacaaagttgaaaaggtttataaaaagaaaaatctctaaaagtcttcttttccccccttcctctcttgggccggctcggcccaactctccctccctctctctcctctccccgcggcccatcggcctcctccccgcgcgcgcgccgctgacaggcgggcccgcccgccgccctcgctgacgggtcgggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctcccgattcccccgcttttccctctctctctccctcggattcgttcggagttaatcccgcaagtttcgccggcgtcttcaatggtggccgagatctccgcggccgattcctccccctccggccgttctctctctctcccggcgctatataagcgttccccgtgctctcctcctccgtttccgccactcgccgcctctcctccccgtcggaatcgagcccgcaccgtcgcaccttc

SEQ ID NO: 39873 - DNA, 5348 bp, Oryza sativa
tgaacccctatattattatctccttgtactcccttgcattaatcatgcattctccggtgtgtcttgctgagtactgtggttgtactcattcttgctctatctttctcccctcttcagtaagagaagctttggagaagatgtcttaggtggagtcctggcttataccccagttgagcgcctgtgaagatggagccgtaggcccgctagtccgctgctgtttatttttgattgtcaggcctgaagtgcctttgtaataatgtaaatattatcgatataataaagatgtgtcctttatatcatgtttgtgtggtgtaccccggcttttcctgggacggggattaatacactggcgttcgggaaaaggcaattttcccggtcgcgacaagatggtatcagagccatctcgactgtaggataagccaagtggataaaacctaaggacatattttataaataaaactatttgcgaaagttccttttttctccttcccttaatgctatttgcaaaaggtttactcccttcttccttcttcggatttcaactagtactagttggtcaggtcagtgaagaagaagacatcgtcagttgtttgtcgaaactccagaaggctgttggatccgtcagcgcagcaaaggaagcagtgaagccagatgtgaagcaagagtgaagatcttggagaacccgtcgcagaacctaagccaccctctagggtagagtcgttagttgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggttagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgacccaaaagaagcaagtaacatttgctttatgtgtgatgagcaagggcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctaatggaggtagagtgtctgatagtgaagattcagatcaagtctcctcagatgatgaagatgaaatggaacgtaaggcatgctctcgttgtggagaaatcggtcatgtcgccagctcgtgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaacggagagaagcatcaaggcaacaccaatcctcgccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcaactccctgcaatcggaagcttgctcctcagcgaattgtcatccatgcatcccgaagcagtcctatagcccgcgttgcaacagctccaactccagcgagtgcattaccacagccccagccatcagttgacaagacagaggccagtatcggcattgtacctttggatgttccagcacagcagccaagaaatcaagtacaggatgaagaacccaagcgtaagaaagttatttacaacggtagtacctgttaaggaagcagacgtgccaatcgccaagtggtcactggagcaaatgcagtacctgttaagcctagcgctagtcagaagcaaccataatactcttgtatcagtaatcatatacttatgttttatagttgttccccgtcaatcatgtaataacagagaaacatgagattatgaaggagtttgataagtttatgaaggatccatgttaagatcgcaagtgcggtgagttgtgtacactttgttgctgattagggagacccagggtctcatctccgtaagctcataatctattatgaatcaaataacctcgcgattgatggcgaagaaaatcaagtgatcaaccaaagagacatttgtttggactaagagtttcagatgtgtcttcttcggatcaaaggcatgcacccgttgtggagaaattggacacgttgctagcatgtgtctcacactctgcactccctatgaagaagaccatccaccaggggagtgtcccactcgcaaggtgacatgttttctgtgcgaaggagcaaaccgtgggcccaaggattgccaactcagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataataccttcagcattaaccattctctgcaccgacagcctcagcaaggaattgtcgtcgatggaaaaagttgtgtctctccccgacctactccaggccaagcaaagggcaatcaacctccggagggcgataccaagcagaagaccgtcatccgcttcaaacagcaatcagaaggaagcttctcctgtgaatgatagcaatatgcagtcctatcacataatcacagaaccaatcaaggatgatgcagtcactagaacaatgccagctatatctctccagaatcaaaatgagcagccatgtttgtggttttcagttcgctacttatcatggtgtaatcgaaagtttgcagcaatcatgtaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgggattcttttggaagagatcggaaaagatgtttggttactgggaaaagaagtaggtcgaaaggtgattgataaaggataacgagaaccatgatttgtgtcactcgaggaagactcccgatagcaaacaaccctacaacagttgccctgtcattaaagtaggtgaattcacgagtaagagagatgaccgcaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcaatagtatcgctcaacgcattttcctagcaatcgatccatcgagaaagaacacatcaaggctgaaggtgcacaggaatacgttgaatgctaaatgatgacaacatgaagagaatagcggaaagtaaactgaacataaagaaagtgaatccgagctgcttgttcgtgagagccattcccagttatagaaccagtgatatgttcgaagatagtctacagaggtcagattaaaatcacctctaacaacgaagcttcagatctggcaggatcacgatcagacaataacaagtccagcagcaaagtcattcgggaagacgtcaaagcatgtcaagcgggataaattggttctcttgggaagcataacttatagttagagtggttgaccctggaatcgaatagcagaagtagctagcacccggagaccaggaaagctaatatgaggcagttaggggcaagttgccaaacatgatatcctagtaatgacaaagctgatgtcgacgcatgtcacgaaggtggtaactggtatgaggttgacgccaaagatatgaatgataagaagttctagaactgaagccccatcctcaaccaccgcagcctagtctgagtcagttaaaggtgcaaccagggacaagtcgggtgaagagaagatttcttctgcaacaggagatcgagccaagcagtccagagcggaagaagtcagacaagaagagaagaccgcccaacctatcttcttgctagcctcctcgaatctcggggacgagattcttgtaaggggggtggatttgtcacgtcctgataaattcatcccgaaattaaaaatcattctctaaaaggaataatagaattagttaaaattcgaaaagaaattggtaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggtttataaaaagaaaaatctctaaaagtcttcttttccccccttcctctcttgggccggctcggcccaactctccctccctctctctcctctccccgcggcccatcggcctcctccccgcgcgcgcgccgctgacaggcgggcccgcccgccgccctcgctgacgggtggggcccacctgtcatcgccttcctcccgccgctcccgccgctcgcccgtgccctagcgccgccgccgccgcagattccgccgcatcccaccgtccctgcgcgccataatgaggggggaatcattccccgcgattccctctcccgtttcccccgtttttccctctctctctccctcggattcgtccgatttcattcccgaaaccctcgccggcgcaatcaatggcggccgagatctccgcggccgattcctccccctccggccgttctctctctctcccggcgctatataagcgttccccgtgctctcctcctccgttttcgccactcgccgactatcctccccgtcggaatcgagcccgcaccgtcgcaccttctctccgccgtcgccgccgagctccagatcgccgccgtcgtcgctccggacctcctccccactcgg

SEQ ID NO: 39874 - DNA, 6981 bp, Oryza sativa
cgccgtcgaccggggtgagccgaagaccgttccattcgcttcccccttccctcctctctctcgggtgccgctccgccgcgccggtggtcgccggcggtgaccatcggggcgcgggcgcgttcccctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgagatttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatatggagtttattagagtaaaagcctttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgaccatactattattgttattgatattattaccttgttcaccctagaataaacaaaaccccaactagtggacactctatttatggttccactagtatgaatttaggtagatgcttcgctgattaataggacaacattaggtggattttataattttagactttgggaatattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgtttcaaattcttaaaatttgctcgacaactaaaatgtggaatggttggcctgggttggcttgggacgagctgggacccagggtcgggttgccagttcggtctgaatcatcgtaggccttgggttaaggcaggtccgtgagggttcacggccttgtgtaataatactgtgtagctctaggatcgtctttataaaatggctttgggcaaccaagtgacttttaaatgctgtttactgcaaaacttaacccctatattattatccccttgtactcccttgcattaattatgcatctccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacatacgattcgccatgtgaaaaccttaacggcgtaatcaaattatgccgaaaccgagtcaatctcaatggctcgtttttctcattggcgtgcggttcttgtggacatcggactatccgatgaacacaatcgcccttggccttggtgagtactagacattccagtgaagtcaccaacacacataccgattgatctcatcaacccatgcggctatcggttcatcgcatgttccgatcacctaagaactcatatacaacataatagatctcatctactacatccgcatatcaactatatgcaatgatctagatcataaactataaaaggtggctctgataccactattgggatacgcgtaggctacgatagcatatatcaaaattttctatcgcgtaaaccaggaaccatgcaagtattagatcatagatcgttaccactcgacgcgctgcgcagcggaagaagacactgagaagtcgaaggaactctcgcgaagtagcgcgcgtcgatgtagaggaagtagtcgatcgcaccggctcgacctttttcttctcacgcgttctcctcgccgtactcccacgctaatcagcaccgcaaaccagcggcgcctctaccggtatctacacgtacagggacagaacgccacgcgcagatatgctagcacccgcgcgcggctagggttttgcgtggggagggaagtgacggctagggtttctcacgtgatgcaatatctccgccggtcgcacccctcacgaatatataggatccatcactcgggcctccaaggcccgtaggactcctattcggatccctatccgaattaagcttatattggatctccatccaatcgccttattccggcccattaagcgtgcgaccctgtaggttcatgtatattcggctgtaacccgaaaactccttttcggtccacacgtcaacagcggcccctagcagaacgtattaacccaccggacatacataatgatcatatcgactgaacctgtagtgtatacttgtatgaacccctttgcctcacgatatcgattaagctcaaggctagatatgtgacatcctctaatagcttaattattcactcgaacctgttaatagattatataacttgtgattgactcctcattcacctttggcatggccatgcacttccataatctacaacatcgaggggcccagagatatctctccataggaggggcaaatcccatcttgattattcatatcccactgcatgtttcatagcatacccgaaaactacttttataactacccaattacggagtagcgtttagcaatccctaagtaagctactacacatgttgagaaccatgataatcttaggtctaaggattcaacaccaacactaaaagagatcactgatgacacaacacatatggctcttacagtgtctcatgttgggtctatccaataacatgttcaccaacatgtgtccacattattaatttggtatgtctataccataatccataagacatgatcatcaattaatacatgtgctgatcatataaacatatttgttccacatatgatatttgatcagggatcctttagaaatagtaacaaacaacataaagagtctcataaaagaatcacatattcattaaccaataaggagttatctatttcaaagaacaatgtcggataaatatgtaaacatagtgtatgatacaatcatctctatgattgcctctaaggcatatcactaacaatttggcatgtggtgtgtacgttgcggcaattgcctgccttctaaaatgcatgcacatatatgcccaataaatggacttgcaatgtggaggtggtttccattttataagaagtaaagtaaatcagggagatggttattctcaggtgaatattaaaatctaagtatatgcatgacattataaaataagtcatttaattccctaagatatgtaaaattgtgttaattagtgaattgtacaaaacatgtaaataatgaaatggatgattactaggcgaatttgttcttaagaaaaaaaatgtaaatctcaaaagagcacgcaaatatcgtcctgcagatgataactactcgtaccgatgcggtacatatgtacatatagaactaatacttaacacaattatatccttctctatcccctagaaaattatctttttatccttactacctaattaactgtgccagtatttaaataccttataagtggtaccttttagttttactgttgagcgctgaatttttgcctttttttagaatgcctctccatatattaaatatatcagcagaaaacgttcctgttataccagtatctttttctgcaatcccagcagtttgagggcgactgctttgatcagataagtgatattttaagcacaatagcgaccgtacgttataagatattcgctctccgagtgcgtccaattatgtataaaaattggaacaactagaatgggagataccaccaacctttgtcatcaaaagtcatgggcctgccgatcaagatagatgtgataatgcaggtctaggctacccaccatatccatatgtctatgtctatgtgtgtgtatgttgcatatattcatgctctaaacttttagctgtccacgacaacaatctctcgtgcttatcccctacaaaacgatgtgcttccctcttctatgttgcaaaaatttaatttgtcacaagtcggtccaatgagaatttgcctcaccatgccatgtccgtatgtatttagacaaaatttgatcacatatcataaattgctcaaagatgggatttttttttcattacgggtggtgttcaatgagaatatgctggctaaaaaaattatttgttttaatgttactcaatagtaagagggagtcggggatttatcccatgctactcaatgagatatatatcaccttagatctcattttgttttttttagcttatggctgtgtgtaatatgatagaagttagaggtgtataaaacatttgcattatcttaaaacaaattgctcaaacaagtaactcatcttatttcgcgatggaaatcttgtccaacatgtgccatgtcccaattttttccaaaatgtaagtctcacaccgatttcttttgtcgtaaacaagatcacacgcgattcagaaaatactccctccgtccttttttaaatgtaaccatataagtttccgtgtctaattttgatcgttcgtcttatttgaaaatttttataattagtattttcgttgttataaaatgatagaacatgaatagtagtttatgcttgacttatgttttttaatttataaaaaaaattttaaataaaatggacgattaaagttgagcacagaaaattatggcttcactcgaaatgggatggagggagtagtcgacaataatgcaatagtacgttttttaacatattatctagctcaaattgatcccactgtcaaattgctcgagctaatcgtggcatgccgcatgtgcaagacttaaccgatcaaataaattaaaacaactgtgtgccccgatgagcgcgggcaatttgacagtgggatcatattgtggctcataatacagagtggaggcgcttacaagaacaatattcccttagttgccaattgccattggaataggcgcaatcaaagaattgattcccgtgtgatggctccaacactctatctacgtccccataatgactccaactttacaggcaacccacgtgaattgatatgttccatgggattcacataaccaaaacaaattatataatgaagtgactggttgctttataacatactccctctgtcccatatccccttatagattgattctttttggacggaggggtaggtgactaaactgtgcctatcttacaaattatggtaattagttcgtaccccgcactttgctacagaataagtggatgaatacatgctatatattatagaaatggtagatatatatttaaataatataaaaatgatgtgaagataattaatgatttgacaatgcttgcatattgagttataaaaatataacaaaattataaatgatatgtcatatttgcatgatatttgaaatagtctagataataattactagtgggtgatgatgtggtgcacttacatatgatttaaaatactctagataataattgctagtaagtaatgatgtggcacacttgcatatgattttaaagactctaaataataattgatagtaagtgacgatgtggcacacacttgtattttaagctttaaaagttagtggacatcaatattatagtaagataggataccaacaaggcgacgagatgatctaacgatggatctaatggtattgggtctccaattacaagctagcatcgaagctccattcttgttttctcataggtccatgctctccctaaacaatagatcttctcatgcgatatagcctaggttttttttttatataacaaagcaacttattgaaaagaaaagttcaggagacataaaatccccggtacatcacctggattaaaattaaagataatatagaacaaaagcatcccttctgcaagtaagtgtatagttgaactaagagaaataattttgcaaatgaaaccatgcagcaataatgaatggggtcgacagagggatacgacattattgttgtgatgacttcatcctccacaggccagatctattactaacgtacgcaccgcttaggtggccctgtcaatgtgattcaccggactcaacaaaatatgtcactaatttattggttaaatcagatgcaccctcttgtctaa

SEQ ID NO: 39875 - DNA, 1240 bp, Oryza sativa
  unsure (1)..(1240): unsure at all n locations
attttttatattttagcccttctaaaatatatgttttacatataggtccccagaaaactaattatagatatggtatggaaccaccttggtgctacggatattggcaccaagatgggatgccttaagactaaatatgttgaacgccgaggttgttttggtattgacgataggccgagtattgagttgccatcaatttttggaaaagaaaaaacctaacaaatcgatgtatcctagttcattctgataacttttttagtgaaagcttaatctgagagaagaatgtcgatcattcactcctcccaatacctaaattctcttgatttgctattaaattttgaaaagaggcaaaattggattgtgactcattatttgtaattttttccccaaagctaaccaacaggatttaggtattcatttaaaaaaacaggatttaggtataatgagggagggacatacatcctcccccatattaagaaatggtacctannnatnnatnagcggtaataaaataagntacntcgaatttgtaagttttatcccaataaattagcatcaaatcagtaggatttggacaaaccctagatggtagactagccccaaattgattggcgccgtaataaaaacgtcagcaccatatggtgctgagatatcccacctcggcatccctgagagtctatttgtaaaatacgttttttcagagtgtgttaaaaaaatattgaaactggaggaggtcccgagccacgcgtccatgcatggccggggagatattatcgtcgcaggctagctttgtagttgtatgtgcctatcaaccagccggcatgatctgctgtagcgagcaggacagacagaggctggacctgggttggaccaccatgttgtggcctatctcctgcttggtctgtgtaccacactactagtttagttagctagtagatgactagaggtgcatatggttttatactggagcattattggatatatattgtatatatagctagctaccgtataaagaatccatccgctgtcaacgttctagaaacttctgtttctctacacgcatgcatctatatcatggggtcagattcaagtggtattaatacaacgacaccgttctatgtatggtaataaccagctacctcagtctcatatgtagttgttactagtatactcaagagtgcatgcactttttttctttttatggacttttttcttagattacccatccgattcacgatccgat

SEQ ID NO: 39876 - DNA, 4862 bp, Oryza sativa
aagatggatgcgtggagaccccccaaaagtataaaatcaaagcggaccggaactcgagaagtgcataggatagtttattttttgcaatcgagtttttagaaaaaaccgtactattaagaggggttctaggtgatgctctgagatatctcaagtgctcttagtgtgaaccaagtgtcaagtttccctaggagtcatttttgcaaatgctccattggtccaaaaatgcaagtccggaacttcctgtcttccaggtccggaacttcctgtctagtttccagttcaaatttgtgagtaacggctagatgacgtcacctagccgttatacatatacagctcgtttccagctcgttccttggccttccactttcactttttgaacctagagctgttgctagcctctcccaagtgtttcttgccttctccactcaatctagagcctaattcttgtgagaaagagagattgagagggagagaagaagatttggagatgtgtgaagactaggatcttgggtgagcacttggaatatctcgtgggctgtcatctcggtgctaattactcttggagatgatctcctagacggttaggtgtcgcccacgagaatccgttgcatattgtggatgtcccgggtaagtttatgaaggatctcctctcctccaaaagggaacgaggtaagttaatgaagttcttgtgctgagattctagaggatttccaagtagagcaacctacacttgtggcgaatttctagaagtagtttgagttggattttggtgatcactcaattctagaaacttgcctaggggtgtttgtggttgaaggctgtggatttcctctggagtttttgcacaagtgaggcaagaggttaatcgagacccagctcttgagctcctcaacggagagtaggatcgcaagattcgaacttcaggaaaaaaattgctcttgtctctttctgtgatgtttttttggatgtttctgtgatctatcttctacttagaatacctgtgcatcatcttgtgaagattggcttagtctcctgattcgaaatatgaatttcatccttgttttgtaacccggaagttcctgtcctaagaacaccggaagttctgggcctggcaggccggaagttccggagttccttaccacgatgttccgggtctgtttgaattttaacgctgcgatttgtttttaagttttcagggacagcctattaaccccccctctaggcttcatcagcacgttcaacaacagccaagaaatcaagtacaaggtggagaactcgagtgtaaaaaagttatggtttgttacaactgcaaagaaccacgacattactccagggactgtccctaaccaaggaaaaaaaatcgcctccacattttcgccaatttacaagaagcagacatgccaatcgccaagtgttcactggagcaaatgcagtacctgtcaagcctagtgctagtcagaagcaaccataacactcttgtatcgatgttcaagtacttttgttttatagttgttctctaccaaccgtgtaataaggaagaaacgggaaataatgaatgagtttggcaaatgtatgaaggatccatattgagactgcaagtgttgtgagttgtgtacattttgttgatgattaaggagacctagggtctcacttccgtaagctcataatctgttatgaatcaaataacctagcaattgatggcgaagaaaatcaagtgatcaaccaaagagacatttgtttggactaagagtttctgatgtgtcctttttcggatcaaaggcaacgatagtccgtatagcttttgacgaactatttcaaggtttctctgaaaggcagtaggcccaaggacctcattgccccagaagcacccacaacatccggagtgaagagtacttggttgagaaaggtcaaaaggtgattaacggaagagatcggaaaagatgtttggttactgggaaaagaagtaggtcgaaaggtgattggtaaaggataatgagaaacatgatttgtgtcactcgaggaagactcccaatagcaatcgaccctacaacagtcaccatgtcattaaggcagatgaattcgtgagtaagcaagatgaccacaggtagaagtacttccatgaggacaaggatggaaacctttgtgacatgaccaagaagtcaagaagttaacctgaacagttggaatctaaagctcggttcaaccttcggctctgtattagatgctacctagaataaaagcacatgcactagtatcgttcaacacaatttcctagcaatcgatccattgggaaagaacacatcaaggttgaaggtgtgaaagaatacgttgaatgctaaatgatgacaacatgaagagaatagtggaaagtaaaccgaatgtaaagaaagtggatccgagtttcttgttcatgagagccattcccagttatgaaccaagtgatatgttcaaggataatctacagaggtcagattaaaatcacatccaataaaaaagcttcagacttggcaggataacgatcagacaataacaagtctagcagtaaagtcatttgggaagacgtcaaagcatgtcaagtgggataagttggttctcttgggaagcataattcaaagttagagtgatcgacccttgcagtgaatagcagaagtatctagcacccagagaccagaaaagctaatatgagacagttagtggcaagttgtcaatcatggtatccttggtaagcgggatatgatagtctaaagcatttggtggtaagctggaaggaaacgccaagcatggtattctcatgatgacaagcatggtatcctagtaatgacaagttggtatcgacgcacaacgtgaaattggtaacttgtatgagattgacaccaagggtatgaattatgagaagtcctcgaactgaaaccccgtcttcaagtaccgcaccccagtcgaagtcagctcaaggtgcaaccaaggataagtcaggtgaaaagaagattccatctgcaacaggagatcaagccaagcagttcagagtggggaagttttgctgggcaagtttgttaaagaagacgcaacggaagaagtcagaccagaagagaagaccgcccaacctatcttcttgctagtcttctcgaatctcgggggcgagattcctgtaaggggggtggatttgtcacgcccgtgataaattcatcctgaaataaaattcattttctaaaaggaataatagaattaattaaaattcaaatagaatttggcaaacgttaaaatgcgtacaagaaaaattcgaatgtggcctagagaattttttttaaattctccttggtctaaaaggagccctcaaatttaacttgaattttcagaacaccgggaataattattaagcaacaaaaacaattatcaaaatttattaaaaagaaaaactaaaaattaatcctccttttccctttgggccaagtctggcccaaagttttcctctctccctcggcccgcggctgaagtctctcttccgtccctctctttttcctttcttctctgtcgaaacataaattcggcaataataaaagagggtagcgcacgagacctaaaagtggatggatgcggagacaaggatttagacaggttcaggccctcccaatgagaggtaataccctactcctgtttggggatttgaatccgccgagtgtagtatagatctgacgatctagttgtctcatatgccccctagagggcctcctgcccaccttatataggatgaggggcaggattacaagatagaaaccttaatcaatacggtatcggtttcctaaatctactttacaatattatcaaaccaggactttgggccattccgtaagatacaaggaaacgtaacacccaagtcatgatctgttacatgttccatatatataagttatcccctataactagtaggataaccatgccgtgtgggtatggggtacccataatctccacagtagcccctgagaccttcacagtcgaaaagataatcttctctcgaactagattactccaaagccgagtgcttcaatcatctttgccatgatctcccgagtacttttaccaaatctgaagactgtggagggctgaaaaataaagtcaggtgcatcgactagatgcacctaataggtgtagcccccgattatgtggttaactgaacaaaccaagtatatagtcaaggaataaataatccaaccaaccaagtggttcaataattatggtcaaccaagcgacttgatattaatatgtagcatatgcggtgtgaatccctgaataacatgatccgagtgatataccgactactttgtaaaatatgatgagtgtaatctaaggttggccacatcattgaaaattcacatagcaaaacagctataaagaagcttgtatgttgtgaataaagaaatttccaaagtattgggcatacgccatgcgcacactgctttaacagatgtgcttaagtccctaaaagacacatggtttcaccacacctggaaatatatggcatatgtggtgtaaaatccgagtaaataaactcataaaggatttaccaaccgcctggaaaatgaccaaaatatataatgagcctaagccataatattggtcaataaaagtgcacacttacgtggcaaaaagcaatgatattgtatccaatcaattgctttatgaatccaaacagcgccttgacttatataaaaaagtcagcgggcagctatataaagcattactgtttggcaccttttaaaatgcattgtaccaactcctaaaaagttgagtaactgcggtataaaaggattttaaggtattgagcacttgatcacgcgcactttggcctaagcaaaaagaacgtgaca

SEQ ID NO: 39877 - DNA, 1126 bp, Oryza sativa
tgtatttggccacctttccggccagagccaactcggcctgctgtttgttgccccagaggaggacaacatggagacgatcgtcgcgcacgatgcgcttgtaatcacgtggaactcgtcgccagacaccgcagatcttgcccgtggcattctgatagacactgagagtgcccgccaagggggtctccagttgatgctcctccaggattacacccgcatcatcaacgaattgaatggcacgcggacgaccgattcgcgatgaggtgtacaaggaatagtatagattcttcttgtggaacaagaaacgggcgggggccaccacattctgcggattgtagggggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactcaagggttctgaattcatgggta

SEQ ID NO: 39878 - DNA, 818 bp, Oryza sativa
tatgattttgataacactatgtttgcacaagcattagaatttataaccaaaatggtccgaacttaagaccatgtgttgggtcaaggagcacagccaaatttacatggcagaatgtagtgtaagaaattacgatcttcatatttcacagagcatgcgaggtgacaatccatgatgaaatctaagcgtatctatgaatgtttccaagttatagattgcacagttttctaaagtctttatctgtaacaaataagtacttcagttcatgtcaattgataccaaacaaaattgtagtaactaactagtttaagtatttatttaagttcaggtgtatatttaatggaaatggaaagacattggaagatcttgttttagctgcagagagcggagtgtttgtaaacatagacagtgaatttgatttggagaatattgtcactgctgcgagagttgctgggaagaaagtccctgttttgctcaggataaacccagatgtggatccacaggtaaagtttttcctcccacctcaggatacagtgggggatttagttatattggtatgctattgtgttattgtcatataatactagaaatcagattatatagttttgggtacccttgtgttttccattttttcttgaaaaaagttgtgtactacataggtgattattgatcttagttgtgcgcggtatcaaacatgtactactccctccgtcctaaaatatagcaacctagtacttgattagacactagggcatttcttttgcattaattaattgaatggataatgtaggcaaattttgctactggacatcgtgacttga

SEQ ID NO: 39879 - DNA, 14704 bp, Oryza sativa
aggaatattctcagtaggtgcatctgactcctcatcatcgctgctctcctcggagtgagaggactcctcattgaagaaacgagaagtgccagagggaccctcaccactagcaatgtctcaagcagtctcataagcagcaaaaggatcaacaaactcctcatcatcagaaatgtcagagtcatccttgcctgctgcaatccaatcttccttctgacgcctctctatcttgtttaccttcttagctatcttggcacacatacaaaagatagccctgagagccttctttatgggagaagaagactcagaacgctgtggtgcagcagaggaagaaggagcagctgaggtggaagcacgagtgactctggcagtagaagtagttgaagtagtgggagcatgaggacaaaaaggcttgtgttgattgtccttgaaataacaaatcccagtcttggcctcaatcatcttcatgatatatggagcatagatgcaacccctctttggctcacacactgtctcgtagatctcactccagataagcttcatgatgctgaaatctggcttgttgtagcgcatgcgactgaggaggagcgcatgcctacctgaaagagctgtagcatctcccactttggggagcaaagaccacctgaagatcgagtacaacactctatagtatggacgcaaccctcgagtagtccccaaacaatccttgggagcatccttctcatacataaaggtagtgttggtcggtgacagagcatcctctacaatgatatgtgggcgactcaggtcatcatcatctaaccccaaagctgcagcaaactgtgccatagagacactatactgctgcccctgaatggtccacttcacaaaatcaagccccttcttggtggtgccaaagaaagcagtggagtagaactgaccagtcacttcctcattccaggaatactgcaaggctaacaaatctgccacgtgcttgcgctcacacaccttgcgcacctcattgaaaactaagttgttctttgaggacatgtactgccagtctagccacttcatctctaccactggatgagatcttcccatgatcacagaattataccaatcaacctgcaccaaggtcctgaatctgtcatcctgagagttagcaggcaaagtatcaggactcatcattgtcctttccacacttgagcagatttttcagatagttcactcttgggcgtctaggatcaggatcaacaacccttgtcttgtaaagtctcaagggattgctttcagaaccaggctcatcctcattgccaccattatctgactctgatgcagctggagagggagagcggggagcatcacgaatgacaatgctaccatccctcctgaaatggatcggaatctgactcccactgtaaaaatctccaacgttttctttgcccaatctccccctaggaccatgaactggggggctcgagtcagcaggaacatcttgtgaaagcttctgtctcttctcacgaggcataatgaccactgcaacaagaatcaacaaggttggagtgcaatggttaaaagaaacagtagcagaatcaaggttactggctggctagacagagaccggaagttccgggccaagaacactggaacttccggcctacaaaactgaagaacagaggatttaaccaggccagtgcatgtgacaaaatcctatagatcggcaatctacaaggtagcaggaacaattctatccaaaaggttttctccctaggttcacatatttagagatcggggcaaaaacatgatgaaccaaaagagaagatcaaaagtgctacctagagaggagaaatcgcaaatcgatcgcgggatgaacctcctagccaccaatgtagttgattccacggagaggaatcaaatttccacggtttgaatagaaaatcgccgagaggagcactgtagcggcggctagggtttgggaatcagggaggagaagaagtgaggagagagagaacaggctcgggctcccccgggtatttatacccccgacccccggaagttctggactgggatgaccggaacttccggcctgacagaacagagggcagtcaggcccaagttcaaaggaatagatgagaattcaatgatttagaaataaaaacctatgaatatatagagacttatgatgcatatgaccagccaacaatcaacattacataagaatggtcaatatacatcacaagaagggataaaaaccaaattttctcaataaaaacacacacaaaaaattttgcaaaatttcacaaaagggtttttggataatagagggaatgtttgagctttattcctagtatcaagaccatcttctacacaagaagtgatctcaagacacaaaagctcttttttttttaatttacattttagtgacacatgtttggctatgaattagccaaccacccatcagctaatgttacgagagtctaagatattgagctcacccctaagctcgcaaaatcttttctcatctaaaggcttggtgaaaatgtcggctaattgggtcttggttctcacatggtaagacatatgtctcatttagtctcgtgatctctcaaaaagtggtggcgaatatctatgtgcttgtttcttgagcgttgggcgggattattggctattttgatggcactctcattgtcacataggagtgggatcttggtaaagttgtagccaaagtattttagggtttgtttcatccaaaggagttgggcacaacaagaatcggcggcgatatatttggcttcggcggtggataaagcaatggaattttgcttcttggagaaccaagaaacaagggaccgcccaagaaattgacaagtcccgattgtactttttctatgaaccttacacccggcataatccgaatcggaatagcccaaaagctcaaagtcacaacccttaggataccacaagcaagattaggagtgtgaactaaatatcttagaattctcttgacggcaatcaaatggcactctttaggctccgcttgaaaacgggcacacatacacacactaagcatgatgtcgggatgtcacgtcctgataaattcatcccgaaataaaaatcattttctaaaaggaataatagaattaattaaaatttgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgagtttataaaaagaaaaaccctaaaaagtcttttccccccccttcccctcttgggccggctcggcccacctccctccctctctctcctctcccccgcggcccaatcggcctcctccccgcgcgcgtgccgctgacgggcgggcccgcccgccaccctcgctgacgggtggggcccacccgtcatcccctacctcgcgccgcgcccgccgcctcgcccgtgccctagcgccgccgccgccgcggattccgccgcatcccgccgcccccgcgcgcaataaagagggggaaatcactccccgtgattccctccctctttcccccccacttttccctatctctctctctctctcggattcgtttggaaatcctcccgcaaacttcgccggcgtcattgatggagccgagatcgcccgcgccggcctctccttcctcctcgtcgacgtctcctccggcagccccttccgccgcgcccgtgcatcagccggcgctgccgtcccctccctcggcgtcgccgcatcgccctccaccccggctgctcctcggtttcgccggaacgccgtcgcagcgccggcctctccatcctcttcgtcgccagcgtcctttcggccgccccttcctcctccccggctcgtcggcttgctgcacctctaccatcttcggcatcgcagccgcgacgtcgtcctcggcctcgcctcccctccgaccgaacaccgccggtgtccgtcgtcgtcttcaccgttcatcctcgccggctcgccgtctcgcggcgccgcctccgtcgtcggcatcgcagcggtgtgttccacgccatcctcgcctccgtgcagccgctgccggctgccctcgtcgtctcctcgctggccccggtcgtcgtcgtcgtcgtcctctcgtcgttcccggtcgttgtggcgttcgtccctccgtcaagccgttctcgtctgccgcccgcgtttcgtcaagtgtgcagcagccccgtcgtcgtcttcgtcctcgcctccgcgtcgtcaagcctcgtgccggccgtgtctcgccttcgtcccaggatcgctgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacccgtggaccgtctctgtgtacctggtctaccgcggtcctttaggttgacatgtcgggtccgcatgtcaacagcgcagccttcctgtcttttccaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagtcttcgtcgttccggaggttcccgaagcgtggttttcggtcgtcgccgaaggttcggaaggccgttctctctgagcaaggcaagtcacatcatccttgaacatattgaatcccagtttataaaattattttgatttaaattattgcattatcgctttatttaaattcccgcgttatcactgttttatttagccatgcctatttacctttgttatgaccttattattattgctattgttattattaccttgttcaccctaggaaaacaataccccaactagtgggtactctattcatggttccactagtatgaatttaggtagatgcttcgctgattaaataggacaacattaggtggtttttataactttagactttgggaattctcatatcatttggacactatggaatggttggcttatggtggaattggacatacacctctcttcctctttcaaaacccctaaaacctgttttccggtggggtttgggtgcatgccagttgtgggaagtagcaccccggccactataagaattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcacgtcttccgtccgtataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaataactaaaatgtggaatggttggcctgggttggcttgggacgagctgggacccagggttgggttgccagttcggtctggatcatcgtaggccttgggttaaggcaggttcgtgagggttcacggccttgattaataatactgtgtagctctaggatcgtctttataaaatggctttgggcaactaagtgacttttaaatgctgttttctgcataacttaacccctatatcattaccccttgtacccccttgcattagtcgtgcatctgccggtgtggcttgctgagtactgtggttgtactcattcttgctctatctttctccccccttcagtaagagatgctttggagaagaagtcttaggtggagtcttggcttataccccagttgagcgcctgtgaagatggagccgtaggcccgctagtccgctgctttttatttttgattgtcaggccttaagtgcctttgtaataatgtaaatattatcgatataataaagatgtgtcttttatatcatgtttgtatggtgtaccctggcttttcctgggacggggattaatacactagcgttcgggaaaatgcaattttctcggtcgcgacaagctggtatcagagccatctcgactgtaggataagccaagtggataaaacctaaggacatattttataaataaaactatttgcgaaagttcctctttttcttcttcccctaatgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacatatcaacaagaagagttagttcctttaaggtcttgtccctagttctggtccattctttccttgtctgcttcccctctcaacctctaccttgtgacagatggataacactggtaacaaaggctatgggaatgatggatccgatgactcaagaacccaagccagtgggaatgagaaaagcatcaacaaaacctcaccagagctaatccaaattgtggttaaccaaaccaacatgttggcaacagcctttcaactattacagaattggaacaacccagcagggacaaccaacgttcaagtacctacagtccagcaacagtgcaagttatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcctcagctggttggaccggcttcagagtggtgggatagctacgaagcatcacggccagaaggacataccatcacctggaacgagttttcatctgtattcaggagatcacatgttcccgcaggaatgatcacattaagaaaatgagagtttcgctatctgaagcaaggagatttgaccgtcacaaagtacctgcacgagttctatcgtttggctcactatgcaccagaagatgtggaaacagatgaagacaaacaagagaagtttctccaggggttaaaagatgagcttgcagtgcaactccttctagaggattactaagattttgagaaacttgtggacaaagccatgcaactcgaaagtgagcataatcggatgacgaactgcaagaggaggattgtcaacatcccagtatttccatgtggtaaccaaagacagcgcactgagccacttcagatcaccggatcttctgttgtgcatcaagagttcctgccccaagaagatggacgcaatgcagacaacaacactagcaatactaatgatgatgataccaccaacaaccatggttcttgcctcattagcgaccactcgaataaagcgtgcaatgtcagtagcattcaccaagatgtcaacgatagtatcaatgttggaatccagaatgacaaccttagcaattttgacactgagaaagactccaatggtgatagcaactatggtaccactgatgccaatgttagcaaggatttccaaccaccaattccaactccaagtcaaaatgatcgtccccagatggacagctcaacaaagaagacgttgatttgttacaactgcaaagaaccaggtcatttctctagagattgtccacagccgaagcgtaacctacgccatcactccggccattatgcaagaagaagacaagtcactcgccttgtggtcactggagcaaacgccatacctgtgaggcctcgagttaatcataacccatagtagaaacaatgtaccgatgttaagcatcttccctttttgtttaaggtagtgccttgtattcatgtaataagggagaaatgtgtaatacagacaagttctattaggattcttttggaagatgcggatatgtgattatgtgtataattgcttactgataaaggagacctagggtctcatttcagaggaatcatatactaatctcgagttaataaccaacctgttgatggcgaagaaaatcaagtgatcaaccaaagagacatttgtttggactaagagtttcagatgtgtcttcttcggatcaaaggcaacaatcgtcagtctagcttttgacgaactacttcaaggtttctctgaaaggcagcaagccaaaggacctcatcgtccccagaagcgtccgcaatccacattaaagaataccacctgttagagataagccgaaagaagattgataaaagagattggcaaagatgttctctagcatgaaagaagtaggccgaaaggtgattgataaacagaaacatgctctgcatcgctcaaggaagacccctgattgtaattgccccgcaacagtcaccttgtcattaagtaagcaagatgacctgggtaaaagtgtttctatgaaggcaaagagtgaaatcttcaactcggtatcagatgctacacggagtgaaaagtgcaagcaccggttaccaggcaatgccatgtcttgggagatgatccaatgggaaagaacacatcaaggttaaaggtataaaggaatacgttgaatgctaactgaggacaacctgaagataataatgggaagtaaactgaatgtaaagaaagtgaatccgagttgcttgttcgtgagagctattcccagttatgaatcaagtgatatgttcgaagataatctatagaggtcagattaaaagcacatctaacaacgaagcctcagatttggcaggataatgattagacaataacaaatccagcaataaagccatttgggaagacgtcaaagtatgtcaagtgggataagttggttctcttgggaagcataattcaaaggcaaagttatcgacccttgcatcaaatagcagaagtagctattacccggagaccgggaaagctaatatgaggcagttggtggcaagttagaagtgaatgacaagcacgatattcttatgatgacaaatatggtatcctagtaatgacaagctagtgttgacgcatgacatgaagtggtaacttgtatgaggttgactccgaaggtatgaatcatgagaagttctggagcggaagcatcattaaactaccgcaacctagtctgagtcagctaaaaggtgcgccctggttcaagtcaggtgaagagaagattccatccgcaacaggaggtcgagccaagcagtccagagtggagaagttttgctaggcaagttcgttatagaagacgcgacggaagaagtcaaacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgagtttataaaaagaaaaaccctaaaaagtcttttccccccttcccctcttgggccggctcggcccacctccctccctctctctcctctcccccgcggcccaatcggcctcctccccgcgcgcgtgccgctgacgggcgggcccgcccgccaccctcgctgacgggtagggcccacccgtcatcccctacctcgcgccgcgcccgccgcctcgcccgtgccctagcgctgccgccgccgcggattccgccgcatcccgccgcccccgcgcgcaataaagagggggaaattgtcacgcccagaaattcactagtaatttccgaacttatttgtgcataaaatcctcgtccaggaatcagccgaggtacacaaactgacaatttaatatacagaatcatcaataatagtgttacatactttcaaaagaaaagaaaactgcagcggaattacggtctagcgaaggtccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagaggagtaaaacagtggagtaattaatcagaaattttaatcaacactgaacagcacacccatgctgcacaggcccaaccatcctgaacaaccatacccggctgtacagatctaactccaaaccaggagctaagcaaattattaccagatataacatccataattattgtgagaggtgtgagactaatcacgaaaaacattgctcaacccgcccataaccgcgggcacggctattcgaatagttttactctggccagaggtgtaccactgtacccacaagacacagcctcctcatcatgtctaccatgcgtcgcgatactggaaagtacccgaatagaggctgtgacaataccctttgcacaacacaactcaccacagtgcaccattcctggatcataatcaccccctctataaatataaccagaggcatggactccccagcgacccccacggacttctcgccgcttctcagtctggtgccccgcaatgaatcatgctatacagaaggtaaagccgttgcccatgctggcttgtggttggtacggttaatgtttcacaacagtagctcgtgaaccggtccttaattgtcatgagcacgaccttcaaaaccatgtgctcacaacccaccattgtcaagttttagttatcaattaattatcataacacgattaaccatcgtgagctacgattaaaccatcattaaacaatgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaattggccataacaaaggaataggttcacaccacccggtgacattcgaaaataaatgcacagttgaaataaatagagaatttaaatataggatcaacatgctcaaaggattgtgtttagggtctgtgtgacttgccttgcaataatcggtcttcaattaatcttattgaatacttccggcgcactcacgaaccttcgcaacgacggaaacgacaaactaacacgcaaaacgaagaaaaagactaataaaaaccaaataaacagtacatataaagtaaacaaacatgtagatcctgattttagatgaatttagcaacttgaaccactcaaaaccgagttacgatgatttagttatgaatttccgaagatttaatctattagaaaaacaggaaaaagaaaaaaaacgatgatgacgtcatgatgatgacctcatcaatggccgaaccaagatggcgacctcgccggagattggatggtcggctgcgactttggaggacaagaacacgtagaggacgacgagacgaacccaacggtacccaccctcgaaccaaacgacgaacgacgacggccggcgacgaggtctagcggcggcgcggcttcggtcgacggcggcgacggggctgcggtggtgggcggcttcggggagatagcggccgggcttctccaccctcccgcgcacctaacggtggtaacggcgaccggcggcgacgacggaggcggcggcgcgacgcggatggagctcggccggcgacgacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttgggggtaaagatagaggaggataagaggaatatttcccctcaactaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttaaattgttaaaaatacttcctatgctcaaataattccaagaaaaatcttgaacatacttggacacccaaagtatttaacaatattaaaaaaagaccatttaatgattaatttaatatgtgggtaattactgaaatgctctttgtatgattaaaaattaagaattgagctccgaaacatctgagaaaatttcagagagtgtaattaatcatggagaatttaatcaaaattaaatccatccatgctttatatttaggaaattttatttcccacatttaacttcacttgtaaattaatgaacatttaatataaattctaataataatttattaaataatttataaatcctgaaacaaaaatcaggatgtgacagaaatcactccccgtgattccctccctctttcccccccacttttccctctcgctctctctctcggattcgtttggaaatcctcccgcaaacttcgccggcgtcattgatggagccgagatcgcccgcgccggcctctccttcctcctcgtcgacgtctcctccggcagccccttccaccgcgcccgtgcatcagccggcgctgccgtcccctccctcggcgtcgccgcatcgccctccaccccggctgctcctcggtttcgccggaacgccgtcgcagcgccggcctctccatcctcttcatcgccagtgtcctttcggccgccccttccacctccccggctcgtcggcttgctgcacctctaccatcttcggcatcgcagccgcgacgtcgtcctcggcctcgcctcccctccgaccgaacaccgccggtgtccgtcgtcgtcttcaccgttcatcctcgccggctcgccgtctcgcggcgccgcctccgtcgtcggcatcgcagcggtgtgttccacgccatcctcgcctccgtgcagccgctgccggctgccctcgtcgtctcctcgccggccccggtcgtcgtcgtcgtcgtcctctcgtcgttcccggtcgttgtggcgttcgtccctccgtcaagccgttctcgtccgccgcccgcgtttcgtcaagtgtgcagcagccccgtcgtcgtcttcgtcctcgcctccgcgtcgtcaagcctcgtgccggccctgtctcgccttcgtcccaggatcgccgccgaagtcattccctcgccgtccgccacgcctgttcgtcgttgttgttcccacgcctcgtcgcgtggtggtaaggatccgtcctctcgctgccctgtcctcgtccttttggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtcttgtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttccaggctagcgcttcgacatg

SEQ ID NO: 39880 - DNA, 5179 bp, Oryza sativa
cttgattaataatactgtgtagctctaggatcgtctttataaaatggctttgggcaactaagtgacttttaaatgctgttttctgcataacttaacccctatatcattaccccttgtacccccttgcattagtcgtgcatctgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacacgggacgagatgcacataagtaaagcaaagatcctatcatggagcgatataccttttggtccacacatttaccattatcgttgtggtctaggtggccattagtaggcatgggcgtcttgataggtttggcatcctccatcccaaacttcttgagtatgtctttcacatacttggtttgagagatgaaggtgccctcttgtgcttgcttcacttgtagcccgaggaagaaggtcaactcgcccatcatagacatctcgaaccttttagtcatgatactactaaattcttcacaaaaagaggcattagtagaaccaaatattatgtcatcgacttaaatttggcatatgaataaatcactcttatattttttagtgaagagagtagtgtccgcctttccaattttaaaaccattcttcaaaagaaaatctcggagacattcataccaagctctaggggcttgattaagcccgtagagcgccttgtggagcttgtacaaatggtttggcaactttggatcctcgaaccccggtggttgctccacatagaccaactcagagataggtccattgagaaaggcactcttgacatccatttggaataacctgaaatcatggtgagcggcataggctaaaagaattctaattggctcaaggcgagcgacaggtgcgaaggtttcaccaacatcgtggccctcgacttgggtgaacccttgcgcaactaaccgggctttgttccttacaaccacctcatgttcatctttcttgttgcgaatgatccacttggtgccgatgacattttgcttgggtctctccaccaaagtccatacttggttgcgagtgaagttatttaactccccttgcatggccatcacccaatccggatcaccaagcgcatcttccaccctggttggttccaaagaagagacaaacgagaagtgttgacaaaaacttgggacacgagagcgagtagttaccccttttcttatgtcaccaagtatgttgtcgacgggatgatctctttggacagtgtgatgtatccttggatggtgcactgggggacctgagcctgatcagtatgctctaaagtgcccgcagcatcgatcccatccacttgtgccgttggcacgttttcactgccactggtccggaggttccagactgtagaacccggaacttccggaggttctgatcaataggacccggaactttcagctcagcaaagacagcacttgtagggctattggatgtcgatgacggaggttgatccctatcttgttggtcatcctgcgtctcgactggtcgtatgtctccaatagccttagtgcctatagctttacttggatccacatcacctacaacatgtacaacaacttacgctccttgggagccattagattcatcaaatgtcacatccctagtgacttcaacaataccggaggttttgttgaagacacgataggcatgtgcatttgattcatagccaagtaagaatccctcatccaccttaggtgagaacttagatgagcgaggcctcttacttaaaataaaacatttgctcccaatgacacgaaaatatgaaacattaggcttcttaccactcaagagctcatatgaagttttttttaggatcttgtggaggtacaagcggttgatggcatgacatgtggtacttacggcctccgcccaaaagacatccgaagtcttgtactcatcaagcattgcccttgcggcttcaataagggttcggttcttcctctcaacaatgccgttttggggaggatcatagggggcggagaactcgtgcttgattccttcttcatcaagaaattcctccacttgagtgttcttgaattctcctccattgtcacttcgcaccctcttgatagtgagatcatagaggttttgggcttgctttgcgaagcgcttgaagacatcttgagcttctcttttgtcatggagaaagtacacccaagtgaagcgtgaaaaatcatcaacaatgacgaaaccatacttgttacctccaatgcttatgtaggccacgggcccaaataaatccacatgaagaagctcgagtggtcttgttgtagtcatgatgttttttataggatgtggactgccaacttgcttcccggcttggcaagcactacacacacgatcgagacccattacctttcctttaccatcatgtccaaagacaatattttcacgacttccaccctcctcattaagacttgtaaacatactcctctctcccatcatatgattggtgcagccactgtccacaacccaacttgagccactggaggagtatgcctacaaaagaaatcaagcttgggatttaggaacccaaacttgtctaagtttgggtcccttgatgttagtcaccaaagcctttggcacccacacacaagtacggtactcatcattgtaattcccattgaaataagcaaccactttgccctctgaatttttgaaaattacatatgaatcatagtaaagaccctctagccagaacttcctgccattatacccggaacttccggttagtccgttcggcctatcagaagcccggaacttcctgacaaaatgtccggaacttcctgtcttacagggcaggaacttccggtcattttgctcggaacttccgggtgtctgaccagtgaggggacaagtcacctcacttgcttgtggagcttttccttctctcacaaacatcaagcattctttcccatttaccatcacacgcttagacacatgacttccaccagaaaacccgagcccatgtccatccttgttaggatgagcggtgatggtcttgtaaagggcatcttttgaatgatatgtcttcacgcatccatatttcaccaatgtgcccaattgtcacgaccggaaataacccaacgggcgttccttacgtgcgtgcattatttcttgtcccaggaggcaaggtacaccaaaagttgatacaattcagagtttaacaagcggaagcgtaattaattaatttattacatgggcggcgaagacccagcacacaagaagacaaacgaaaaacagcggaagactagggcgatgaccacaggcgcttgacggcaggcacgagctagacaccaaagccttcatcttccaggggctcctcttctgggtttgggcaaaattgagcaagactgagtacaaccaccgtacccaacaagacacacccacaagtgcagaataaatgcaagggagtacaagggggttaaaatataaagggttagggtttgcagtaaacagcattaaaagacacttagttgctcaaagctattttgtatacacgattctagagctaaacaatattattaatcaaggccatgaacccacacgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcacggctattcaaatagattatactctgatcagaggtgtacatctttacccacaagacatatcttcctcagatgtaaccacgtgccacataccaccacggtatacggacggaagacgtgacatagtttccaacccatcctagccatagacaagagtaccgacccaaccccacctacggccggaacccccaggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgagatgctactatcaaaaccatgcaccccgagcccagcctaaaaccattttgagggttttgcatagagggggaggtgtgaatccaattccacaataatccatccattccatggtgtccaggtgatgagaatattcccaaagtctagagttgtaaaaccacccaatgttacctaattaaccagcgaagcatctacctaaaatcatactagtggtaccatgagtagagtgtccactagttggggttttgtttaatctagggtgaacaaggtaataatatcaataacaataataataaggtcataacaaaggtaaataggcatggctaaataaaacagtgataacgcgggaatttaagtaaagcgataatgcaataatttaaatcaaaataattttataaactaggattcaatgtgcttaaggatgatgtgacttgccttggtcactttcccaaacgtcggcttcaacctccacgaagagcggatcttccgaagctgcagcgtctacacgaccaacggtaaagaaaaggcttttactctaataaactctatataaccagcaggaacaaagcacaaaaatgggttcttgacttcttaaggaaaaattagagacttgaacggtccaatttcgagttcaaatggccaagttatggccatttgaagtttatatgctctttaaatgaatatttgcgactttcttcatttaaattttaatttaaaaagggttt

SEQ ID NO: 39881 - DNA, 10159 bp, Oryza sativa
gggggggagagatgggccgggccggcccaagagagggaagggggactttttagggttttttgttttttataaaacctttttaactttgtttatttcttaacacttattatttgagctctgaaaattccactaaaatttatttacgtattttaggcttttaggaaatatacaaaaatcctctaagtattatttgacttttaactttgcacattttaattgttggaggctttcacacggattttaattattctaggcataatttagaggatatattttagggtcgttttgggacgtgacaccaatctttcattctctttcttaagagcttgcatagcatcaacattagtagcataagagttcaaatcaatattgtaacacctagcacaaccattgctagtagatgggttggaagaattagaaaccacatttggttgagaagtgctattccaaagagtgtcaaattgaacttcaagatctttatgacttttgtctaaactagcaaatttctcttgaagagtttcattgacatccctacggctagctagagaaccattagccaaattaagctcattagctagttgttcatttttagcacattctttagctaggctctcctctaaggcaaggtttcttttcttctcaagaataagtaattcttcttgcctttcgagagattgttctttactatccaaagctctcattaacatagccaaatgttgcatagcgggtttgctaaagctcttaagcacatcatctaattcattatcactttccgcatcactagaatcaacatcaagagagatgtgagaggacttttgagtcatcaccttgcggccttgggccatgaaacaagagtagtggtaggagtcgtcgtcgtcatcactccagttgttgaagagacgctccttgattgaagaggatgacttgaaggcgacagtagcaacaccaccttctccttcaaccttgtcttgaggcttgggcttgggcttgacctcgagatcttcttcatctccggagtaccacacctccgccatgtgtgcctccgccacatgagcatgctccggcttcttcttgcctcccttagccttagcttcatttgacttgggacaatcggcaatgaagtggccatgttcaccacaattgaagcaagctctctttgattgcctctttcccttgtcatcatccttcctccctttgccatagccactcttgcgaagaaagtgcttgaatctcttgacaataaaagccatctcttcatcttcactttcttcacaacatgactcttcttcttgttttgccttcaaagcaacttcttgatttttgatcatggcggcattcttcaccatttgcctcacttcacgagcttcctcttcttgcatctcatgagacacaattcttccaagaatgtcacttggggtgagactcttcaattctttcctttcccgtatcattgatacaagagtaggatttcttggaccaaatgcacggagaagtctcttgaccacaaagtgatttgtcatgtcctcactcccaagtcctttaatcttgttgacaaggatcatcatcctatcatacatctcttgtggtgtctccatgtcatccatcacaaatcttccaagccttccttccaataattcaatcttggcctcacgaacggcgggtgatccctcatgagccaattgcaaagtatcccatatctccttggcctcctcaagcccatcaaccttgttgaactcctccagactcaaggcggagagaattgcattggaagcttgagcattgcggtggatgagttgttcttgctccgaagtgagctccatgttatcatggggtacatcaacatctgtacaaacaactttccaaatacttggatgcaaagagattagatgcaacttcatcttgtgcttccaagcggcattatgtgtcccatcaaattgaggagcatgcccagaaggcacggagacaaagttgtgagggggaatggtaagtttgctgtaatcaaaaggtatagtagctcccttgggtgatggagttcccttgctgctcgctccatcttcatttccattttccccgttctttccccctaagtccgacattgtggatcactcaaagcagtgaagcttgaatcaagagcaccttgctctaataccaattgaacgtgctgatgaagcctagaggggggtgaataggctgtccctgaaaacttaaaaacaaatcgcagcggtaaaattcaaacagacccggaacttcctggtaaggaactccagaacttctggcctgccaggcccggaactaccggtgttcttaggacaggaacttccgggttacagaacaaggatgaaattcaaatttcgaatcaggagactaagccaatcttcacaagatgatgcacaggtattctaagtaggagatagatcacagaaacatccacagaaacatcacagaaagagacaagagcatttttttcctgatgttcggatcttgcgatcctactctccgttgaggagctccaaagagctgggtctcgattaacccctttgcctgacttgtgcaaaaactccagaggaaatccacagccttcaactacaaacacccctaggcaagtttctagaattgagtgaccaccaagatccaactcaaactacttctagaaattcgccacaagtatacgttgctctacttggaaaacctctagaatctcagcacaagaacttaattaacttacctcgttcccttttggaggagaggagatccttcacaaacttacccgggacatccacaatatgcaacggattctcgcgggcgacacctaaccatctaggagatcatctccaagagtaataagcaccgagatgacagcccacaagatattccaagtgctcacccaagatcctagtcttcacacatctccaaatcttcttctcttcctctcaatctctctttctcataagaattaggctctagattgagtggagaaggcaagaaacacttgggagaggctagcaacagctctaggttcaaaaagtgaaagtggaatggccaatgaacaagctggaaacgagctgtatatgtgacgtcatctagccgttactcacaaatttgaactgaaaactagacaggaagttccggacctagaagacaggaacttccggataatacttaggaaaatttctttcatcatactggaacttccggacctggaaacaggaagttccggacttgcatttttggaccaatggagcatttgcaaaaatgactcctagggaaacttgacacttggttcacactaagagcacttgagatatctcagagcatcacctagaaccccacttaatagtacggtttttcctaaaaactcgattgcaaaaaataaactatcctatgcacttctcgagttccggtccgctttgattttatacttttggggggtctccaagcatccatcttccacaccttgaactaatgcacctaaaagatactcaatgaactcattagtcccttaaccacatttgtcattaatcaccaaaacccactagggggattaatgcactttcagttgtgctggaacatccaaaggtacaacgcggatactggcctctatcttgtcaactggtggctggggctgaaattgagcattgacaccttgtggtagtgcactcattggagtgggagctattgcatcttgggctatacgactgcttcaggacgcatggatgacaattcgctgaggagcaagcttctgattgaggggagttgcatggactgatgtgctggcaaatatgtttctcggtttcgggcacatgtcggcgaaatgacccacttcttgacaattgaagcaacatatatctttccagacttggcattttcttttcccattttgattcctctgtcttggcactggagttaggctgaaactgtagtcttgtcgaggatttgggttgccttgatgcttctctccattgtaactggcgggttggttggccatcttcttcgtcagcagaaaactgaattgacaatcttttggtacatgattagttccttcacacaagaaacaagtgatcctgctcgttggacactcgtcgggtggatggtcttcctcacaaggaacgcaagtggtgacacatgagctggcaaagtgaccgatttctccacaacgagagcatgccttatgttcctttttattctgattgaaaccttggagagacttctcatcttcatcccgtgaggagacttgatctgaatcttcgctatcagacactctacctccattagccaaaagatgttctgtcaactgtggtgcacctcggaagaaatttcttctctgacgttttgtcattcctggtggaggccattctgtgccggtaatggtcatcttacggacctcatcttcggttcgcattggtgcttttcttttctgctgaggacggttccttgcatagtgcccttgttcaacacagataaaacaaatgattcttgcttcttttgagtccacaagtggcatggcacgatgggcctgttgggatgctggcggagcgctgacttgtggtgtgagtgcttggactgcctccaactgcacttgaggttgcatctgactcgggttcagaattggcgtctgatgctgctgtagtatctctataagcaatttgttctggttaatcaggtgttggaccactgccatacaactggtgtctggtgcttcattcactcgggagcttgaggtacccacgtcctgatttctgaccatactgccttttttattgtcagccatctgttactaggtttggagagggagagagggaaaacaaaaggggagagacagattagaaactaaggataggaccttaacagatctattttttttctgttatgatgtatgttaggtttattctgcaagttgattaagcaaacaatctagcatggttacatcacaccccactgatgcaaaccacgcgctacacacacaagcaaggaaacacacgactaacgactctaccctagagggtggcttaggttctgcaacaggttctccaagatcttcacccctgcttcacagctggcttcattgcttccttcgcttcgctagcggatccaacagtcttctggagcttcggcaaacgattgacgatctcttcttcttcacaaagctgaccatctagtactagttgaaattcgaagaaggaagaaggaagtaaaccttttgcaaatagcattagggaaaggaggaaaaaggaactttcgcaaatagtttcatttataaaatatgtccttacgttttatccagttggcttatcctacagtcgagatatctctgataccagcttgtcgcgcccggaaaaataccttttccataacactagtgtattaatccccgtcccaggaaaagcacatcaggcctgacaaacatgatataaaagacacatctttattatatcgataatatttacattattacaaaggcacttcaggcctgacaaacaaaaataaatagcagcggactagtgggcctatggctccatcttcacaggcgctcaactagggtataagccagggctccacctaagacttcttctccaaagcttctcttactgaagggggggaaagatagagcaagaatgagtacaaccacagtactcagcaagtcacaccgggatatgcatgattaatgcaagggagtacaaagggtaataatataggggttaagttttgcagtaaacagcatttaagagtcacttagttgcccaaagctattttataaagacaatcctagagctacacagtattattaatcaaggccctgaacccacacgaacctggcttaacccaaggcctatgatgattcagaccaaactggcaacccgacctaggtcccagctcgtcccaagccaacctaggccaaccattccacattttagttgttaagcaagttttaagaattaaaccactaacttgggtacattgctaggcttgcccataaccgagggcgcggctattcgaatagattatactctgatcagaggtgtacatctttacccacaagacacatctttactctgcattccacggccgtggaacccgtggtaaaggatgtgacataacccctttacccatcctagccgtgacaaaagcaccgacccaacctcgcctacggccggaatcccgagacaggtaggtaagattgagcccctagcagcaggacaccggccctgtgccatgacatcttgaataccgagccgcagcccgtgtagccttcatttgccctagagatgtccatcgagccccgacttcgtccatctccatccgtgtactcttgcaaggactagactgagcaccgagttaagccttacccattagacatgtggttagtacggtagtgctttgcaacagaggcccgaagaccggtccttatagtggctgaggtgctactagcagaaccatgcacctcgagcccagcctaaaaccattttgggagttttgaatagagggggggaggtgtgtgttcaattccaccacaagccaaccattccacagtgtccaaatgatatgagaactcccaaagtctaaagttataaaaccacctagtgttgcctaattaatcagcgaagcatctacctaaattcatactagtggaaccgttaatagagtacccactagttggggttttgtttatcctagggtgaacaaggtaataataacaatagcaataataataaggtcataacaaaggtaaataggcatggctaaataaaacagtgataatgcgggaatttatgtaaagcggtaatgcaataatttaaatcaaaataattttataaactgggattcaatatgctaaagggtgatgcaacttgccttgctcagagagaacggccttccaaaccttcgacgacgaccgcgaaccacactttgggaacctccggaacgacagaagctacgcgaagcacacaagcaaagctacaagcctataaagaagcaataataaaacataaaaagaaagcacagggttctttaggttataacaaacattaggagacttgaacaggtcgattcggagctcgtatgaccaagatatggtcatccgaagtttaatgctgtcacgtggagatttacgaattattgtaattaggctttgcaactataaaacatgtgtaagcgctagcctggaaaagacaggaaggctgcgccgttgacatgcggaccccacatgtcaatctaagggaccacggtggaccgggtacacagagacggtccacgggtcgaaggaagcagaccccgtgtgtcaaccgaggcgagtggccgacaaacggactccaccagacaccacgcgggctgcacacgtggaaaccacgcggctaccgagcgggcacacaaacacggtcaccacacgcacccacgaacactactgacaccggtacacgggtaccggggttgacaaccgcacaacgggcacggggcaacaccgaaaggacgaggacggggcagcgagaggaggcaccgttaccaccacccgaaaaggcgcggcacgacgacgacgaacgggcgcggcggagacggctcggggacgacagaggcaaacgacttcggcggcgatccttggacgaaggcgagacgcggccggcacgaggcttgacgacgcggagccgaggacgaagacgacaatagggctgcagcggctcgcttgacgaaccacaggcggcgaacgcgatcggcttgacggagggacgaacgccacgacgaccgggtacgatgggaggatgacgaccggaaccggtgaggaggcgatgagggcagccggcagcagctgcacggatgcgaggacggcgcggaacacgtcgctgtgatgacgacgatggttgcggcgcagcaagacgacgagccgggcgaccgacgggacatcgacgacgaggacgaacggagacgacgacgatggactgcagaggggtttggatggaggggaggcgatgccgaggacgatgtcgccggctcgccgctgcgatgccggaggttgtggtggcgcggccgacagcgcacgggtgaaggaagggccgaccggggaaattccggcgaggcggatggagaggccggcgctgcacggcggtgttccggcgaaattctgtaacatacccaaattctagaccttaaaaatttcctatcaaaatagttggaagctaacttttccatttttgagagctaaaaatttccatttttaacctaggtgtggtcaatctaacttgaacctaagtaaaatttgagaacaaattaaaactttttcatttataacctaggacataaatgcaaacacgagtaaaagcatgcatacttgcataaaacatgttttgacttgagtccttcatgtgcatttgaatatttgatttgcatttcataataggtctgatgaatattaactaagatctagataaacaactaaaccattatggcctagtgctagctagaggaagttaaaatagaaaccatacaccttaaaatatatcaacatggctaatgtcaagcctcacaaaactaatttggacatccatctgaagacatgtcatgaacatgaaagtgaacaaataaattatatcatatagggtatattctatcttaatcatctctaagcattctcttaatttaatactaaagtaaacttatgcataaataagtaaggagcttatgacatgtgtaaggtaaactgtaattctatcatatcaatatcacctcaggttaatgagagtccaaatataacttttataaacatttacatgcatttaggaaagggaaacacatataagacataagtcttgcgaattatctaaaataattcgtgcaagataaaatcatgggaaaattcctgtaggctctactcaactcatacaactcactgtaattttggtataatttaataactaaatttggtacctcaaataaatcagtcaaactaataaaaactagattaaccgtagttcttaatcggctaaaaccatactttatctaaaagtgcatttaactgcataaaagtgtataagtaaaataatttattcaaatactaggtcatttatcatgaataaaaataatttttccagaatttatcttctctgtttaaattactaaagtgggagagagaaataatcctgaaaatcattcaaaacttttgttcacccacgtttctgcccaaccctctcaccctagcttagtttgccacgacctggacccacttggcagccactctggctcgtcctcaccttgtgcaaatcttccagccgaccagagacagccgagagagagagagagattggcgccggctgtgtacgacgcgtggccacaatgtgtcgacgccatcaaactcctattctagccttctcctcctcccagctgcatctccacacatcattctccacctctaagccgaagaaaccgagggaggaggctctcaacttctccgtcgccctcatccttgctgccggccgcgaagaagacgactatcgtacttgtaaataagccagggtaatccccatctctttcgcgttccatactcttctcaccatgccgatgatttatccttttaatttcatcctctatcgtgcagcggatcgacgggaacgccgtcgtgcccacggcactccggagcgcgctccaagcgccgccgcagccgacatcgtcgtcgttccgaccattgtagaccaaacaaagccgagccgtcgcgccaacgtcttctccttgaagtcttcctcaaaaaccctcaaaaatcctaggcaatggcgcagcaagtgcggagatcggctaccgtcttcttcacctccggtcgccgtcgccattgtcgattccgcctcctccggtgagccattgtccgattcttcgcgtatacaccatccctgggacctcactaaccccatgaaaacacatggatgtcaattcgatgagtggatcgagccgttgccgtctccccgggctctacaccgtcgccggaccatcttcttcaccgctgccgctgtccagactttcccgcgcctcgttcaaggttcggtgagcacacttgagcccataggattgcattcatgcatttcattcacttagaatcgagcaccaactcaacatgcagtagcagcctaagcacagccgccgctcggactcgccgccggcgttactccgatgtccactgaccgag

SEQ ID NO: 39882 - DNA, 2390 bp, Oryza sativa
cactatagaatactcaagcttgacaaaggagggatcacaagtaaacatggaacacgcgaggaaataggtagtcccataatcccatgtactcctaattagcaaaacgtgcaattttagttgcaaagagtaaaacatttgtaaattagcaaggagggctaccggtttgaggaagaactggggagtgaagctcattagctgcaaacttgagggggatcaatcaataaaacatcacgcaccaacagaaaagagaaggtgagaatttcccccatactaccaccacaaccacatcctctagtaaattaaacttaaaacaatccatcaccactgtgtagtttttccctagcaccttagttcagcttttaatagaaaagaaggagcggtagcaggctagcagcagataaaatggaggaggaaagaataggagcacttacctaggggatgattgctcggtgaagtcgagctccatggggcgctggtcatggcgtctgggtctagagctccatgcgtgaccctattctagccatgggggggtccacttcttggagctgtgggttggagagcatagagagaaggattaagaggggaggtcttgctggtagcctgggcattgaggtcgccgagagcaacatggtggtagcagcagcagtactagagtagtagagtgaggatttgagggaaaagatatccactgctaatggcaaatggaggaaggaagaaggggattagctagctgatgcttttacctgcaggagtgataagaggggagagacggggagaggtttctgcaggtgagagaatagagaagaaaggaaaatgtggactgattgctagatgtacattagtaggctacacagaacaccaacctgagcatagtgacccaattctgtagtccaagtatagtttgataaattatctagcacatcacaactggagtttcggtacaataaaaaggttacaaatttgtaagcacatttgtatttgtaaattattgtatttctattagtatagtttaattaaatctcgacgcatttgacggaatacaacaagggaactagaggcggagtctggtcagttgggagcgccagctatttttgatttgaactacgagaattcaggcaagcgaacctttgatcttgatgatttgaattattttgcataaaccttattttgcttcatgaaactgtcaccttgcataaaatagatttaccaaactataagtcggatatataaggatgatgatagatactgggaggggcagttgatggagaaactgatcaccttcggaccttccaacacttattagggtgtccacagatggggattgactggaaacgggaccctttacatatggctataatataaggactaaaatcactctcacatgcatatgtgtgctgtataaaaatcatgtcaaccatatccttgttgcaaggcgagcaacgctttgtatcttatcaagttcttacactccgcatggtgtgtaatgatagatagtgctaagatgggagaccctataaaccccatagaacattagtacttggatgggagatgatataaaccccatcaagatagtagcacgtggtggagtggagtgtaatgtgctgaaataagagaagagcatctagctatctattagtccattaaattttctataaacgcttctaaaccgccacgtggcgctcctacaaatgttcttatatcgccacgtggcaggtggacccaatattttataaatcattaaattatactaattttcaccactacatcttatctccaagaatgaaaatctgtacacgctccactttccgttcgcatatttatcacgtaatatatttgaaaagaaaaacagaacgtgcacatatatgtacatactctccctccctccctgtctgaccctcttcccttccgtctcttctcctaatttctacctctaacaaccatacattataaaaattaattatacattaaacttcctacaaacgcttttaaaccgccacgtagcgctcctacaaacgctcctatatcgccacgtggtaggtggacctaatattttataaaccattaaattatactaattttcaccattacatcttatctccaagaaagaaaatatgtacacgctccactttctgttcgcatattcatcacgtaatatatttgaaaagaaaaatagaacgtgcacatatatgtacgtactctccctccctccctgtctgaccctcttcccttccgtctcttctctctcctaatttctacctctaacaaccatacattataaaaattaattatatattaaacttcctacaaacgcttttaaaccgccacgtagcgctcctacaaacgctcctatatcgccacgtggtaggtggacctaatattttataaaccat

SEQ ID NO: 39883 - DNA, 33025 bp, Oryza sativa
tgttcgcatattcatcacgtaatatatttgaaaagaaaaatagaacgtgcacatatatgtacgtactctccctccctccctgtctgaccctcttcccttccgtctcttctctctcctaatttctacctctaacaaccatacattataaaaattaattatatattaaacttcctacaaacgcttttaaaccgccacgtagcgctcctacaaacgctcctatatcgccacgtggtaggtggacctaatattttataaaccattaaattatactaattttcaccattacatcttatctccaagaaagaaaatatgtacacgctccactttccgttcgcatattcatcacgtaatatatttgaaaagaaaaatagaacgtgcacatatatgtacgtactctccctccctccctctctgacctccacccttccgtctcttctctctcctattttctacctctaacaaccatacatagtataaaaattaattagttagctaaataatctattagtacatatgtttttatataaaaattataatatatatacccttaattttcggtgacaaacccagaaaaaaatattgggacatcacttggatatataccctttcttttcaatgtcaaaccaagaaaaatattattatgacactgcacatataaattatttaattattaattgatattattaattaatatggcatgaattagttaaaatcgaataatctaccttgaaggtgaatgtagttacgccactatatattttgtatagcaaccaaatagcaataagatattatagaaatgaacatatattttgacatctggaaccattcgacaaacatgaaccatgaataaattttcatataaaagaataatttatctagcggccacaaagaaacattaaagagtaaattgcatcgtcggtacacgaacttgtcaggtgggtgcaatatagtgcacaaacttgtaaaatgttcgttttggtgcatgaacttgcgtggtgcgtgcgggagaagtcaaaaaggacactatatgactaatcctattgatttaggggctgattaggatgctatgtaaacatatatatatatatatatatatatatgagaaggttgccactagacttacacctattcaataaaatatagaataggatttagtgatagtagaaaaagatttaaaatatcgagcactgatataagggttagaaacatataaaattcatcatttcaatgatgaaggataaagtagagactaaatttataaatattgcatgtcctatgcatacttgctacaggtatacacgtcgcatcctaatcaacgtcaacttcataaaattgacattgccaagttattttggtcctcattcgcacgaaccagacaagttcgtgtactgaaacgagcattttataagtttatatactaaattgcacccacctaacaagtttgtgtaccaccaatgcaatttactcaacattaaaataaatgaacatgtattatgtaatcttaaatcagtgattccacaaaatttcatagcgaaattagatcgacggtattaggataagaatttataaactcactggctaaaggagtaatttatctagggaccacactattacactttgcatataatccaaattaccgtacaaaattgtaaaacaatttaacaatatatgttgcttcatcatacattaattactttgtaagcacgcatagaaaaattggatatataatatgtaggtgaaaaagaactaacttaactttgactaacataacaattatgaaaaaaatattttacctttagtcagatgcaacaatatccaaataattatgtcttttgaaatatgcacaattgataagacaaattaaatcagttgatcctttacataagcgctctaaaatataatatatggtgccatttaatggacttacaggtccttttaacaaccagatgaatattgctttggcttccataccttctatatataaagataattttgtctattttatatgcgtaggctattgaaaatgtgaatactcctataataagtagtagtagagaagaagaagttatgtttgttattcgtacacatgcataaccaactttaaaatccatttagattttataacatacttattataaacacgctatactgacaactcagacaaaattgcagccatggaacacatataatgattaacttatttcgattttctatgtaccaagaaaaatcaaggtatatcaaatgttagcaaactatgatacgcatatatttatatgtattgtttcacatagggaatatcaataatctatgtaccatgataattttaagccactttgtcagttctacatattggcaataagaaaaaggtggtgtacgagatcgaaagtggataggtagaaagcaaaaggtttagacaagttcagaccctcttgacaaagaggtaatacccctactcctgtttcggcgattgaattcgtcgagtgttgtattgatctaacgatcttggctgtggttatgccttcaaaacaccccgtgtccttgtataggttggtgcaaggttagaagggtagaaacctaaccgaatccggcatcggtttccttatatattacataaccgtatatgagtaagacttatgagacttgccgtaggaaacaaggcaataataaatccccagtcctaattattacataattcctagactcgacccacctcctatcttcaatcgaatatccaagcgagtgggtatgtggtatccataatatccacacacttatccattatttttcattacactattacataaatgtttttttacatatgcggctaaaatgttaagccgcttgtattgatgccttagctgcctcaacctcagtggccacttttgcaaataacatttgtagtttacacgggtggagaaacctttattagttccggatggtaacccccttagtcccggttctcaaaccggaactaccaatccgggactaaagatcgctatcattagtcctgggtggaataaccgggactaaagatcgatctttagttaccggtaccaaccgagactaaagatcgatctacctttttttttatttgcatggccctgttgctgcatggtttatatatatatatatatgtgtgtgtgtgtgtgtgtgtgtgtgtacacatatgtatatatatatatacatgtatatatatacatgtatatataaatgtatgtatatatatatatatattacatatatacatgaataatatatatatgtatttatacatatttatatgtatgcaaatgcatatggatatgtgtacaaaatagacatatatgtatatattaaagcacttaacattttatgtgcatatatgaccaaaatatatatttacagtaaagtaaatgtgtacatatataaatatagacatgtattacaattcattatgtcctagctacgacttcgacgtagtcgttatctcagaagataacgtcttatgaattgtagatttgtcgtagtagaattcaccctcgggattaaggacttgttctttgatgaatcccatgagttgttcttgaaccgccgtgataaagtccttgtgtgtgaggttgtccctcatgtgaataacctatgaatgtatgaagttatattaattagtaaacaagaaatcgatacgtatgcaatgaaattttgaatggtttatttatacgtacatcgagctctcttgtggtgatgatttgagttgcaaagcagtggcaatactcacatacgtagtagccacacaagttagttccctcttcctgctttgcacactatatacatgacaaacgacgagagatttaatatacacttatatttgaattagagattcaatataaatttagatcatgtactcactggaaatttgaacctctggctaagtttttctttccaagtgccgcggaccaaatgacagaaccgataccaagccctacatggagtttaaagctacgatttgtactagcaatagcaaaattcataataataacactggaacatatgacattacctatctataagttcaaaaacctggtcaaaagtagactcatctttattcattgagtcatagacattaactctgcatgcctccaagtcgaagagtaaaaggacccagtggaatatgcaatttgtgttagatgatatatgaaacactgtacatgtatatgtacgggaatgaaatttgttcggtagacaataaaaactaacgctgtgttgtacggcagtagtatgaacgtcttgaaatgctgctccttgaggagatggacgagattttcctcagtggcctgtggatacttggtgaccatttcgacgtttacattccgagggtcgatgaatccagtatcgaaaaccccccgccgtcgggcccattgaatctccattttacaacaataaaggaattgttatttatggtgtacatatatacaaggagctaattaaaggaacgtaagaaatataactctcaacgatacgtacaaaatccatgcgctcagaagagagacgtcgacgacgtctagctggtatagttcgtagatatccttaaaattgatccagagaacatcttctccttgtaagaagtcggcgttcttgatcctcgctccgataatctccctaccgctggtgctcatctctatgtaccgttcatggaattggtacgtctgtgtcggtagggactgtagctgctcaggtgatgaggacacaactaagcttggatataaccatgactaccttatgtattaatcaaccaaaggtgcatatgctctacattagatttacttgttatatatttgaacaaacgttgcaacacaatgagtttcgtgtgtttttgtttgcagaggtacttgcttgggcgaaagaaaagagaccgagcgtaaggaatgcatggatgattgaagaagttgattggggaccaaaccaagaccttctccaagtccacttccatctcaccacatcacttttggtccatagaagataagagataaagttctacacgttttggattcggattcgggcctcctagcagcatcaacttcaaatggatctaggcgctgatctagaaggaatttcggggtccatgagtacttgttgaaaagcttatggagtctactttcagatggttttggtcctgcatcaaaattcctactgagctgccgggaatctgcaaaacaagccatgtatctcatccagtccgaatctgatttgggttttgggccttgtaattgtgtcgtgggcttagcccaagggggtgtgcgccctagtgcaaccctaggacgtccctaatcacatttattcagtagccgtcatcgtttagagttgggttttacttagattattctgttaagaacagtttcgtcgctagatcggtttgtggaaccccaaattcgagtgcttaatcattcatatgcaatttggttgcaatctatcttgttctttcttgtgttcttcgattcgcatgcagggattagccttctcggcgaggtcaaccgggtttcagcacggttgataaccagaggagacgtagtgctgcgattgcggggctcagtagcgtgttcgttcagaagccggatcgagttgtgtctcgactccgtccaaatcaattgtttatcaatacctatcggaagatcaggacctaacatccctcatcagtaggtatcagagcccggttgcccgttaggtaatttaaattcccataaccagaaaattgccacacaaaaatatttattctttacctagacaatttgaactgttgcattgttctattagattttgcttcgttgaattttagattgcatcgtcgtgtcgagtgctggtttagttttagatttaattttagttttgagtaatgcatctgttcatcactttggtccagggttcatcactcaagtgtgtgagttgtacgtcagttttgggtccattttttcatctcgttggttgttgccgggacattgaaaaattgaatcgtctcgtcatcgggtttccatttttgtgatttggagaaattttttatgagttgccgtactgtgcacgtgaggagagtactgcgcgcgtgaggagagactccggatcaaatccgatctatccgtgaccgtccatattttcctctttatagaagtgttaagtaacggatttgagatattttttataaaaacagaacatacatgacatgagcaatccatttttgagatgatccaattttagttttgcactttatgtttgagtccttgtaatatttatatttacatttgagtccctgttcgaggtcagtggtcagtttctgttgaaaacaaaaacacacgaaactcattgtgtagcaacgtttgttcaaatatataacaagtaaatctaatgtagaacatatgcacctttggttgattaatacataaggtagtcacggttatatccgagctagttgtgccctcatcatcaggcttgacaagcggtttaccgagttcgtactggtgtctcacttctgccttagggattggtgcgctttaagcaactgagccctagttagcccggtgtcagaaatgaatttttttattccaaattcttgcccggtcactaacaactcgacctcctggtttggttgctctccaagctgagggacttttttggactttccagaatgtgctttcctaagtgttcgctcatagtccgttagctttaaggcctccttgagtggtcccgacatcttctggaagaacttcttggcactcgggtctataggaatcttcttttttggactctgaggcttcaattgcctcttcacttattctgccacgtaagcgtcgagctcctcttgcgtgcaatcgtacggtggctccttgttcttggcagcgtcaactttcgccttcttcgttgcccttgtgcgggcaagcggtggagcttggtgagttcttgacttggaaggtgccggaggacatggcagaggagcctgaggagaagtcgatgcaggagcctgaggaggagacggtgcaggagcctgatcagtaggagacggtgcaggagcctgaggaggagatggtggagccggaggggatggtgcacgagacaccgcttgtcgcccagggaggatgatgtagcgcttgcgccatagtataatggcgtggcttgtgtcgcgtagatacgtcttaccgtctcctccagggtagtccaactcgagttcctcgtacgcggcttccaccagttcaacttcgaccctcgagtatcctgctggaatcagcctgcagtggtaagtccctgaagggtccgttgggatggtcattcccgacgtaaccttcacgtgatgagaggttatctattagtaatcaacctaagcagaaacttgcggaatgtacaagtccaaaaaaacataaaactacgggcataccttgattgataagttcttgaagggaatatgcagctcacatggtgtccgctgcgtgatctcatcaatggggcaagtggtttcgtcctgagtttgcacggcgtccatgctctgtgatcctacctgccccgttgaggcgcagctgctacgattgcctgaggggctgaccattacaggaggaatgtatggctgggcatcatggcaccgatgtgcggccatgcgttcatccaccttccttgccacctcctcttgcatgctgagctcgtagctcgataccctgtactcaagatctgcaatcttcgcctcggtatctctcttgctcctcatccgactcttgtacgtgtggatgtcctccttgaatccaatcttccaaggaaccacgcctttccctcgtgttcgtccaggatgctcgggagtctgcagggcgagtgacagctcgtccttatctctgttgggtcagaacgtgccctgacaagaggcttccactacatccgttagtcgactggcagcctcgcgtatctgatcgctgaacaccagggagccgtcaacagggttaagcgttccaccgtgagcatagtaccagaacttcgatcgatccagccatttagcggtggccggttcgacacccctctcaatcaagccggcctccatctcctcccacttcagcattgtgacgctatagccatctgaccccaagaggtgatggtacttcttggcggcattttctttgtttctgtccatcatcgcttgcccttgttgccctgtcttgtaagcgacgaactcgtcccaatgatcccttagcttcgggaatacgtcgaagttcggtgtcagccccttcaggatgtatttcttgtagagatctcccttgaagctctggaattgttctaccattttcttaagagtccactgtttcactatgttctccgtacccgcagggagcgtgaacgtctcgagcattgtgatccacatcgtatctttctctgattccgggacaaagctgtcataatccccgcgtgcccttgttctgcgccagtacaccttgctgacaggcacgttatccttcacaacccaaccgctgtgtcgtacaaaattcttggctgcttcagccggggcactaggtcgatcgtcttcgtccacctcagttatgatgtgccgaccctctatcttcttcgcggcacctcgttgtccgcgtgccctcttctgtccagcggaggattgacttccactagcctccgcctccttgttcccctcctcagtcccctctgcatcactctccacgttcccctcctcgttcaggtactggtttggatcctcgttcccctcttcttcgttccagtactggctgcttccctctgcgattgtatcgtatagtatatgtttgtcatcgcgatcagccatctgttcatacaagaaatatttgcagccgtttgttatttacgtatataatatttgattagaactctaataatcatatattaaaactctaataatcatatatgctaagtctaataatcatatatgctaactctaataatcatatattaaaactataataatcatatatgctaactctgataatcatatattaatactctaataatcatatatgctaactctgataatcttatattaaaacgataaatattaatacatgctaagtctaataatcatatatgctaagtctaatattcatatatgctaactctaataatcatatatgctaagtcgaataatcatatatgctaagtcgaataattaatcatatattaaaactctaataatcttatgtgaaaactctaataatcatatatgctaagtcgaataatcatatatgctaagtctaataattaatcatatattaaaactctaataatcttatatgaaaactataataatcatatatgctgagtgtaataaccgtatatgctaagtctaagtttctaatattaaaactctaataatcatatatgctaagtctaaataatcatatattaatactctaataatcatatatgctaactctaataatcatatattaatactctaataatcatatattaatactctaataatcatatattaaaattcgtaataatcatatattaatactctaataatcatatattaaaactctaataatcatatatgctaagtctaagtttcatatattaaaactctaatagtcatatatgctaagtctaaataatcatatattaaaactctaatactcttgtattaaaattctaataatcatatattaatactctaatactcatatataattacatcacttgcctgcgcaaattcctactagggctagctaccactttggcttaagggacgacgacgacgtctttcctacaacatggaaaaaaatgtgttagtctaaacacaaaggaacatattttgattagtgcgctgcatgattaaactaggacggaggggagtagaagtttaggttcatggattaatttgtgagacatgtaactttgcgttcattcgcgttttattcccgttcgttcgcggttcgttcacattcgttcgcgttcattcacgtttcgttcttgttcattcgcggtccgttcacattcgttcgtgtttcgttcccgttcgttcgtgtttcattcccgttcattcaaggttcgtttacattcgtttgcatttcattcccgttcgtacacgtttcgttcccgttcgttccagttcgttcacgtgtcgttcgcgttcggcagtggcggccacggcgtcggcaaaggcggcggtggcaaaggtggtggcgttgcacggcactggtggcgtggcacagcggcgtcgtcggcgttggcatcggcagtggctttggcacggcggcggtggcatggtgcggcggcggcggcggcgtcggcgtaggcgttggcatcagcggtggcgtggcgcggtggcggcggcggcggcgttggcgtcggcgtcgagagtggcggcggcgtcgggagcggcgcgaggacgacgacgacgagcgaggcggccggtttagagagagagagagagaaagattgagatcgcggagcctctcaccccaatgcggcggcggcgtcgacggcgacgacgacgacagcgagatgactgcggcgtcggagcaagggatgccctaggcgcggcggcgaaggtgatgcagctgagatcggagaaaaacatctaagtgttggtggagaagacgagtgcgccttgggcatatatataccccatgatctttagtcccggttagtgagaacaaccgggactaaagatatctttagtccctattcatgacaacaaccgggactaaagatcttatcttaacatctttagtcccggttgttcttacgaaccgggactaaagatatctttagtcggactaaagatatctttagtcccggttgttatcaccaaccgggccaaaagatcttttcccgctatttccaaattcttttttaacacggttagggttaagaaccgggactaaagataatagcattgcatattaaatttcattacatatgggtttctaaaatagtaaataatgcattaaaatgatttaaagtcacaaaattaatgacaaaaccttgaaaatatattgttgtctatagtaaattaagtggataatatataataagcacatgaatgatttaaaattgttaaaaattctaataatcatgtgtaaataccacatgtatgatttaaaattatcaaaaattctaataatcatatataactagcatatgcatgatttaaaattgttaaaaattctaataatcatatgtaaataccacatgcatgatttaaaatttttaacattctaataatcatatgtaaataccacatgaatgatttaaaattgttaaaagttctaataatcatatataataagcatatgcatgatttaaaacttttaaaaattctaattatcatatataactagcatatgcatgatttaaatttgttaaaaattctaataatcatacataattaacatataccatacaacaattgatttatatggatattcaatacatccaaaatagtttacatcgtgtacacaacaattacggcaatacattggcggtgacggttgaccacacgtagtttctcctcactattgtttcttccttgtgatcactaggtgagtaaggggtgtcttcatttgataggaggatgctagggtcaattgtcaccgtgaaagggggttgcccatcaaactgatcgtaatcctcgtcagtcttgtcctctacttcgacgatttttcttttgcctgggagaaccacgtggggctttggctcgtcaggccctttgcccttctttcctttgctagacatgtccttcatgtaaaaaacttgcgttacatcattggcaaggacaaaaggttagtccgacaaccttgttaaggtcaatcgttgtcatcccactgccatcaatcgttacgcctccaccagtcaacctaacccattggcaccggaacagagagaccttgagaggtcgatagtcaagttcccatatgtcctcgatggcaccgtaatacatgccagttgtaccatcgtgtcctatggcatctatacgaacaacactattctggttcgtgctcttcatgtcttgggctctcgtgtagaatgtatacccattgatcttatatccctagaatgtcgcgatcgagccagatggtcccctcgctaggaaggccagttgttggtcaatcgtctcgttacacatgagatgttgtcacagccacgcggggaaagtatcaatgtgataccgtgtaatccatgcatcggacttaccgatgtttctggcgcgaactagagccaagtgctcctcgacgtaaggagccaccaatgaagattgttgcagaaccatgaaatgggctttacggaataaattgttgtccaccgtcattattgatttccttccgagagtcccctttcccgtagtctcctttcatggcgtgattcaagcaccccgattgggcgaaggtcttcaataaattctacgcagaattcaatgaccttctctgttccataccccttggcgatgattgcctctagacgagcacggttacgaacatacttcttcagaacgcccatgtacctctcgaaaggaaacatgttgtgtaggtacacaggcctgagaataccaatctctttgacaaggtgacaaagcagatgcgtcattatattgaaaaatgaaggtggaaatatcaactcaaagctgacaagacattgcaccacatcattttgaagggcttctaatctatccagatcgatgaccttctgcgaaattgcgttcatgaaagcacatagctttgttattgttgcccggacattgtctggaaggataccccgaattataactagtagcagctatgtcatcaacacgtgacagtcatgagactttaggtttgtgaacttcttctccttcgtgcttattattcgctttatattcgtggagtatccagacggtaccttaatgctctctaagcattcaaacatactttccttctctgccttgctaagagtgtagctggctggactaaagtaatggcttcctttatcctttggttccgggtgaaggtcgccgcattgttccatatgcttcagatcattacgtgcttccagtgtatctttcgactttccatatacacccagaaagacaagcaggtttacgcaaaggttcttagtgaggagcatcacgtcgattgcatggcagacatccaagaattcccaataggttaagtcccaaaatatagagttctttttccacatcgccgcatgaccatcttcgctctctataggctggctgccaggcccctttccaaacactactttaagatctttcaccatagcaaacactgttttcccgctgcgatatttaggcttcgtacggtggtccgccttatgttcaaagtgcttgcttttcttccgtaccgggtggtttgtagcaaggaatcgatgatgacccatatacacaaccttcctacagtgcttaagatacgtactttcaattttatccatatagtgagtgcaagccttgtaccccttgttagattgcccggataggttgctaagtgcaggccaataattgatggttacgaacagcagcgatcgtaggttaaactcctcctgtttgtcttcgtcccacacggggacaccttctttcttccacaacagtttcagatcttcgaccagtggtcttagatacacattgatgtcgttaccaggttgcttggggccttgaataataatcagcatcattatgtacttcctcttcatgcatagccaagggtggaggttgtagatacacatcgtaacaggccaagtgctatggccgctgctcatctctccaaaaggattcatgccatccgtacttaaaccaaaccgtatgtttcgtgcgtcctttccaaagtctttaaatgttctgtcgatgttttgccactgcgaaccatcggcggggtgtctcagcatcccgtcctgttaacgttcttcagcgtgccaacgcatcattctagcattcccctttttcctgaacaaatgccttagccgtggtattatagggaaataccacatcaccttagcaggaattctcttcttcgttggctgcccgtcaacttcacctggatcatctcgtctaatcttgtatcgtagtgctttacaaacaaggcatgcttctaggttctcgtactcctcaccacgatataggatacaatcattcggacatgcgtgaatcttctgaacttccagtcctagagggcagactatcttcttagcctcgtacgttgtctcgggcaatttgtttccctccaaaaaaatgttcttgatgaatttcaataaatcgccaaatgccttgtcactaacaccatttgttgccttccattgcaagaactccaaagtggtatccaactttttgtgccccttctcgcaacctgggtacaacaacattctgtggtcctctaacatacactccaatttatgggcctccttttcactttcacagtcctccttggcgtcctgcaacatctgaccaagatcatccgcagcgtcgttatcgtcagcatccctgtccaccttgcccgtttgatttccttcaaattcagcgtactaagcccagtccggaatgttctcgtcttccacttcatcttcttccatttcaaccccttgctcaccatgggatgtccaacaattatagcttagcatgaaccccgactcaaacaagtggatctgaatagtcctgaatctagaatactccttctggttcttacacttattgcatggacaacaaataaaacccttatgcttgttagcttcggccactctcaaaaaataatgcacgccatcaataaactctttggaccgccggtcagcgtacatccattgccgatccatctacataaaatgaaaaaaaaaatcgtacataaataaattttcgtacaataatgacagtcatacaataatgataaaataattaaaaactctttcaacagttataaaataatgacatatcattattcatacaataattataaaataatccaacaaacaattcttatttattatttttgaagttttaaactaatattaatgttgtacttctttgaattttcaatttagtttgttttctattttttaagattaattttcattatattttaaactatgagttaaaaactctttcaacagttatacaataatgacatatcattattcatacaataatataaaataatccaacaaacaattcttatttattatttttgaagttttaaactaatattaatgttgtacttcttttaatttttaatttagtttgttttctattttttaagattaattttcattatattttaaactatgagaataaaactttcttaagtaaacaaacaaaattcctatatattcttcttccccacacaaattttctctctcatcaacttacaacaaagttttggagacaaaaaaaatatgtgaaacattgctcccaaagtaatataacaacaaaaaaaacattggaggatgaagttactaaccttctatacacctccaatttatatataatcaccaaaaaaatttcacaagaaattttggcatgacctcccctcttttttgaagaaattttgaagcttgctcgggctgaaggaggaagaagacatatataaaggggatctttagttccagttggtgttaccaaccgtctgaccgatcaaagatggtttctccactggtgttactcctggaacttattaatccacaagctaacatttaatgaattaactctcttagctacagaaaaagttcatttgacgttctaattatatttttcttatcttctttattttatgtttctcttcatatatacaagtcgtattttgctttgataaatgccaagagacaaaagctaataataaatccatcgagtcaataaactcatatccttgtacgtagtagctttataggtttctctacatcttgtatatatacacgccactagctcaaaatagtttaaattgttcctattaaatctacatgttaagacccaagtggactatatgtttttctctaaaatatcgtacaggtcctacgtatcatgaagaaacaatgtccaagatatgtatatttcttccgtctttactcattgacatgaatgcatacaacaaattgcatgcttatgaaccaattaaagtgatgactcgaatgttacaagtaaaatacattttgttagtaaaagtttctttgaggtttcttaagaaaaaggagacaatgagacaatggacgacattcaattaaaaaaagagaacatcttgcttttaatttaaacttaatttgttagacctgtttttctgcacaaattatacatgtgcccgcgcgaatgcacgggctaccttcctagttgtactctaaatattacaaatacgcgaccggtaatatatagattgaatatgggtacagtgatacaagcctgcgcagtgctcaattaaaccttgattcacgcctgtctcttggattagaggctacgggtgcctattgcggttctttctaactatacaagtgattagtagtttttcttataaattaaatatggactcttcttacaagatattttttaaaataataaattataatcgagaaatgatgacttgatatgatttatgaaatcgcatgccatacatccttgctaataatactgcttgctgagtacttgtactcacccttgctattaactatcctccaaacacttttgggcaagccacttttgggcaagccagtgagttaaatggtgggttggagggtcagtactatgccccttggtgtgatgaaaatcaaggggatgttgtttatgactatcacgtgtattatggaggatgggatgagttgatgtacgcaggggagtggtctagtagctatgtcagtgaacctgggatatcgaagcaggaactcccccgtctaaaaaaaagacaaaccataaattttcgtgtccaatatttgactcttcgtcttatattaaacttttttataattagtattttcattgatgttagatgataaacatgattaatactttatgcgtgacttgtctttttaattttttttatatttttttcaaataagacggacggtcaaacgttggacacagaaacccagggtttgtcttgttttgggaccgaaggagtaatgactaaagtactgctagctcctgcttagaacttgtattattaatgggtgaacttgtaaggccatgtttcagactttaaccctgcatggcatggtattgtaatgttatctgaaccttcgctatctctgatgtggatcattattcgcaaaagcgctactgtggcgaaacataattgatggactagtgacgtcattttggtaatgacggcgcgggtcgtcacaatattcttactctataggaccgaaatcttttgaaaaatattatttctgtaaaaatgtatttaaagccactcataagtcatcacggaagagagagcgggtggataaataaggaacgagagggagagagaggggagtatgataagtgggctctattttatttattttattttattagaaaaaatgctcgtgcattgcaacgggaaaggctattttaatcttatttttgttatatggtttagttaagatgaaattcactgtgttaaattcgtttggatatatatattgttagaaaatcatgatctgcaactaggagtctgatcttctcaaattagcatgcgaatttttttaaagagatttcttatacgatttcttctgtatttccaaaagcgaatgaacttaaaaaccaactcaaatatggatttgtatttccaaaaacgaacgaatttaaaaaccgacccatacacaaatggcgtaccaaagtaccgataaaaacatcttcaatttataatagtagagaagagatataagtagtagatagatagagaataacaaattaaaaccgactcaaacacggatgacgaaccgtaggagcatcttcaatttttataatagtagagatttgataaatgggatgccacgtgtacaccacgtcaacagatactatagtcaatattgctctggaattcaaattataccgtttttaatagtttaagatcatgatatcgggtattacgtactctctctgtcccaaaatataacaacttttagccatcaggatttatcccaaaatataacaatttctccagcaacattctctttccaaccaatcataacccaataagagcaaaatggaaaacttgtcgtgaaaaattttctccaaaaatttgaaatttttgagtatgttacaagcatttagctgttctcttcccaaccaaatacaaccctccaccattcacttttcccatatacctccactactcatcgaatcacaaccctccaccattcacttatacctattttcttaataaccgtatcccacttaaaaactttttatattctgcgacggagggagtattatagttgacaaaggtatattcagggagtcaaagtggacttatcactgcggctttgataaatccgaagtggactggaaaccgacaccgtgtgatccgtgggcgggcctggacttgttctccttgtcggattccagcccatataccacatcacaggcgcaggggcacagagcagggcgacccgtcgtataaaaccctaacgccgcctccaccagctctctcaccccagaattcccaaatccgcaacgcacgcacgacagccagagagagagagagagtcagaccgccgacacccgacgacatggccgtcgcctccgcgtgggccaaacccggctcgtgggccctcgccgccgaggagcaggacgacctgcccccgccgccgccgcccgttcccgccgccgacttcccctccctcgccaccgccgccaccaccaaggtccccaagaagaagaagccgcagcccgtcccgctcggcgagttcaacagcaccaagttcgtcgcccccgcctaccgcgggcccacccaagacgacctcctcagcctccccacaggcccccgcgagcgcaccgccgaggagctcgccaacgccacgcgcggcttcggggctcgctggggcggcgccggcgccggtggcccccgcggcgacgacgagccccgccgcggcggatctggcccccaggacttcggcccgtcgcgcgccgacgaggccgatgactggggcgccggcaagaagccgctcgagaggagggagcgcatgggagggtttggcgtggactcttcgatgtcgcgtgccgacgacgtcgatgactgggtctccaccaagagggcggcagcccccgcgcccatggagcggagggagcgtagcgtggcgttcggggccgactcgcattcccgcgctgatgattccgcgagctggatctccaacaagggctattctgcggcgccgccaccgccctccgacagccggaggggcggtccagtctggggtttcaacagggatggaggcccagacgccgactcttgggagaggaggagggaggaggtgagcggtggtggttcaagcggtggtgcccggccacgcctgaaccttcaaaagcggaccttgccactggctaatggcactgatggagaagggaaggaggacaaggaggaggagaagggagagatgcagcctaaaagcaggtcatcaaacccgtttggtgcagcccgccctcgcgaagtggttcttgctaccaagggagatgacgggaggaaggaggaggagaaggagaaagaggaggagaagctggagattcaaccaaggaccaggacttcaaacccgtttggggctgcccgcccacgtgaggaagtgcttgctgcgaagggtgaggactggaggaagattgatgagaagcttgaggccatgaagatgcgcgaggcaccaccacctgagaggaggtcctttgggaggagaggttcccctgttagaggagaggacaatgggagccgtccactgccagagagtcatgtcgagggagcttggaagaagcctgatgcagttcaggctgttggagaatccgaagatgggtctgataagcttaacacggctgaggctgcgagaaaatttgaagaagggtttgataactgaacttttatccttcttttattcaattggctaattcatcatcgattgctccctgttattgaattaatagttaattgatctctgttaggtactagtagtttttattgatctcagttattttttgtctgaggtatgctttctattgctagggtggaaaacaaatattgagcctgttactgtgtgctatctgcttttcagtatgtgtccctctagattcattgtcaagtgcatgtcctagcagattaccaattagtatgcagcgaagctttatttttactggcttcattaataaaataagttcctctcttactagtcaatttagcaacagttttattaagacaaattgcattcatataaacatagtggttggtatggtaatgtttgatttgattattgtttgtcttttgctgggaatgttttgtttgccagattttaagattatcattgcagtgaattgaagaacattgtttgcttgcttgatgtgatatttagacatgagccaaatacccgtgcattgtaacaatctagcataaatatatgatttcaaattgaatagttcacacttaattctaatacaaacgacgtgcaaatgatacagttatgcagagaagattgttcagataaaagaaaaatgaacacagttatgcatagtatggtggtggtgcaaactcatttccatcactgctagcttcttttacaatatactagtaaatatcaccctgtagttttggttcgttacatgttcttatggtctcaatatgacaaatgcttagccaatagccacttaggtagttggtgttgttctccatttgttccacaatctaaattacaaaaagtttcttgtctggtgtttatgctccttttcttttggcttcaaacttatgtacttgagtgctcaaattcgtgttgtgttgggttgcaatctaattctggagaatatgcgtctggtgtggcattgtactgaacaggaagggtcctgttcccatctgagttaacatcctgtgttcgcatacatctcttccttctaatgcatggaattataagcatacatcctgttttcaattctttgaaccatatagtttggtgatggtggatatcttgaatatggtatagtttggcataaaaaaaaacacagtaaggtacctacatatgtttttccaagcgattgacaatattgtggctgcgagtggcagatgtagatccaactatcagaatgaacaatgcaaccacaaccttataatagggaaatactgaaacagacatcatgacatgtttcttatgccttgcatgaatttttttttggttagtttatatgtgatgtagtagatcagccaccaggaagaaatttatcatagtaatttactataatttcattattgtgaatttatatgtttgtcatggtttgctttgtagaatgtgaattcggttaatatgattgttgtaattttagtaagtcacgtatgagttaatattcattgttattagctggtatggtttgtgcaccattagtgtgttcttgcttgtttctgattcatggacctcacatggaggaagtcttcgcaagcctgcaactgtacccctattgccttggccccttctagttcagtttaatttttgcatgtcatctcttattgaaagaaggaaaaattgtaaatatactttgcatttgtccacttaggttgaagaatcttgtttggcttatgtctcttattgaaagaaggaaaatgtaccatttttctaggttgataaagctgcgttgttagcattctctactatagggttattgttgttttcacaaagttcatgttgttcttccattgtcatatcacttgaatcatatttcagtgtttgtcttctttcatgttccctctatctgctgaacattatttcattgcaggtctgatgctaccaaagagactgctgcagcaaactaatctatgccggtacttgcgaacccaaggattgcagatctcttctgctaaatagcctttctattatttttttgctacttgtgtgctacagttgtaacactgagtcaattttgcgtccatgtttcttatcttttcttagcacctggtaatcgtgatttatggtattgagaattttgatctggaacttaggtcttaatcatagtgggtagtagctattcattctattgtgactgttagttgtcatgctatgttgacatggtgataatgtctcgaagaaagaaatagtgcttttttaaccttgttagctgtggagatgtggagtagcatttgtttagaattttgcatttacaatgcggctgaggtttgcgccagcaagtgtgaccgcacctatgatttctgcgctaccttgaatcacggtgaacgcttggctgaggtcctgttcgcgaaaagaattttttgtcacatcggatctttgaccgaatatctaagatatcagaaggggtttttggacacgaataaaaaaaattaatctcataactcgtatggaaaccgcgagacgaatttatgttttagcctaattaagctgtcattagcacttgtgtgttactatagtatttatggctaatcatggactaattaggtttgaaagatttgtctcgtgatttccatacaaactgtgcaattaatttttatttttatctatatttaatgcttcaagcatgtatcaaagattcgatacgatgtttttgagaaaaaaaaatttatggctaatcatggactaattaggtttgaaagatttgtctcgtgattttcatataaactgtgcagttaatttttatttttatctatatttaatgtttcaagcatgtatcaaagattcgattagatgtttttgattcgatacgatgtttttgagaaaaaaaaatttagtaactaaactaggcctcatttcgatgcctatggctatgtggcctgtttgacatgcatagccggtccaatgaatcactgcgaacgttcggctcatttggcttgttggaataaactagataaaacagccccctacgtatgtctgtaacatttgataaagcagccccctacgcatgtctgtaaaaaaaaaagttaagtggggtttcatgcggccttccatgatccactagtcgttctcatgctagattagcccctttgtttgacattcatatggattttacaatctgttgggaatgcataattttttattcaacgaagaccttcagttataccatcatttggctcgtacgttaaaccgatgctagcctagtgtctagggtcctccagtgtggtttgtaatatgagataccaaacctagtttgatgaacatctgcatgtgtctcttcatgatactcaaagtgacacatgcagatgtcctcgacctccctgccacacatgtagatgttcttttcccatatcatttttctaatctgccatcaaattcgcaaacaaaacaaagattgcattgctcatttttctcacgttggattggacacttttgtaagctgaaatttgtattatggagtttgttgttgttgttgcaaaagtcagctaaaggtaaacaactactccctccgtttaatattacaagacaatgatagaaagacttataatatgaaacggagaaagtaatcaaaaagcttctcctggtggagttgattgattgatgcctatttagatttcctccagtattctcaacgcagattccgcatagatgcgttgtctgaaaattgaaaaccacattacaggagcataaagttaaaacaaaatttagccaaaatttatagaattggagggagatagggaatgaaaggtttttctttcttggcgtacttctcttgggtgtgtctagggccagccggccagggcgattgtgtttcatgtatccatcccatggaaccttcttaaggccaacctgagcagcgatcatatccctcaccccatcaaagtattggaaaatgatgtgagcaattgtatattttattcatttattttaaatgaagagccaattcaattgcggtctctcctggcataatttgctgagggtccaagaaccaaacatcacacacaacaccccatgatgtcataagtcgaaacaattcaactgcaaaagaatgtctgacaaagcgttggatgtttagtttatacttcgtactcaaataaccaagacggccaaattaagcagatctgcacaattattttttgcatttcctcacttcttactgtcccaaaaagtgtcagtaaactctttgttgtatttgatagctattgggcatacaatgcagccaagctcaaaagcagcctgaaaaatcacagtgcagacaaatatgcaagccgtggttagtctggcaagaaagatgaccaaatatatcttatggaagaggatggctgattctattcgaccgtcttgtgtatgctttctggggtacccgatatacactgccagattgctactaccatatttggttactgctcaaaaagagtttaacgcgggtactctgatacagttttgtttgaagaaattgagtcttgaattttgtcttgtagaaactctgtacaacttaacaatttgaaatatcatttgtatgggcatatcacatatccatatatgattttttttcaacaaaaaggaaatgcttaccttcttgaacatgactgtataccgattgttaacgcaagttccttctgggaatatcataagaggattgttgtctggaagttggacatgctcttgtaggttgtagcctggtaatgaaatttcttcgagtaaaagtaagattaccaaatataggattgctaaggatagcatttcttacttttcttccaccatgttgaagcagaaggagcggctgcttgtccttggcgttggcgcgggtgtgtggttgggtgatgacgatctgctagccattgtcaataataacgaaattagggccctcctgtgtgtctcctggtagaaggcatcccatgcgcaccacctgaagtagtcaacaatgcagggaacttcttgttagagtggagccagaaggtcttaaggtaggacttggatatgacaactttgccggtgatggcggtgaaggggtcgaactccacggtgtcgatgacgagcacgtggtcgaaagatgtggtgtgcgtgtccgcgccgccccagcgccgctatcaacacagagctggagcgtgccagcgctctgaaggctagatcagaacgtgccctcgtttagcaggaggaaaacgacatacgcgtcaccgccaccaccatccattaaattcgcaccttggaggagaatttgaaagacttgggccctcttcactgcaagctctccacgtggtgtgctaaatttggattgtcgcacccgaatgcttgccctttgtgcgattaagatggggagacaatgcaacacatcttcatatcttatcttgtgtctctgcccgtcaagtatggttctctagtcctagaaaatatcagattgacgatggcagcacctcaaccttaggcaacctgtttttttagtgggtgatccaaggtagtcgagcattatactaaggagacaaagaaatgattaagttccttaatcagcctagtggcacaagaaatttaaaagtactggaataattgtgtgttcattaatatcacaccaacggcacagttgtcttgcaagcattagcaatagagtgttcgtattggctgatgccacataggtcgctttcttttgatggttagctgctcatgggaggtttttgtgtgtcacgtgttttttaatgtctttttcctagagagttccttttttgtggaccactctattgtacaaatttctgcttcttgaagcacaagcctctcgcattttcttgaaagaaaaaagaaatgttctagggtaggactagtgatccttgtattgtaaaagcataaaggaccgatgcaaacgacgacccccaatacagtcctatggaagaggcagtacaccatcatgcgcgccacattttgcagcaacatttgaatccgatcttccaatgcaaccatatagatcgatggcaatacacattgccagtatatcacgaagatccctcgtgcttcaaagtaaaaaaagatagatatatactggtttaccgcaccatatcttggtttcatttaacaatgacctatttattcttcattcagatccaacatgcacccgcatgttgaactatagtaaataaacgcatatgagaaacaaaacagtattttgtcctgagccactaaaattcttggcaacatttgctacagtacatttaaagtttgtggcctttgcggtgagacacctagagaacgtgtatcttctcgtggacactgtaaaaaatatggtaatcagctgctggacacccgcctcattattttattatttttggtggaaacggagagagaaacaatggttaaagataagtttgcccatgggcccacttgtcaatcacacatctggctttctacgttcctcttcttgctgctgggccgactcgccgcgtggacggaggacaaagaacgacgtgcccacgaggagggtgagggcattgtctctcgcggtggcgtcgggcaaccgactgcgtcgactggccttgaaggtgagggccccccatgggccgacagtgggacggatagagatgatcgggaggctcgactggcggaagatggcagcagcggcatgcgtcgggtcccccgtgggccgacagtgggacggatagagatgatcgggaggctcgactggcgaaagatggcagcagagcggcatgcgggaggctcgactggcgaaagatggcagcagcggcatgcgtcgatggtgggacagacggagtcgaccgggaggctcaattagcagaaggcggcagcagcagcatcctggggagggctcgaagcgacaaggggcatccacccctaggcacggagctctaggctggcatcgacggagtcagggtgtcggtggagacgaccctagggcgcgaaggacggtgattgcggcgggcagaggtggtgtactgctgatcgatggcagtggcagtgaggcgccgctagccttgacgtggtactcacgacggcatccaccgagaggctggccagtgacgaggagtccaagacacacggtgtggagggccacccgacaaggagggtgagggtgctgcttctcccgccgcctctctgccggtcgccgccccacccatcgtctaccccctccgccgcccactgttgcgctcacttgccaccactcggtcctctattgccagcagcctcccaagctcgctaagaaaagagaaggaaaagagaatataagcaggaagaatagtgtccaggggcatttcagtactttcaacactctttctctattttcaccaaaaataataaaataatacatcgagagtcctacaggtaattaccacattttttaatgttcacaagaagatatacgttttttagtgtctcacagcaaaggctacaaaatttaagtgtcctgtagcaaaatttgccaaaaatctttggataaaataaggtaccgacatcacagtacaataaaaaaaaataccgattctacagcaaactgtactgcgctatcaatccgaatcctgatacagccacacataacaagagaaaaatcttattacaattgcaggaaaacgagttaggcagagagattatcaaagaacttcatgtagtcatcaaatgactctccacgccgaatcttagcaatggacccatcatcttctacctgcattacaaataacagggcatattggatgggaaccaacaattataaacattgcataaagggagcattttgaaaacctatcaacaaatgatttcggatgaaaaatatataggtcagtttgtacccaatattcaggtggtcgcaacttcaagttgtaggttgaagccatgctcatgcagtaggctcctgcgtcatgaaccaccaaaccagctccctacaagcgcaatatgtttgtagggtaccaacaaggatatcaaaaagaaaacacaagatatggtcaaaccttatcaggtgttggaagttccctgtctttgccaaggaaatctgcagattcacaaactggtccaacaatatcgaatgttgctacttctgcatctggggaaggagaaaccagttcgatatgctgcaccatgtggatagagatgacaggtaaataacatgataaaacaacatagtacgaaataactgaatgtatatttcatgtttattttgaacatttgttggaaaaactgtatgcaagaaaaaaattgttggaaagatgttatttatatataggtcagatggagatgtaaagatcagagctaaacctgagaccaacgttacaatcatcatatatttatgaatggtgagcatcttatccaaacgaactcagctattatgaacaatggacaaaaccaacactctgcttgcaaccactatcagttgtatcactaaacaaacctggtatgctccatatagacttggtctgataagctctgccatgctgccatcaactacaatgaaattctttgtaccattagatttaacaccagtgaccctattgacgaagcagcaagtgttagctatgagggatctcccaggttcaatgatgagtgtaagatctcgtgacagaactaattctcgcacctacaaaaaatcacaggggcacatataagaatcacgccatatgccaaattttaacagtgcaaaaatccaaagtaggaagtgatctatttaaataaataatgtgcctacgaagatgagaatcggaaatataacatggatattgagctcacagtgttgatgaggtccataggtgtaggcaagactgcatccgtgtggtgataatctatgcccaggccaccgccaatattgagatattccagttcaaaaccttgtgctcgaatttcatcaacataattcaccataagacctgccgcatctctaaatatatcgacctagacaacaagaaaacaatatcatataccataccatgtagctcaaatgtattgtctaattatttgaacatggtctgaagaaaaaaaagttatttagcaaataagcataagcccacatctttaacaggggcttgtccctggataaacagaaacaaacacattaagtttgatgaagtttcaaagtcagcataataagtctttttgaatggacacactgctgcacagaaatagtatacacacaagaaaggaattatccctttctcctaatttcttcagtaagctttattcacataagctgcaagttcacaagcaatggagaatgggagaggagaggagagaagagcacgggttctttgatgctgtccatacccggtgctgcatccctgatttccattccccgaactgatcattatactacttgtcaagagaaaaacattacagcgtccaaaacacgaacacgatgctttccatcaccgttgctccacatccactgaaacaaaatcacgtcggacatgctcaccgatgtctcacccgatatcacatgcgagagccctcttctaagttaataagtcttccaattttaaatatttgtgatgaaccttagttcgttatgggataaacattacaaggtggacggctggaaatggatagactagagactatcagctgtacttaattctttaataatcaaccaatagtcagagattttaaaatttcagaggacttcatttagtcccagctgtactattgatttacaaggtggcacttagtttatctcagaggactgggactcagataaattcagctgtacttgcttgttaataatcaatcaatagtttcctgactatatagtgagcctcataacaaccactgctacattatgatgcaccgatacaacagaaaacagcatattcctgtaccagatatgtatccgagacaggagtacgcagtcaatacagtattgcagaaatattgatcatataatggcgaaacaaatcaaaactattagcaatgcttcctcgattcaaattagatgctcagatatgcagtcaagccaaccctcattcgaaagcccacagatggtagtctaacccaagaccactaacccttgttcgcacctgtgtgcgactgtgagtgctgttcccctcattctccacctccattatagcatcaccctgcctacatcaccttcagtgagcaacctgctcgcctcaactacaccatgtgtgcaggaggcttttctatgacaattgaaagttaacaaattggaaagatgtgtcttgatttaaatgtttcttatcaaacttaaaatgttttggataaaaaaaaaacttagggtgtgttcgttagtttggggttgggaacccatctccccacacggaaaacagaacagtccattagcgcgtgattaattaagtattagctatttttttaaatgaattaatttgatttttttaaacaactttcatatataaactttttgcaaaaaatgcaccatttattagtttgaaaagtgtgcgtgcggaaaatgagggaggggtgttgggaacctagaacaccgaacacaccttaaaatgttaacaaatttggtttcatgttaaatggtccccattttatcccattgaactgacacatcttagtttccagagagtgagacacagagggtaaaatgaaaagctggtccgttggagctaagagtctgacacctgcatgtggaggtactcatgcctgtgacttgaggcttgaaacattgaaaaaaacaaatcacttttttctaaaatggccagttcagaaacaagagcaaaaatattttgaacattcaatctagttccgcaaggtcagctatgccaaaaatctagttcatggtcattaacagatcacgtactatgttatttccataatgctttcagtactatacaattggatagaaggtaagtctcaaatttcaaaatgtagatgtttcagacattggcacagtaattaaggaagtcttaaaatgaccttgttgcccataatcatagcacattggaatgatatcttatttattcatgagatgtattcaatttacaaggggaatagaggaaaaaatgggacaggtacctaaaagtcatataacaatttacattttgaatcagagcagtgtggttcctataattcttagtgattgaaatgatctgttgttgccattcgcatacactaaaacaaatggcaacaataactttctaaataaactcaaataacaaaaaagcacatttttcagagcataatgcagcccaaaatgcaatttcttactagcaatttccaactgttacttaattgttctcaactagctagaagtatggattaatgttaatcatctgaatgccatattacatgcttggatggatataacatcatatggaagctacggcgagacgaattattgtttgagcatgatgcataaaagcatgtccgctggctcagaagtacttacaagacattttagctcattgcacaaggattaatgtgtagaagaactccccttgcagctgtacaagaatgctgcagctgtacaagaatgcatgcagccatcacatgcttgcacaggaggggagaggaatattactaaccgagaaaaccctggcatatgctaacggttgatggttttggttaataggtttaagtttgtgcgaagtatttatcaaatggaaattccacccaaaattactttctcagaaaagcagaactattcttgaaaaagaatgtctaaaacgatatataatgaatgaagtggtaaccataaaaaggtacaactaatgcaaagcaagcagcatgttttttagtaaatttcacaagaccccaggtattggggcatccataacacaaaaccccagttattgtgatttgtttcagggaaccccatgtttcggggtaaaatgtttcaaaaaaccccatatttatgtaaaatactcatgtttcattattacatatgattttttttcataaattcacatttgttgactctcgtctagtttatttattttttctcaatttttcactgcacaaaaaaactcaacataatcataagtgataatgacataataattggttaagtatacacataaatgatcagaccacgatgaacaacgattattgaaaagcagctaacgtgtatatgtacttaaaaaatggcaactaatgtaaagaaatgcagcatgtcaggttttggggcactagcattataaaaccccacgttttgaggtttccttcactaaatcacaacttattcaaagagctcacagagtaaagcagggagaggcggagcaagttctacaatatagggctgtgactgcacaatggaagccgagtgcctggtaacagaggcaatgtgatcttaggatacaggaacctacgtttcgaggctccgagcctctgatttctggggttgtcttatcagctaacgggaacctaacaggatatgatggaactgagttttgtgatacatgccggcatgttgcaaaacatgggatttagtgaagaaaaccttactacctggggttttgttaaaatttacacttttttgtggcaaaaacagaaggcgagttgcctgtactgtatgacaaaatgtctgttgagcacaagatgctaaggtacaaaacaccaccacgaacaagctcaccataacaaatacctacttattacaactcaaagtttccaacaattataaccaaagaatagtacatcataattcatttacctttgtaatggtagatcccagatgacaatgaacacccaccagtgtgatatcatttgagtatgacttgatagagtctaagaaccattgtagtttctcattacggataccaaatttggaggttttgtttccagtcgcaacataaggatggacctgttgacagaaaaaaaagacaagcttcaagaaataagcaatcttaagtttgctcctcaaaagaagattatcttgctttcagttcttaatacaattgacatgccttttacaagtaaaaacaaagatactttcatacaattttaaatcaactgcattagtatcatcatacaaaagactatggaggaacaggtaacactatatgcacatacattattggcaaatttcgctacatgacatcgtgacttcgcggttttagct

SEQ ID NO: 39884 - DNA, 1990 bp, Oryza sativa
ttccgcaccacctgaggcttgctgtagaggtagaagggggtccgctccgccgcccccatcgcgtcctccaccctcaccccctcgcagtacaggtgcccatcggcgccgcgccggaaacagcgcttcggcgcccgaccgtcggccgccgccgccgccggccgcggcggcggggacggcgctgccgtggagagagaggcgcgaacggaggccgtcaggccgtggcggcagcggagagatacggccgaagggctgacgcggttgctgtggctgcttgggttagggtttagagcagggaggagcgcgcgagagagaaggttggccgccgccatggctagggtttagggtgaggtccgcaaccagtctccacttctccagctccagccagcaagggagctctacaaaaattcggtgcaggctgactatgccgaacttcaatgggctgggctgggcacaggtttcagaatgcgatgaaatgggatggaataagtctatttcacgtacctcaactcttgcccttggtcgaatcgtgttcctcaagtttaaaaaccggtgcaaatgaactcattgattgttagggaggtgatttattctgatgtggtaggttgacttagtctcagtcgtcaaatgaatggaaggtaaaagtggatcctacacgtaaaaggtaaaaataaaaatatgtggggctcacttgtcagcaccactacccctttcaattctgacgtgtcgttgccatcggaggaggggcagtggtccaccgcggcgattgagcacgcggtagtcgggcagaagcgaacaacgacgacgacacaggcccagcgagcggcgagccgagctcaaggaagaaagagggatggggaaggctcccaaggcggcgacgcacctcgacccccacggcatggaggccacctgcggcggtcggcggcggtggcagcaacacaaagagcgtggcgacaacagcactgttggaggggatcgcacactactatgaaaagcatttttccgtgcggtcaaaataatttttccgtgcggaggacttgcccgtatgcagcaatacgtctggaaaaatcaatattttcgcgtgcgggtggcccaaccacatgggataatcattttcccgtacggtcgggttaagttgactgcacgggataatcgattaccccgtgcagtcaaattataccgtccgcacggaaaaaaacaaaaataaaaaaaagcaaaaatcgccgcgggcgccgccgcgaccagcaacagccggccggcgcacgtgcatgcggagccggcggcgccacctcatcgtcgtcgtcgtcgtggcgcccgccgccgtattttggtcgtagaaaccgaaacaagcagcaactgcagtagtactagttagtagttacagccatagaaaccatccgtaggaaaatcagccgctgccgcgcgtgcacgcggagccggcggcgcgcgcagagagagagagagagtgacatcaaagaaaggagagagcaagaactcaagcactggctatatcggcatggagaaattagtagcgcaacagcttcaactaccagaacattagcaatagcagccaccaccagtggtttggctggggattcaactcaagcttgagagaaatcatcaagagactggaaccagtagttcaacatcacaaccacaccactttgctgtcgtagcagccatggagaagaaagagagtaggagatgcttgagatctagcgcgtgcacgcggagtcggcggcgccgcctcgtcatcatcaagcccgccaccgagagccgcgtggggccccgccatgcgtgccgaggagccggcggcgccgcctcatcgtcgtcgtcgtcgcgcgtgcccgctgctgagccacgggccccgccgccatccgcacccgtagcgcgtgcaagcggagccggtggtgccgtctcgtcgtcgtcgtcgcgtgcgcccgccgttgagccgcacgggccccgctgccgtccgcgcccgccgcgcgtgcac

SEQ ID NO: 39885 - DNA, 22844 bp, Oryza sativa
gtcgctctactacgtacccggacagagaggacttaagtgatctcgagggctgtcaccacctctacacccacctcaaacatactgtgggatacgcagcaattactggataacaactgtctgaacactatatctaagcaattactatctactttagtgtttataactcaccaaagcaatcactatattttagttgattatagtagacaataatcccgtatgctatttagaaactaaccatgagataattctcacaagataaatctaaattacttaagaagaatattatattaaatttagagtaataaacggaataaaagaaaataggagaagattaccgacaactccggaattcttctgacttcttctactctactctcttcctattctagtatacaatatagtacaatagagcctcttataattaagctcaagcttggaagtgtgtgttgaagtgagtgagatgatgtccttatataggggtaggtatgacggttggcgaaggggaaatgtccgaagtgccctccaaccgtcattagggatgcatctgggacgtccacgccaaaccccacatccaacggtggtggtggtggttcggccgaaccagggggtttggccgaacctgggctgggccctcctggcctggccttcagcccatgttctcccctgatccttctctattcattcttcggtattttgggtcgatttactgatgttttgatgaagttcacaacccatccttgcagggatacacatttatcctcactttagtctgattttcctcccagcatctgagtttatcatctaaatacaaatatataccaacacttgtggaatatgtgagattaagcacctatcactatgttggatgttttattatccgtactttatgcagaatttggcggtatagaatcggcatttaattgccgccaacacggagccggcggcgcgcgcagagagacagagagagaggagagagaggagagagaggggtggggaggagaaaaggaggcagacagaggggaggggaggagatcgaggagagtaaagaaggagagaaaataaaaaggaaaaaagaagagagagtgtgaaaaatttgaaatgggtgagagagaaaagagagagtatttttccgtgcggtccacttaaaaagcccgcacgcgaaaaatgatttttccgtgtgatcttcttaagttgaccgcacgggataatgagaattatcccgtgtggttgggttaagacgttcgcacggaaaaatgcattttcccgtgtggtcgacagtttcgcgccggtccccccattttttcgtgcggttccagttatatactgcatattaaaaaaaggaggaaatctatcatgtatgtattagtggtaagagcttgacaagttgggcggagagtgcggtaggggcggaggccagcggcagcagcgcggcagggtcggtggcgagggaagaggctgacggtagcagtgcgaggggatggaggccagcggtagcagcgatggatgaggaggtcgatgggcgtgagcggccccctcccaatcctgtggtgcgacgacgagcaagcggcggcggcggcgccctcccggactgggcgtcgcgcgcggcgctaccgccagcggcgttcaagaatgggttgtatgtcagtacatatgaaccgccataacttgttggccttggcattgaacctttatctgtcgtcccctcttcacaaatctccgccgcacaccgatggttgtttctgttcgttgtacacaatgtccggcttgattccaagctgctccgtcagtgcaagaacctgtgagaactaagaacccaagatgcagattaaaatcaatttcttttactattcttgagctagcagaacagcgaggagaggatggtttagtgtttgtgagctcggggcgtcaacgacgtcgggaatggttttagtgtttgttggcatcgagaaagcccgtgagtagggtgttgaatgtgagatggagaaactcaactagattggattaatcacggagtgtttacaatactagttaagtgctcgtgtattgcaacggggataaaaatgttttaaagctaacaaagttcaccggtttgctaaactacattctagtgaaaatacttacgattctgaatttgaccatccaatcaagcaaatacatttgtctccattcataaattctttaggtggaaacaagatcttacatattggtgcaacgaagtgatcctagcatgaaactcgatttattggcctcaacccaaatatattgccagttatatggatattcatgttgacttcctactggatatttgacatgtagttcttattcagaactgctcactatactgattcatgtttgaaagtactttggcactgttatattattgctactaatgacatattttatgagaaaacaaagctcaaagtttacaaactcacgcagcaaatcgatactaacccactcaaggtttaaacactttgattgctacatcttactgcatattgtccaatggtatccagtggttaatacaacaagaataagttaattgcaatgtggaattgttcattgagattgttgaacatacaaatcaacaatgatcctgatcctaatcttctttctaacttcagaaactaactgccaaggcattttaaagaaaaacataagtctaggcagactcatttcgtcaacaaaaccattcctttatatttcaaataggcagtgtcaacatttcacatacagctgaacaaggagattttgcaatggctttttatgtcctgtccacccctttggcgtcaagccagaatctctcctgttgaggaactgtatattttccatcaagttggatttaaagtgcatctcagatgtccttcatccaaatcaagacccttgcagcttcctcttttgccttcgattcaacaacacttctatgatgacactccagcttccaaagcagttcctttttacagctctctccccctcaagatatgccagggtacactcaagacctgaaacaacaggtattctctcacactaaagaagctttgtaattgcttgccaatgaaacagctttgtaattgcttgccaggttttttcattggctaaatctaacagtgctgaacaactggttctgctagcacataagttatccctgaaacaacacatctcatgttataaaatggcctatttattctcaacaagtatattggtcatttgcgtagataacatatgaatttgaaataggaagcaaccatggcacgaagtccagagagttttatatagtagctaatagagttctatatagtacagttattggattagaaataatagctaatagaaacgttgttgtttggtaggtgacgctgtataaaacagcaagagcaaatataatagagtacaagcagcaatatataacagatagacatgaacaaagagcgaatataatatcatttcagccttcttaccatagaaatatacgaaattattgtttgattgtactaaccaaattgtccatgtccaggataataacaccaaatatatccagagttaacagactggtaatcaacacatgttgtttctacagcagtggaccacagttgatctctacatgaaaaatcatgcaagtaaataatgttctgaaaacataccttcaaatcctttatcaatattctcaaaaaaaaaagtctgactacactgacgagcagcaacaacggttctttgaatttcagtgaggcaaggaatccaatatccaataagtaagattgccattccattgtagcattataaaggaaacagtaaccgatgagatttttttcagattcagagatatagtcaataaaacagttagttttctcaaaattaagagacaatgtgtattgtccattgaaataggccaagggaatttgctttctcaccgtggcaaatcgatatccgtctaaaacacataaaagatctgtaatgtgcccgtgctaacgctacggtaatatttagtaatgcaaatcaaataatttagaaattgtattcttgcccttacttttcagttcaattgtgattttacccttactttttagggtttgtgattttgcccctactattttgaaatgaagcaaccatctgcccctggttttgacggtagttaggtgggcccaaaattttcgaattaaataaagggaaaaattatattttaatttgtgaattaccaacgtacccctaatttcagtaaataagtcaatcacatgtgagaatcaacatttccccgatcgaaaaaccctagatcgagggcagtgcgtgcaaggaagcagcggcagcgatgcacagggaggcgcggtggccggcgagcaagcggcggcagtgacgcggcggcctcgccagccagagcgcaggaggcgaggcggcggcctcgctggctagcacgcaggaggcgtagcggcgtggcggcctcgcgggcccggcgtgcagggcggcacgatgtcctcgcggtccagcttgcacggaggtgcggcggtgttaacaaccaaatttggtaatctgagtatcggagatgaagataggagcggagtaggatgcaagatggaaatcgttccggaaacagagcaaggatcggctaaagtacgaatcggctacgaccaggattggcagagtccgagttggacaaggttagccgattgagccaaatccaacaatatgacacggcatacgttgtcgggttgagttaatgtgcttcatgaagattgccatgcatgggtagagtcctgaaaagacaattgtatctattaattaggatatttcatgtaattttcttagagatatgtttaggcaaaagtctgccgcaaggacttatggtatcttagagtttgttagagataagagtcgtgtccaacatggacatattttgtaatctcgggtataaatagaccccgagccccatggaatcaatctaacacacgttcaatacaatctcggcgcatcgccaccctttcgacgagttcttgttttcgagttgagctgcatcggtttcgatcttcaactataggtaaaacttgttatgacgacttacgttctcgggattagtgcttccatctttatgatactctaatcttgtttatataattcattgagttatcatatatcttatgtaatctttggcaatatcgctatctaaccttcaattggctaacgtctgttgccagaaggcagccgatcaggttaaatactaacgttgacttagattatataggatatctatcactctataaaacatccaacagcttgattgtctagatattatccttcttttcatacttatagctgcatcagttgagtttgatcttatgagtcgtgattagaatctcaatttctagcctgcttttggttgctgattagggtagcatcggggtttcagccaatcttatctgatttaaccacttttatcttatatgctcgattgacatgttaaatctgccctttatgttaagatcttgctgcatttaagtatattaggcttttgtttggtatattttgcttgctgtgatatcttaatatagagtggtatcggagtattagctgatacatactagatctatctgatcagctatgctatgaacatatatagtcttgttgttagtatatatttcaatccaagtgattcatattgtctaggcatggcgaccgatctatcccaatcacttgatttaaatatatatcgacataacgattatatattgttaatatctatagccgatcgagtagatttagtcctttcttacttattcatgattgccgatcgatctacatatgacatcggctcaaagataaatgatatgtcatcggcaactagccgatcggctattgtttatggatttaactgcggtttctttgtctttatctcttgttaattgcaggatcaaatcaactggcacactcacgaacctaaaggcaagcttttggacatgcactgaagttaagcagatctcacatgcctcgtgtttttacatcaataggcagccgtgaggccaatgcgcagggaggcgtgcggcgactccgtcgacgactgcgtgggcggcatttgattaggagacctcaagtagttgtgtgaattccacgggtggccgaccgtcgccggggctgtggatcagtgctgctggaggcaagcaagtgcagaggcggcgggcaggcttgcgcgtggatttgggatttttttttttttgcttgggttctcctttctttttcctttttttgtgtgtaatgtctttgctcatgaaaagatgggtaataaattgatttgtttggacaattggtcgccttcttgtatatatgcaacttatatgttcctgaaaaaattggcaaaaaattgatttgtgtggaggtgccatataatctcaaagttaaagttccagtatgtatgtcagatccatcgctggatgcattgacacaacggggcaaaaacactgcatcctcacaaagaaagcaaagggcgcacctatctttctactactaaattaacaccgtgtgaagaggacttaaccgagtaggggcaaactgaagcttcaatttgaaaaaacatgggtaaaatcacaaaccttaaaaaaaaggggtaaaatcgcaattacatcttgaaacggggcaagaacacaattgcctcgtaattaaaagatatatataccttgacaaaacaaatcttaaaatatcttaagtccaaataaccaagcaaggacatacattattgtaataaattatcctaaaaattaattttatattgctataaatttattggaggctagaaagaattactaacatctctgcgggcttgcttctcggcttcacttgatgccaaaggaaatcgatcaaatatggatatttaaaatatccataaaacaaaaaaagaagtttcacaaagcgcatacaaaacagtccataaaactgaaacttctttccttgccatagcacacgggctttctattattacaacctgaagcttacaaactatcgacaaatttaaacaattggaattttcatcacatgagttaatagccaaaaaaaatattgctgcatgcttccactgtacagtaaatagattttggatgaaaatcattaagatggtatatggaaaggaagttacaaaattgtatatgctaatcaagttagaaaactcatttctcatgtataagtatgtgaatgaacttacgatttacaatgagaaccatgtatatactaatcctgtaatccaccttattctttgctctaatctcttcctgtaggcaaagtgatctctctttgttagttcatagatcctttcttcctatatagttgatacccactggctataaagcttgctccgcatgcctccatgtcatcagccaaatagagcccttggattagagatcactaaaaatcaggacctttcgatattacagtatttttgcatgtctagccgaataattgcctccttcctccgagcagccgaagcgcatccccttcactacgcatggtgcagcgccaccaagtcctgtacgattctcctccccttcctcttctctaaaacctttggttatctccccaaattcaggtaactgcaaggcatcaactgtggcaattaaatcaattatcaattccatcaacacacttgagttttctcatatatcgatttcttcgacctgcatccggttcctggccgtagatgtcttctcacagtgtttgggtatgacttgagatgtttatcttcatgtttcctttttctcaagttcttttcttctacttttatctaagccccattgatcagcttattgcatcggtttggtattgtttgagctaaatcatgtttatacgtgcagagcgtcagcagatttggttcattggtttcgttcaagctccactatttcccaattagttcttccgctgtataggctttgcactgttcatcctttgtccgatgtacagttaggtccttcatgctacatcttgcatgcattcctactttcctgtggattttatagtacttgcctctaaatttcaccttcagttttcagttttattttctttgatgagatattttttttctaatgcaaaggtgatttatcaaattttcagaactgcaatacgttattctctgtttaattcttattatcggactataccatattatgccagtggcaatcatatcaagcacttctaatattatgccagtggcaatcataccaagcacttttaatcaaagaataaatgaacgcaattctcagcagcgtacagcatcaggcatattctgctattctataaatgtgtcccactaacctgcatttaatattgtctatcttgcaatatcaatttttctaagtgaatatcttgctaccaatttacatgggacttttactaaccatacaaaacacttctacgttttgcaaatgaactttactatttcatcacacttctacattttgataatgttttgcctattttcattaagtactgttattaccaccctacagggtgactttcttggatcatgtcatcaattatgatgtattctttagttgttgtttacccacatacaagctctgatgcccaatattcagctacatgttcagctaatgataaagtgtccaatcataggctaagtgccattttgataatgttttgcctatttttatcaagtactgttattaccaccctacaaggtgacttttctggatcatgtcatcaattatgatgtattctttagttgttgtttacccacatacaaactctgatgcctaatattcagctacatgttcagctaatgagaaagtgtccaatcataggctaagtgacatttcagtgtacaatcataggctaagtcacattcttatgttggacactcaattgtacatgtttttaatttcaggcttgaatatgatctgctaattacacaatatccattgcctccatggtttgtaactatctgctcacacttttatgaaccccgcaatgctccttcactaatcaagtaatcactccagttggtagctagattagggtttgaacggtacttaaaaggagttcagaagcagcacaccacttaaccaggtaaatgcacaacaggtaaatatacaacagttttttttgttagagattcattaattgtgggaaattaagatgttcaggaaatcacacattcacacttgacaagttgatagctacttctagatatacaaatgcactaccgctgagctgagatctgcttttttcaatgaagaactcccgttattcgtaccagactacaggtatatatttgtacaaaacatttatattgcccttcttcagagttgtttgcaccgttcctacccctaattgattactttgttgtgtaatgcttgagcatttgtcagcacttaaaatatcatgatcacttcttacaaatcccacagcaacacgcagggtatcacctagttaaatgtaattgagagaccagtcctcattcattggttgaacttgttgtaaatattttttttaatttttaatatattgtttactgtggggcttcctctacagtgttttgctaaaaaaaaaagagatcagttgaaaaagaagtcaaatcctgaggttattcattgatcatttgtagtggaatttataaaatatagaaaaatgggaaaaaaaaactaatttgataatcagatgtagagatgagacaataacctgaagtcttgaacttctatgttttgagtgcgaattatgaatcatgtgatgatgagcttgccagagttcttcttgcctgggcaactcttcatgatggtggcgttgaccaaactatgcaagtttttgcattgactccctgaaattctactcaaaatcactaaatcagcatattatacaatgaaatataatgtaggatttcttttttttaaaaaaaatttattttagaaatatttttttttcaaaaaaaatgtgaaagtgcgaagatgagactttttttgaagattacccctatttccattaacagaaacaacattacagacaatggcggagcttcatagactaacaagaagtggccattaacatgaaatataatgtaggatttctacataaactaacctgttaaagatggtaatcaatgtctatgaagatgaacatactcaatatagtgtatttgcatgaagctggaggagccataacccagtttatcctccacgaagctctgccactgattacaggatctaaaaatagggtttctctgagctctactcctaacagatgtcttgagtactgagtatcaagaagttgaaatttgatacctttttatctcaagagcctatgcctgaaagctgtacagattaatcagaccgaccatggccttactttgcccatctaaaagctgcatctgattctccaatgatttgccacctacagggctggcacacgcaacacaatcaaggcagcaagtatcgatggagaaatttatctttccaataatatataagcccatttctctgctagtaaagttctcatgtcatgagctactttactttttgaaaccaaagaaactataaatcaaaaaacaaggtagagatttgtacatcaatttcctagtcaattgagctattgtccttaagaccctcaaacagcttctccctttgttatatacgccttcattatatatgtctataaaaaaacacccaacagaaggggaaaatttatgaatatccctgctagttggttgtgttacagtcttgaaaagcaatattttgctatgtccaactaatttgagaaaaaaaaaccattctgaatgagattatgtcgagagcagttgtgaagttgaattgttcagggatgtatgaaaagaaagcttaggtttgatgcaacaaatatgtgtatatgtaagatttctggagtatggattctgaaagataacggtagacaattcaatcaatattttatcacctaaagatcatatgcataatagttcgatgaatacacaccttcatattactaacgatcgccatgacttggcacacgtacaagtcgttgtgtggatctaaaatccagaattcatatgcactctccagaacacatgatctcggcattacaggtgtggagatggacatggaagttcgcgagcaccccacgtacgttgtactctgtggaagagcgacaaggactgcatgatgagttttgtgttcaactactcacctctcacaggaatcacgtactacacccccaccgacgaggacctccacacctgcaactccccccattggcaagcttctctgctctgcgtgctggtgagcttccccgcgccgatgagaccgagcgagatcccccatgtctgctgctctcccaccgatcttgaggacggagcgacggcgaggagacaggggacggcgacctggcagtgggtcctgagggcggcgtcaaatcgcaggcgggagcggtaagtggtgggaacatgtaacactcgaacatcacaaagggcgacctctcgcgaacaaagtgtaagtcgatttcgacgtgcttcgtgcgttgatgctgaacacgattggccgagagctaaactgcactgacactgtcaccagtgtgtcacatcctgaatttcgtttcaggatttataaattatttaataaattattcttagaatttatattaaatattaattaatttacaagtgaagttaaatgtgggaaataaaattttttaaatataaagcatggctggatttaatttttattaaattctccatgattaattatactctctggaattttctcggatttttcggagctcaactcctaattttaataatacaaatagcattttagcaattatttaaatattaaattagtcattgaatggtctgattataattgttaagtactttgagtgtccaattattttcaggatttttcttgaaattatttgagcattggaagtattttaacaaagatcatttcaatgattagtttaattggaaaaataattaaaagtccctttttccttttcgggctgaattgggaaaagtcctcactcgctcttggcccaatctctcccttggccgaagtctgatttgtgtccctcctccttctttctctccggcacctggggcccactctgcacagtgccgtcttcctcctcctctagccggccgatctcatcccgtgccatgcgttgccgcgccgcctcctccatcaaatccggtgcatccattgctacccttccgaaattgattgcaaaaatggattcctctcgatctcctctatctaatcccaagaaaaccccatcaaattcgttatctatcccatgaatttcggcccgttttttatccgggtgaactcgggataaatcctaacttccttcatcgaatccatccgttcccgagccgatctctccctcttccggctataaatagcagcccctcggcctcttcttcggtttccccctgttacccgaagttttccctaaccctagccgcctccgcacgctcgccttctctctccaactccggccaccatctccagccgccttttcccgtcacgtcggccgttcccgatcagtgccgccgcttccctccgctccgcaaggttgatctctaccccggccaccggtttccctccgccaaatcccgccggaagccgctatcaccgtgaaggccgagttcgccgcctcggtttgatctccagccgatcctcctcactgttgcggtcgttgctggttcaccccgaggccgtcttcggcatcgcagcgccaagccgaagaccgtccaccccttctccgccgctgcaaaccatcggagcttcatcgtcgccgtcaacccgaggcaatcatccgtcgccgcgtcttcagccgtgccgctcgtcgccgtccatcgccgccttcgttcgccgtcgccacccatgggatcgcagaagcgagaagaagcccgccccccctctattgctgccgtttcccgccggagcaccgccgccatcgatgacccgaggtcgccgccttttgaagctcgtcgccggccgttttccgtcatcgattgtcgtcgccgtcaccaccggtgagttcctctcgtcgtcctcatgacgtagatgccctcagttggcccggccgagtcctccatcgccggcggttgtgtggtccagagccatgcctgttagtgatgtcatcatgacatcataaattcttaaatttaaatcgtaatggttttctatattaggtgaaaaactgattaaacttcgaaaattcataattaattcatatgaagttggaattaagtggttcaagttgctaaattcatctaaaatcatgatctacatgtttgtttactttttatgtattatttatttggtttttattagttttttttgttttgcgtgttagcttgtcgttatccatcgtttcgaagagtcatgagtgcatcagaaaaattcaagaagactaattgaagaccgattattgcaaggcaagtcacaaagatcccaaataaccctttgagcatgttgaacccatttaaagctattgtttcatttcaacttatgcattattttcgaatgtcatcgggtggtgagcctttcccaaataattatgaccgaagatgactttatttttctatggataataaattgattagctcgaaccttatatattggtttggttcagctaaatgctatatatataattgcttagccatgcttagctacattagctcattaatgggatgaatcatactacattattatttatgattatattaaatggtagctcatgatggttaatcatgttatgataattaattgataattaaaacttgataatggtgggttgtgagcacatggttttgaaggtcgtgatcatgacaattaaggatcggttcacgagctactgttgtgagacattaatcgtgccaaccacaagccagcgtgggcaacagctttaccttttgtatagtatggctcattgcggggcaccagactgtgaagtggtgagaagtccgtgggggtcgctggggagtccatgcctctgtggtggattgtgttgtgcgaggggtactgtcacaatcccgtttcgaggtatcgtggtggtactaagggcatggtaacatgttttgaggctctgtgtcttgtgggtatagtggtacacctctggccagagtaaaactatttgaatagccgtgcccgcggtcatgggcgggttgagcaatgtttttcgtgattagtctcacacctctcacaataattattgatgctataactggtaataatttgcttagcttctggtttggagttagatctgtacagccgggtatggttgttcaggatggttgggcctgagcagcatgggtgtgctgttcagtgttgattaacattgattaattactctactattttacattctcaaatatttgctaaatgctgcttttgcaaatgagcctatattatgccatcctttggtacccttgtgtgtttgcatatttgttgtgtggcttgcggagtattccatgtactcactttgcaataatcaatcaaacctcagttgaagaaaaaggatctagaaggaaaagaagtttggtttaaaccctagttgagctgcatgtgtgagtggagctgaaaccatcgctagtccgttattccgctgctgtttttcttttcttttgtaagtatgtaactgattgatttgtatattaaattttcagtttgtgtacctcggctgattcctggacgaggattttatgcacaaataagttcggaaattactagtgaattttcgggcgtgacaatagatatatgagggcccacacgttatagacacatgagagcccacatgtcatagacacatgagtggcaaatccttaattgccatattttaaaagtggcaaatagttaaatgacccgtgatccggaggagttacgtgatggtggtgcgaaggagattgcgtgtggagaaggagtatgatgggatcgttctgcagcgtccgattttctgatccactgttaattgatcacgtgtctatattggcttcaccatcactagactgagacgaggtaggaacatgtaacactcgaacatcacaaagggcgacctctcgcggacaaagtgtaagtcgatttcaacgtgcttcgtgcgttgatgctgaacatgattggatgagaggtaaaccgcactgacattgtcatagtacaccagtgtggctttggatagaggggagtgcagctcacataagagttgtcgcaaccaactagcctcggtaacaacattggcaacagcatgatactcggcctcagcactcgagtgggagacaatgttcttgcgcttggaagaccaggaatccacatagccggaggtggacttgcgagttgacaagatcagcggcctgggagcgctagatttgaagtccatcatccagggtgccacggatgtaccgcaaaatcctcttgagagctgctaagtgagattcgcgaggatcaggcatgtagaggcacacatgttgagctgaataagagatgcccggtcggttgaatgtgaggtactgtagtgctccagcaaagctacaaaaatctgtaggatctgccaccggcgcgccatcagtggatgatagcttggcctaggtgtcaactggagtggaacagggtttacaatctgcaatgccagcacgctgtaggatgttgagactatactaccgctggtgcaagagaaggctagaagtctgttgtgtgacgatgatgccgacgaagtgatggagagcaccaaggtccttcatggagaactcaaactacatagaggagatggtccactggaggagctatgcagaggaggcagtgagtgcgatgtcgtcgacgtagaccaggaggtacactatgccagaggcacaatggtggacaaacagtgaagtgttgaacttggtctcagagaaaccaatgggcagaaggaatgccgcaaacctgttgtaccaatagaggaacttgttcaggcggcaaaccatgtctagccgagtggagtcgatgaagctgggaggctggatgcagtagactatctcctagagagtgcaatgaagggacatgttcttgacatcaagctagtcgatgggccaactgcaggagactgccaggctgaggacagtgcggatgtgttaacagtgaaatttggtaagccccgaagtcatcttcggcctagattcagtatcggcttcagagtccttgaatcggccgatgggaattatcaagtcgccaatagttgtattcttgctatatttggttaaggaaattaatcaattaaaggaagtttatctagaagaaaatgaattcaaggaggatgcggcatgagagtttatctattaattagggagaatctgttagtttccttttttctttaggaaagtatgtttcttgtccactaaggactttatgttttccttttatctttaggaaagtttctttcttgtcaagaaggactagtatctacctatgtgtataaatatgtacacccagggtcattgtaaactatcttacagatcaatacaagtactctcgttgcatcgtcactctcttttccgagatttttacttatcacggcggaacatggctcctaatgcggggatgcatcagctttcaatatctggtgaaggggtaagtcctatgttccgtcggccctggcaattgtattagctacattagtgttgctcaaggttgcatcgcttcaacctcttggatcgctctggttcggttgatatttttgcctacctatttatcatatatcttagttaatctagtttagcatcttaatttgatcatatcggttgagagtcgtcttagggtttatgctagtatcggctaaattatcatgctagattagattaactaaggtatccaccaccctgaaaatttgccaaaggttgattgtttagactttatgtttcttagcatactttgcgatgcatcatccctagtcatacttagaattataaaggctaacctgtctttgattataataaagggtttcatcggggtttcaaccgatgagttatctggatgttgcatcggcttataatgattacatacaagttggtttcgccgattgcaacaaaggtttaactgattatctaatcatttggattttatgacaccggacctctagccgatgtatgctttaaccatcggatcaatatttgttctatcatatcattattagtcggttggtttctattggattatattgttgcttaattacattattatcaaccgattgtctatatatcattatttacttaagtatcagaatatacattggacatatagccgattgctcaaaaccctatcgacattagttggtatcggcatcggctagtatcagcatcggctagaattactccattggcttgtcagccgatcggctatttcatctgttgtttgcacatgttgacggttgttggatcaaactaactagtacgccctcatctcatctatctttggacctgcattggagttaaggagatctcctcggctgttgtgttcgttgacttagttcacgccaatatagttccggcactatctgccgagcgtggatttttcgtcaacaggacgggtggccggcttgatgactagactgaatgtcttgtcaaactcaaaccgttgagggtgttgaggatgagggagcgatcctggacggggtagctgtcacacccggagttttcccctttcccttagtttacaattcatcaataaatcgcccaaagaaaatgttttgtttaacctggagcaaatcttaatttaacaatgcgagaaataatcggaattgtaacataccaagaattctttgaagctaaaaaaaaagaaaatgaagaaaacttagcaaaaatttgattttgatcttgtccttgtcatttgaagttaattttggtgttcttggattttccatgcacctcataacgcatttgcatgcaataaacataacaaaaaaaactaattaaaataagtggtagagacttgaaataacctttcacaaatctcacaagttttgcatctcaattaaaaagatgaaagcatccaaaatttgattcaaattaaaataaaaacagtgaacttgtttgaattttcaaaaaataaactgctcttgagaaaaatccccaaaatttaccaagtggaggtcttgaccagactaacctctagaaattttagcacaagcttttgagcacattagcatatccaaaaattaatcaaactctcagccttcttggaaatacccagagagaaatcccctcacctcatcccttctcccgttatctctctgatcagtgggcctaaggatcattgggcccacctgccagccaccatccccatatccctgctctctgtctttctcccttctctccttctatttctttcaggcaattcatcgagcacctagcgtgcgagattgaggtcatcgtttccaagccgaccaagcaacctctgcccacgattctcgctggcaaagatgaggcaaagctggtgcacccctgcccgaggccctaccgctgccttcgccgcgtccctcgctggctcgcccaacccggagctcagtggcggatctagaaaattgattcactggtgtcataatgtgtctatcggtgtcatagcatgctaattatacttatattagtgtgttataatatatggataagcagtttaactattggttttgccgaaagtcatcggtgtcgcctgacaccgatgctaacactgtagatccgcccctgctggagctgccgctctcttgctctccctctctccctctctctgcccgagcaacgacgcgacgcgacactgcgccaccctctgcccgcgaatcccgctgtgccaaggctgcataaagccgacgccgtccctgccgattccctgccacgcccaggctccgaccaccgcagccgccgtggccaatccaacaccgtggccctctgcccgatgccgaccaagccagaccgacgcagccttcctcctctgcctcctccctgcgcaaagccgatgccgctgcctccgtctgcaaagccctctgactcacgtctgcaccgccgatgctgcgcctggcaaagccggcctcgccgcgcgcctcgccaacccggagccgccgccccctgccaaagccgacgcacgaagcgacaaggcgagaccgaccgcccctggctccccgtaactatccctgcaccccctctgcaatccctgcgcaaagccggcgcctgctgcaagccgtgttccccgccgaccaccgcctgcgcgcgcgagagacgccgagcacttcgcgacaattccccgcacttgcctctcgctccttcctcgcgtataaatcgaaccctcgcgccagctaactctccacaccaccctcaacctccactcccaaagccaaagacctaaaccctctgattcgctgggaacggccgcgccaccgtcacgccccgcgccggccgaacagagcgccgccgccgaacccacaccatcgagccgtcgcctcggtgagttccctctcgattcctcgcgccaccaagatcataggacctccctaaatccatttccgcaatctattttaggacccctcgaccggagagccgccgccaccaatgtcgccgccgaccgcctagggagctcgtcgccacgccgcctcggaccgtctccactccaaccacgcacggggtaaggattctcgtagtccctagaccctcccctaggaaggaatcgaattgctgtcgatcgtagcgcgctagccgtcgccgtcccgaacctaccgccaacaccggccatggcgctcgccgcctccagccttccccggccacgcctccgcctctagggtgtgcgaaaggaccactctagcttccccggccttctgccgagccatccccgtcgctgctcgtcgccggcgagcacttcccgagccaccgcgcctctgccaatcgagctgcctgtaggttgaagaagaaggaacttgtcctgtaattagggaaattatagggctctttgtgcaaaaaaagccacacactgacaagtgggacctcggatttatatgtaaataataaaaagtatagggttatttacgagacacttacatgtggacccacggttttaaaatgaatacacagaacatgaatacgctttccctgtaggaaaacgtaatcagggcagtgcgctgtagtttctttataaacaaattaataaatctaagaaaatggtttcggttaattatttatgcactataaaatgctgaaactttggaaaatcatagagaattcattttaactccgattgaggtgaaccaaaatttgttagattcataatattgttctcttgaagactgtacactcaaaattatcaccactattgtgaaaattttcactaaattaagtttgaatagtaaacttcgtttttatcgtatattagatattagaaatgcaataacttgcacatacaacattggatttaggcgattctttctcctaaatttatattaaatcatcctctatacactgaacatgttcatgcaccatgcatcatattttatcttggagttttattggatgttcatttgaatgcatgtttaaatttaaatagaggacgaatcgattgttgccgttgatgggagtgcaggactaagagatatttgagtaactcctaatcaaggcaagtcctattctattcctccttcgatcatgttgaatccaatatcttcgcaaatgctttattattttataaattgcatgcgatgttttataaaaaaaatggggtatcggtagaaatgacctatatgctgcattacctaccttgatatattggttatccttactgttgaagcactaggatgggtatttatgtggtagtatccaagcaccaccgtgggtatattcgagctactaatatagctattgcttagccatgcttagaaattcccgatggttacttatgacatgatatttactctttataaatgggataattgaaaaaaaatattgtatggaggggttgcctctgttatttttgtgaaaattgaaatctgaaaaaaaaaatgatgattttaggcttgggcggcaagtggtgtgcatatggtggtagttgcacatcgataggggggagtgtacgcccgagtcgattaaggactgaactatgtgtcaccaactaagattaccgtgcaaccacatgtgttggttatggggcgaccttggcttattaagttgtttactgtttagccttgcattgggaggccgttgtagtagggactagtctgagcgatggttcataggagctacccatgtgaccactatgggtatggttgtgttcaccatatggcatgggcgtctgagcatatccaatataacggatagtgccttgttgagggaacggacaccctctcctgattcagccgattgcctctattgtaaggtcggcttgaactccctgtgttatcactgcacccagggcaatcttcgatggacgacaacctcatcccctcattccagcaaaatctaaagaactcacagtcccaatgaggatcaaacccgccatcatcttcttcgcaatacctctcctgctgcttgtcataccttctttgatatttgttgataatcctggttgaattcaactgagaagctcgagttttcctttcatcagctgatcttccagctgtatgcaccatattaacatggaaatgattaccatcaaccttcatcggcttctttgaatcatcaaacttaatcttccccccttcaatggcaacctggatctgctgtttgaaaactttgcaatcattggtattgtgagaaccagaattatgccacttgcaataccttctcttgcctagttcctcagtcgatggaatcacatgaccagcaggaagttgaatttgtttttcctgaagcaacaaatcgaaaatcttattagccttggtgatatcaaaatcaaatctttcctctttcccagaacttctcacctatggacatggcacaaccttcttgctcctgacctactcggctgttgctacttcggaatcatcctcttcatcggaaccatacatgtaagggtatacgtggttgatctttttgaaatttttcttagcctctgcaaacctttgttcatgtagggttaccttttgtgcaagatgagataagctttcaaactcctgagatgaaaacttctccttgatcgaagttatcagaccctgaaaacccaaatcagctagctgagaatcggtcaaagccaaactgtagcacctattcctcatctctctgaatctctgaatttaatcctgcatagattcatcatgcctttgtctgattgctgttaagtcagataatttcatctcatggattccactgtaaaaataactgtgaaactgtttctccaaatcggcccaactattgacagagttgtatggcaaagaagaaaaccaagtaaatgccgatccggataaggacaaaggaaacaatctaacccttaaagcatcaacagccgatgcttcaccacattgagccaagaatcggctgacatgttcataagttgagacattgtcctatcctgagaattttgaaaaatctggaactttgtatcggttaggtaatggaaccctctcaaaccactcaaggtacggataccgatacaagtttccagtatcctttggcttaagcccaaactgctccctcatcacatctgcaatcatatcggcccattgtctctactgaggcaccccttgcgcttgttgctgtatcggctcaaactggttgaactgaggagcatactgaggctgaggcaatcccccctgttgatagtgaacatgaggcgaaggaggctggtattgataattcaagttacccccttggtagttctggacattcggctgaatattacacactaagtgctcagggataacttgggtagcaaccgattgat

SEQ ID NO: 39886 - DNA, 8704 bp, Oryza sativa
tctgctgttgaatcggttgacctatctgctaccttggcggcgtctgctgaatggatccaccaatcggctgagttggcaaaaacattgaagcaatttgctcttgggacagccgattgatattctgaccaggatgttgcggttgttctttagacaagaggcgaggattattaattatttgcgttggtgccgatgatggtgcagcttgtgctggagtcgaagctgatgccatcggctggattgatggtgcattggtagcagactgctggttaccagttaccaagtttctgtaatttgggaaaacgcctcctggaagataaactggccctgtagcttgatgctcagctattgtaccattaaccacagactttaccatgtttgttaaggtattgactaggactcctgattggttgatcaaagcatgttgcactgcgtagtcaatccgatcttggaagttgttaaactgtggttgcacttcattgttatcttcatcaagatcctcaaccacttcatcctgaaggccgtcacctttattgcctgagccatctgcaatgcctttatcaccttgggatgagcttgagccaactttgtcggcaacaactactttcactttgtacttttggtagactttcccgcgagtttctacgaacgacttcatgaattgctcctgagcgctcttcatcattaattcaaaatccttcttttgttctggtgacaacttgtctatagtgactggaacaatgttcccttcattaacgtcggacccagtcggttttggaatcttggtttgagggtctgacgacttgcctgtcgatggcagaggtggcttttctgctgacatgtttgtcgtgtcccaccaggtgtgccaaaagcgtgttgatgcgaaaaacacgaggcctggaagatctgcttaactttagtgcagttccaaaaatcttacctttaggttcgtgagcgtgccagttgattttatcctgcaatcagcaaggaacaaagacaggaaaaatagcggttaaatctataaacgatagccgatcggtcagtcgccgatgacgtatcatttatctttgagccgatgtcatatttaagtcgatcgacagtcataaataggtaaaaaaagaactaaatctattcgatcggctgaagttattaatgatatataatacttccgtcgatatatacttaaatcaagtgattgggatagatcggtcgccatgccgagacagtataaatcacttaaatcgaaatatatattaacgaggaaattataagcattcatagcatagccgatcaaatagatccagcatgtatcggctaatactccgatactactctatattaagatattaaagcaggcaaaatatatcaaacatgaagcttaatatacctatatgcgacaagatcttagcataaagggcggacttaacatgtcaatcaggcatataagatataaaatagttaaatcaggtaagatcggctggaactctaatgctaccctaatcggcaactcaaaagcaggccagagattaagattctaatcacgacttataaggtcaaactcaactgatgcagctataagtaggaaaagaaggacaatatctagacaatcaaggctttgaatgtttcatagggtggtggatatcctatataatctaagtcaacattgatattaaacctaatcggctgccttccaatgatggatgttggccgattgaaagttaaataacaatattgtcaaagtattataagatatatgataactcgatgaattacataaacaagattagagtatcataaagatgaaagcactaatcccgagaacgcaagccgccataacaagttttacctctagttgaagatcgaaaccgatgcaactcaacccgaaagtaagaactcgtcgaaagtaaacgaaagtaaaagggtggcgatgcgccgagattgtattgaacgtgtgttgtttgattacatgggttcgggtcatatttatacccgagatacaaaatatgtccttatcggacatgactcttatctctaaaaaaactctaaaataccataagtctttgcggcagacttttgcccaaacttatttctaaggaaattacataaaatatcctaactaatagatacaattgcctttttcaggacttaatccgtgcgtggcaatccatatgaagcacattaactcaacccgacaacgtgtaccgagtcacattgtcggaatcggctcaatcggctaaccttgtccgactcgaactctgccgattctggtcgcagctgattcggactttagccaattcttactctgtttccggaacgatctctatcttggattctgcttcagttttatctccatctccaatacttgaattaccaaatttggtcgctaacacccccgtcgacagagagtgtccaccatggccttcatcttgtggcaaatagtcggtgattgaaagatcgccttgatggaaggtgcggaattcagcttcaagcatgagggcgcgctgctcgctgttgcccaagaactggagttcgagagcatgctagacggaccgagtagtggtgacgtgggtcatcgccctcttggagaagatcggcagagatggaaccatagagccacccgaggacaacactatccacctggtgccaaacgatgtacccacctcagcttctaatcctggaagtccttcaaaatgactttgagtcttggatcatcactccatggaccgacctgttaagctcctttgataacctccaatgagcagtctcaattaccaactttgtaaatcctaactccgctgccccaatcctgctgcttgcttacacgcatggatttctatgcacgtcgcatccccaattccactgtaaacatgagcagcagccgccataaagtctcccttctcatttctcatcgccacacctgctgcccctctattttcattttctaaaaagctccttccgcattcagtttcacccgtccctcttctggtttttcccaatgctgtgtcggatgcgctacagtgcccatcttattttcatggacgtttgaccattcctctagttgtgccacaattctcatagctactcctgttggattctctggcatctgagcatggcgtccatctttttgaacagcccataagttatgtagagtcacaaagactgcatgtattacatggtctgcttgatccataagtctgtcaaacacccacaaggcaaacattttatagttgttgtattcctcatttggcaccaagaagttgacgcctagctttccttcccccttactccaaacccacctggagtaggggcattcccaaaacctatggacaacattttcttccctttgacagaacaaacatcttacccctgtcttgattttccttctctgcaactctaagccaagtgctagcccattttaaattaatcgctggccattcactttaattttatacggaataccagcactccataaacgctgccatcccctgcggggttatcccagtttccattccactctatcatttgaaacttagaagtggataagtgcctagctagtggtcaattatggcatagattagccatggatatttgcatatggccaattaattgcccgtcattttttgaaagtaagcatttgttggggcaatcaccagggcatggatgattgatatacgacccagtgaagtatttcattgcgatgacactgaaaatatttttgagaaaaaaacccaataaaaattgttttagatctggacgattggtatttattttgttggattatttatttctggaaaaaaattgggttgcactccatttggatttttagaaatattagcatttaattagtgtcgttgtgtatgagttgcggaacacaatacatcaaaaagtacatcttcacgcactacacacaattcacccatatcaatataaaaataatatatattgcagaaagctactaataaagattaaataaaaaaagtgagagataaagcatgagcatatatacgatatatacaataacatggttgatttttttttaaaaaaacatctatttagatatacatgtataaataaatactcgttcatgtaggtgtatggctgcatgagtcatgacaaaattttcacgttacaataaaaatgtagttacagaaaacattatgctgtgtcaaaaaaattatgtcttttctattaataggaaaatcaaaccgttctatacaggaaggacacatctaataagggtttggtggtctaattatctaatattggaagaaaaccgtacatgtcataattgtagaacagaaacatcgatcgccagctccagatgtcctgcctatggtactctccttgtttggcagcggggaatgcgcgccattgatgagtctatttttctgtctgcccctccatttctgcccccacccccacacccacctgaccacctcctccccttcccacatccaggctcctcctcttggtggtacgtgcatgctcttctcttccaccactacatgattttctttccaattccttgtttgatcctggttcttcctatggacattagtaataattgtgttgctccggcattgtatgttctttatttaatgataaaatgtaagcatcagttatacatcttttcccatgtggactgaggataaagaggctctactttgttttctacctggttcaatacttgttgtgctccaatttcataagattgggaaaatctacatcggaggcagttgcttatttgtattttggattctttgggtggtcggccagggattgtcaaggggatctaggatttggtacattcttggttcattgtggttttttgggcctttataatttcttcatttgatttttgatggttctgattgtgttgcatgtcatgacttataatgggtgcaagaattattcaaattattccagatcataacacctatcttccacttagattacttttctgctatttttttagcgaaatttattctgttttgtgttattcaagcgttcttgtgaattttgggcttggctgtaaattaatgtgttgaatttgtgtcttcaagcacaatctcaggcacctgtaggtttttatcatctggtgtttcaacgttatcattaatttatatgtgtattttataaattttttgttaatccagaaaaggaacacatgttactaaacttataattatactgatggactatgatatataccatgagatgaggctaattagtgtctcacaggcccactgctcaagcattaaaaaattcccagcaaactgagaccttttgtcttattttacactgcatcgtactgccaagcaatactttaggtcatcaagatatttagaaaattattcgttttctcctttattatacattgagacatagcatgtgatataatcaaataataatgtgtataactgttcaggtccagatagagccgaacagtcatgacagaagtcctatcaagacctcttgaacaccgtctaagctctcgtaagtaaagcaaataattgtcacaaccattttcttattgtttaaagtggattattacaccctaataatgtgtatttttttattaaaaaatcattatattatcttctatctcaaagtataaacattattttcagataaagcgtatgcccttttcccaatggtattctcccgcttcactatcaaagaattaatttctaacttaactatttagaaaatatttagaatctggtatattggaatatacatgaccaactgacatacacgatgtgtcagcaaccttagatggtcactatgaagagaagaggaaatccaatgttgaatactcagaggatgagaagaaagccaaaatcatatcgctgaagaagaaggcaatgagtgcttcacaaaagttaaggcattcaatgaagaaggggaggaggagtagcaaggtcatatccatctcaattgcggatgaacgtgatcctgaggaggtgcaggctgtagatgccttccgtcagctccttgtacttgaagagttgctaccatctcaccatgatgactaccacatgatgctaaggtgtataatctgaaaatagcacatcatgttgttatttatagtttcttatgtgaaaaaagtattactaaaatttgagattacataggtttttgaaggcaagaaagtttgatgtggagaaggcaaagcaaatgtgggttgatatgctgcagtggagaaaggaattcgctgcagataccattcttgaggtaattgcttaagattaaaatatatttggactaatccttctatggttgacacatacccttgtttataagcagttgacacatttttcttcaaatcctatctcaggattttgaatttgaagaagctgacaaggtggcagaatgctatcctcaaggttaccatggggttgataaggaaggaaggcctgtctacattgaacgtcttgggcagatcaatgtcaataggctaatgcaggttaccacaatggatcgttttatcaagaaccatgtcagggagtttgagaagaactttgctgttaagttcccagcttgctcaattgctgccaagtgccacattgatcaaagcacaacaattcttgatgtgcaaggggtggtatgtatgtgcaaatatttggataattcattaaatgattgcacttttactatttataatctaagaaaaaaaatacatttttaggggatgaaacaattcagcaaagctgcaagagacctcattggtcagcttcaaaagattgatggtgataactaccctgaggtaatgccttggatgcacaatatattggttgtaattctgcagaaaattttgtgctggatttattaaagttctcgccgcatgtaattgtttttgcagacattgtgtcgaatgttcatcattaatgctgggccaggattccgacttctttggagcacagtgaagagtttccttgacccaaagaccacagcaaagattcatgttagtgttcttccaatactttgtctatgagtgctcaacttgaagattgattatcaataatctgtgcatttctttaggtgttgggcaacaagtaccagagcaagcttcttgaggtgatcgatgctaggtagaacacctgatgctctaagttaaccatcatattcgaagacaatgttcaccattttaattctattaatttatgttgtctagtgagctgccggagttttttggtggaacttgccaatgtgaaggtggttgcatgaaggctgacaagggcccctggaaggatgctgaaatattgaaggtgactgttccaatctgaacctttattatccttgaacaaattcttaaattacaattcataagggacaaggaactcaaaatttctatgctatattatgtttagatggttcaaagcggggctgggtggtgtggaaatcttagtttgaatcatctggatgctgaggagaaaatgatgatttgtgaagatgacaccatgcacaccaaggtagcaaagatgttacacgctctttgcactagcacattcatatttaagtatttctaaatgtattggatcatagtacttagacatctgttattttatttacgtaaaataaagaggcaggagtctttcaaatatgaagggtgcactttgtcacgaaaaatatcctgtgcccgaattgaacatccttcattatcgcctgtttgcgaggaacttcctcctacgatacttcctgtgagttatgctttatcactggtgaatttccactattcttccagaaaatgaaattccactattgtccttctaacaatgacatgtttgtactttaacaaatttaaagtgtgttttttttgcgcaaacaaacttgcagttagtgttgaaccatacaactaaaagaatatttctcacgtcttatggatgaaactagaggttcaatctccctagacaaactagaataaaaaaaatttgagtcttaacttacaagcttaagtgggctcgtcagttgataatgcgatagatatgcacagacaagtaactttgtgatgatctttcagttctaggaaaagtgtaaaacctcaaatacttcccaagcttagtcatcatataaattttcattcttgtggtgtagtggttcatatatttcttttctaaatactttctaagcttagtcctcatataaaaggagtttttttaatgcagaccctaggatcagcttattcttgtgatgttccaatggtagagaaggccatagatgccatttgccagagcaagggattgccagatgagaatgtcacagtaaccaaaggttaaacatctttgcggcctaataatcttgtgacttaatattgttactctctagttagtttttaactaacagattggataatctttttcttgcagcgattgtaaatgcctctaatggatccaatcctccactctatgggggtatcatggctcttgtcatgagcattgcaacaatgctccgtgttagccgcaacatgccaaagaaggtacttggtgctacccttggggcacaaagtacatccaaaatccaagcacaacaactatccgagatatcagtggaggctgtgtcagtagctgaatatgtttcttctacaaagcgtttgtccgatattgaggagaaggtcattgcgattctcaccaagcctgcagaaatgccagctgataaagaggagatgctaaagactgccgtcagccgtgttagtgcattggaggag

SEQ ID NO: 39887 - DNA, 14241 bp, Oryza sativa
gcaggagactcttgagcggcaagaggagatcatggcatacattgagaagaaaaagaagaagaaaagcaaggtaaaaaagggaaattaaaaggcatccttttgctgctgtgttgtgaccctcaactacaagaagtaaagttttgcacttgtcgctgaccggtgtaccaaaatatatgagattctcaccaaataattagtgttgcttgttctctttatgaactcatctactatatacttatgctaaaaaaatgtttttccttcctaatcattgatttcataaatttaactttgccatttgaaatttcacttgcagcgcttgtttcgttggtaatatgcgaagaacaaataccatgggtttgatcaagaggtgatgttttcatcgttggcaaaagacgattccatgtgtaacatataatgttcatttattatttttcctgtgttgctacaattgatcgatctgagcttctctgccttaatataaatttttgcacattgtgggtgcggtattgatgctttttgatgttgtcatcttatggatcaaccatatgagtgttaagaaacttaatcgatttaaactcaaattgctacatcaaccattaatttgaagaagacaaacgctgagatgagtagattattggattgttttacaaacattaaagataggtaatttttgcttgttcttattctcttagtttatcctttctggtgatcaagtaaaacataacatgtttacataacgtgcaacttttcaccggagtaaaacattgtaagatccacccacaaaaactaaataggtggcagacacattgtcacgtcgggaaaaatgctaccattttcccaaacgctcattgtattaatgtaacgccccgatttttgttcgggattaaaaatcattcaataattcattttctagaaattaaataaaagttaaatcaatttaatcaagtaaattatagagggaattaaaattttcctttaaaaatcattggccggaaatattttgtaatattctctgtgccctaatgaacactctgaaattttccgcgaattttcggagctcaatatctaattttaaagtcacaaagatcatttaaccaattaaataaaaagaaaaacaaattaactttccctttctttgtaattgggccgccccggcccaattccccttcccctcccacggcccgcgccctctctttccctctctccggccagcttctctctccctcggccgcccttgcaaaagtccatctttcctccccgttccaactctccctccctctctccccgacaggtgggacccgtggaccccacctgtcacctcctacctctggcctccccatccaaatcaccatggccggccgaaccaccccgcccacgtcgccgcaaaatccgccactcccgcctcccgcgctcgcaactgtcggcgcgggcacgaccccctccacgtcctccaccacttccccctcacgccccgcgaaaatcggcgacgagccacctccaccccaccccacgatgccgcctccactccgacgccggttgccgcccatcccggcccgagccactccctcccgggcctatataaatcatcccccggccatactctcccatttcacctcctccccgagctccccgcgcctttccccgctctccccatgtgcgccccagctccgtcgctcgtcggcggtctccagccgcgcgccaccgccgctcctgccgccgccgtgctgcgtcgcctccactgctggcttcgccaccgcgcaggcaaactcggcctccactccatttccccattccatcgtcggaactccatctccaccataaaaccgagccactgccccttcaaccgcctccagctgcccgccaccgccactctagccactgccgcaccgcgccgatgccaccttcgggttcgccacgtcgtgccacgccccggccgccactccacccgtccattccatcgcctgaggactgtttccaccgtcgacccgagctccaccaccgcctgtgtcgcctcgagccaccgctcctcgccgcgtcagccatcgccacgcaaatccgccgccaccctcggcttcgccgcgctgccccgcacactagccgccactccagatccccaaaccatcaccggagccccggttccgctgccaacccgagccaccaccacctctatcgcctctggcggcctttccttgctgtcttcggtcgccgcgcgcggcctaacccctctctctctccttcctcgggccacgacgctccccggccgccccctcacttgccgggccggcgccgccatcgccgtggtcgtcgtcgtccttccctgtgccggtcatcgtcatctcggtgagcatctccctcctcctccccttcctttcttttcctctctttgccgcaccggccgccgcttgtgcgtcgccaccgtgcctcggcaccgctcgccaccgcagcccgcgtgcgccgccgcttcccgcgccggtggccgcgctgccgcatgccatcgctcggccggccggcctaagccgcgcccgtgccccagcgcgccgcaccgtggccgcccgatcggcttgggccgatctggtgtaacagccctacattcataaccaggtatttagaagtgcatttgttgtcctttagatttcatatttactatattgcaatttgatcataggcgataacaaaattaactctaatcggtaaaattgaaaccacttctatttgaataataacttgaacataagtgtacatgtgtaataatttattcaaatactagtttatttatcaccaacaaatataaattttgtggattttttactctctgtttaggcctcctaaaaattcaaaccaactttcagcctaaccaatttcatcttttcaccagaattaaaatatttcgaatttttgagtgaaactttgaaaaatggaaccaagaaaacaacacctatcaccacaccaaatcccttaatttttgaactagttttacctagtcaaattgaatttaccaagagagggaaagaaaataaatcctggaaattgcataaacgaatctgtactcagtttttcacccacctctctcaccctcatagacagccatgacttgggcccacttgtcactaaccttgggtgcctctttagccccacaacacacccatgggcgtgctcccacctcaggacttaaggggggcagagaaaaccccttcttcttcctcccctttcatcttcactgcttgttctttcttttcttcctcaagctgagctctcatctcacttctcctccccaaatcccatccaatagcccaagatcaatccctgcaagttagaccacaacaatccccatcatccaagctttccatccatcccaacatcttgcacatgcatggagagttgagagagatcgaaataggagaagagagtggtggtttcagcctgcatggttgcagcagcaacatgactttgtttcccaccatttggtgagcttccatgccatccatggtgcctttttttagttcccttcatgttgaacatctacagcaacattcaacaggtcatccatctacattattgcagctaggaggtggctgtagctcatccggtgttaatctcttttgatttcggttgaaacagccctaggcaacgtctcttaccgtcagcccgaggccttgctccatctcttgccatcagcccgaggccttagcctcgcacgaccctacgaccaggttgctgccatgtgagcgaagtccggtggaagttggagaaaagggggagtgaaaatagaaatcgatttttgagatagcttttgagctgaaagaggtttgcgctttaaaaattcataactaattcatatgaactgcaaattcagtgaaccaaatttttgtcgattaagaaaaacatgatcttcagtgttgaaaaataagaatgaccaacttttgtactggttttcccagtaaaaatataaatagctatatgtatcccttgtgtggtctagctcttaagaaattcgtaagaaattattggtaaaagttaaaattgtgaaaccaattttgttgagcttatattttagtactctttgctgttgtggtgttgtttttggagaaactacctcttaaatcatgtttaggagtttatttagcattcctatgtttctaacttttaaaatccataaataaataatgacaacacttatagctgtgaaataatttttcttaggagctgtgagtgatgtacattactctaaaaataatcattattatgaaatcttggtttgaaatgcattttacttgtaatgtacaaaaggaaatgttaatatttgcagaactgccattttcagcacctgagagcttgtcattttcatatctcccaaactataagtgataatctggtgattatttcaactaaattcaagttaaaatatgatctacccactgtatttatttcataatttattgatcattttgcatgtgcatgtttatttggctcttattcgcatattgcttcttttcgatagattcggagattccggggagtaacgagccatatcccgaggaggatagtgactaccctcagcagcaaggcaagcacctaagcatatagaatctatgctttctctaaaaatgatttggttgcaatctatacgtatatatatgcatgcattgcctagatattaatattgtcggtttatggtgtatgggtagaacctatttatgcatttagttcttgtgatattgctgtccttataccctattaccactggttggaattacttgggatgtcttattcattaatgcttagccatgcttagtgctaatagaactatagggatggacaatgctattaattgtggtatatagacaacttgcatttttaggcataaaacttgagcacttacactaaataatggttgatgaaatatgttggacttggacgggtgatagggcgatgatgggaggttggtttcccctgatgcaagttgccccgtctaggtcgttaaggatcgaacattttgacatctaatcaagcatcctacgtattttccacatgccttatttgggatcggcttgttcttactagttctactgtgataatttataccacgttggagagtcgtgaggcaggtagcctttggagggcctcaggtgcctaggtttggccgggggtgtctcccgcgtggcgcgcccgccttggtgacatcacgcacgcacgtgactgagtcgtcgggaaccccagcatggtataggtggttgggtggggctaagaaagggcatgtaatgagcttgaatcaattgtgtaccgcactcgacggggtgtgtagcatttgatctttgttcatttcgtgtgggtccagttgtacacctctgatcagagtataatctattcgaatagacgcgtcctcggttatggacaatgcttgatgtgttagtcagttatgattagcatcaaatgtggattattatagatgggattatgtttgatggtggtgttggcatgttgtgccatgttggtatggactttggtagtccatggttgatgatgagagcgccgtttgggctcatttgcttatacatttcagaattatatacttgctgtccataaattaatatgatgctagatttacttgtccttgcttattttactcattaattgctcaataaaattagctttatacaaatgttcaacctagagacccactataggctaaaaaagcttgcatacttctctcttccttatgtatatataattttgggtaagacttgcgagtacaatcttgtacttaacccggtgtctgcaatttcaggagaggattccgattatgagttatgcttcttatgtggtcattgctctgccgagggcggcgagggcaatgagtgatctcttgcagcttggctcttgcccggttggtttgccctactggggttgtggcaccaccggttttatcttttgcttatgaactctatttgagacttccgctgctatatttatgtgttgtatgttgggacctcggaccctattatgtgtcatgtacctcgttgcactttaaccctattatggtacttgctatgtttattaattgcttgagatgaaagtgtgaggctagtcgcatacctggggactagctaagcatgagtaatgggttttgatcgcttgagataatcggggatagtgctttggatcgagtcactggggtatgcttttggtcgccaccttcgagtggttgacgggcatatgacggagtggactggcaagctatcttacggttatgtcttgcgctcactactcgacattccggttattataacagaaggttgtcaaccgcgatcatggacacattgaggacgagtggctatttatgagtgtatggaacccacttctccaatagtatgtggtggtcgcgttggacactggatggtataatactcggggtgtccacaacggttggtatcatagcaatgccgactgtaggctagagctaagttggcaatttgaaaatgatttgcaaaatatttaacttgagtcgattgtgaaaatcttagtatgtgtgaatcatttttactcctcatctcattctagtgttctttctcaccttattctcagattttccactcatcttggtctaatttggttgacaaaataaatttattacttctcccattcaaatattagaccgataatgcacccggtaagttgagggaattaaactttattctcagtttgtaagtacaattaaaatgtgcaatagtcactctaaaatggtgccttgctgttcctcatgttgctcttagtctccccaaaatttttgacaaattatgaacatgttttaaacctccaaaatgtcaaatagccaaatctggaatttctggaacagtctgtaatcaaataatcactattttgctgtcaaaatttttctggagctaggcaactactccaggaacaaccacaaaaatgttcagaattttatcacttctttagccctctctaaaaattcgtaaagtggctgctgttcggcaacctgagaaatttcagaaccttgtttcggaagaagtaaaatataccaacttaaaaattcgaccaaatatattgcaaaagtgtactcccagctgagagacgctagatagaaatgtgtcatatagcagtagtggccaagttgcagtgttggtctatttgaattttcatgttccgacgattgatacgcttttggcccgctatgttgatcgcaattggaaaactattttggtttattgcttcttgttcgagctttagtataggatgagctcgattgattcttaatgcttcttatttggttgcatcatatcatgctaacataacttatcgcatttgtatataaatgaattgttcatttttattgtgcattgaaactaattatgcaaagatagacttagcttcgcatgcatttgtattgtgcattcatattaagtcggtaacctaaacttagtttatcatgtatgatgcgtgctaactttcaggccattatcaatccttagttgctcccatcactaattatgtttaatctcatatccataggatgactcatcccagcactcgctctcaatcccatgatgctccggagggttcccgaagccgtggtgatgaaccgccaccttgtcctaccatggctgaggttcttatggtcgtggagtgcaaccgtgtggctcgaaacaccgtccttcagcaaatcacagcaagtgcagccgctaccgctgcccacattgcccaaggtgcaggcggtggtggacaccatgccgccgggggactcgctgaatttcatcatactcaacctccggtgttcactcgctccaatgatccacttgattgtcgcgcccggaaaaataccttttccagaacgctagtgtattaatccccgtcccaggaaaagctggggtacaccacacaaacatgatataaaagacacatctttattatatcgataatatttacattattacaaaggcacttcaggcctatggctccatcttcacaggcgctcaactggggtataagccatggctccacctaaacttcttctccaaagctttactgaagggggtgaaagatagagcaagaatgagtacaaccacagtactcagcaagtcacaccgggagatgcatgattaatgcaagggagtacaaagggtgataatataggggttaagttttacaataaacagcatttaagagtcacttagttgcccaaagctattttataaagatgatcctagagctacacagtattattaatcaaggccgtgagcccacacgaacctgccttaacccaaggccaacgataattcagaccgaactggcaacccgacttgggtcctagctcatcccaagccaacccaggccaaccattccacattttagttgttaagcaagttttaagaattaaaccactaacttgggtacattactaggcttgcccataaccgagggcgcggctattcgaatagattatgctctgattagaggtgtacatctttacccacaagacacatctttactctgcattcgacggccgtggaacccgtcataaaggatgtgacataacccctttacccatcctagccatgacaaaagcaccgacccaacctcgcctacagccagaatcccgagacaggtaggtacgattgagcccctagcagcaggacaccggccctgtgtcataacatctcgactaccgagccgcagcccgtgtagccttcatttgccctagagatgtccatcgagccccgacttcgtccatctccatccatgtactctttccaggactagactgagcaccgagttaagccttacccattagacatgtggttagtacggtagtgctttgcaacataggcccgaagaccggtccttatagtggccgaggtgctactagaaaaaccatgtacctcgagcccagcctaaaaccattttgggagttttgaatagaggggggaggtgtgtgttcaattccatcacaagccaaccattccacagtgtccaaatgatatgagaactcccaaagtctaaagttataaaaccacctagtgttgcctaattaatcagcgaagcatctacctaaattcatactagtggaaccgttaatagagtacccactagttggggttttgtttatcctagggtgaacaaggtaataataacaatagcaataataatgtcataacaaaggtaaataggcatggctaaataaaacagtgataacgcgggaatttaagtaaagcggtaatgcaataatttaaatcaaaataattttataaactgggattcaatatgctcaagggtgatgcgacttgccttgcttacagagaacggccttccgaaccttcgacgacgaccgtgaaccacgcttcgggaacctccggaacgacagaagctacgtgaagcacacaagcaaaactacaagcctatgaagaagcaataacaatacataaaaagaaagcacgtggttctttaggttataacaaacattacgagacttgaacaggtcgattcagagctcgtatgaccaatatttggtcatcaagtttaatgttgtcacgtggagatttacggattattgtaattaggctttgcaactataaaacatgtgtaagcactagcctggaaaagacaggaaggctgcgccgttgacatgcggaccccacatgtcaacctaagggaccacggtggaccgggtacacagagacggtccacgggtcgacggaagcggaccccgtgtgtcaaccgaggcgagtggccggcaaacggactctaccagacaccacgcggctgcacacgtggaaaccacgcggctaccgagcaggcacacaaacacggtcaccacacgcacccacgaatgactacagacaccggtacacgggtaccggggtcgacaaccgcacaacgggcacggggcgacaccgaaaggacgaggatggggcagcgagaggaggcacccttaccaccacgcgaaaaggcgcggcacgacgacgacgaatgggcacggcggagacggctcggggacgatggaggcgaacgacttcggcggcgatccttggacgaaggcgagacgcggccagcacgaggcttgacgacgtggagccgaggacgaagacgacgacggggctgcagcagctcgcttgacgaaccactggcggcaaacgcaattggcttgacggagggacgaatgccacgacgaccgggaacgacgggaggacgacgaccggaaccggcgaggaggcgatgagggcagccggcagcagctacacggatgcgaggacggcgcggaacacgccgctgtgatgacgatgatggtggcggcgcagcaagacgatgagctgggtgaccgacgggacgtcgacgacgaggatgaacggagacgacgacgatggaccgcggaggggtttggatggaggggaggcgatgccaaggaagatgtcgccggctcgccgctgtgattccggaggtggtggtggcgcggccgacggtgcacgtgtggaggaagggccgaccggggaaattccggcgaggcggatggagaggccggcgtggcacggcggtgttccggcgaaattcgggcgacgtcgtggcctagccgaggaagaggacggagttccggtgccgggagaggtggtggcgacaacggccgacgcacaggagacgcggcagaggcggaacagtggcagcaacgccactgttgccggcgaggatgcacttccggaggtctccgcgggaaacggagagcatgccggggaaggggaggcgactgcgacgccgggggaggcgatggcacggccggccggctagctgacgcggcggcaggggcggttggagtcggccggtgctagggagtgagaaggaggcggcgtggaggtggctaaagactcggaagggaccaaaatgtaacgaggggaggatgaggacttcgttttatagggcaaggagggagtgccagtcacgggagaggtcaaagaagggggattaaatcccggcgattggggatgggattaaatggggaaagttaggggaactagagaggaagggatgtggattccatttccctaaacaatttgaattaatccggcatgaatggagcggattcgggggaggaattggtgcaagggttaatgggagagaggagagagaggagccggctgggaggtagaagacgaccgggtgggtggacccattggtccggcgcgaggcgcgcacgtgcgccgcacgtgcagaggggcgcgagggagaggagggaggtggcctggggcggcaggtcggctgggccgggatagggtaggggcggcccaagcggaagaggagggaagaggtgggccgggaggaggaggggaggcctgggatagatagtgtggagattatgggtaccccatacccacacggcatggttatccgactagttataggggataacttatatatatggaacatgtaacagatcatgacttgggtgttacgtttccttgtatattacggaacggcccaaagtcctggtttgataatattgtaaagtagatttaggaaaccgataccgtattggttaaggtttctatcttgtaatcctgccccttatcctatataaggtgggcaggaggccctctagggggcatatgagacaactagatcatcagatcgatactacactcggcagattcaaatccccaaacaggagtagggtattacctctcattgggagggcctgaacctatctaaatccttgtctctgcatccatccacttttaggtctcgtgcgctacccccttttattattgccgaattcatgtttcgacagttggcgcgccaggtaggggtgcgtcgagtttcctatcgagaaatgcgatggaatcaactccatgagtcgccggcttcgtcttcgctacgggattgtcacttcctcgtcgccgacaacttcgacaagctctcattctctgacttggattcaaaccagtcaggagagattcaatctaactaagaaggagatgccacttttaggagttatctccccgacgaggcctcatcagttccgctcgaccggagaacaccgccgccgccgacacgcgaagagggagatcgtgtgctgcatgtgcctgcagcggtgtcagcggtggcctcacatcgcgctcgcgatagtgctcatggtgacctcgcgctggtgttgcgaggcagcaagaccgatctctccctgatggcgtcctcggatactccaatctattatcattagattaatttctaatcagattaatttgctctgttgtgctttctctgtttttgcatgtactgacgacgagacgggcggcatccatctgaggtcatctctgccacgtattaatccatgcatgtgttgctggattaatgccggccaaatctccagtcaatcatgctattggcaaacgaaccaacatgcatactgcatatatgcaccgacacgtgcattatacctacagagcattaatctctaatttctaattagatttatttataatcgcaacttaactgaagcttgtgttggctattttgttcgcatgtttggagattccacacgccggggggctgcggaccagtgccgcctttgcgtgcctaacgcggcccgactgctcctagggcaagcacgacctggatgtgacgccgcacgtcgggcgcttcggtcttcacccggccaacacagcccgactacgctgcttccgccgcgggctcgggagtttcgcctttgtgcgccgccgcctcatccgctgccaactgatgtttccgcctgcacggttggcctattatgccatcgtccatgggcgtccacatcttcaccgaccggctggcatttgtcaccgccgactggtgttctcacctacacggttggttggtcacaccactgttcatgggcgtccacgtcttcaccgaccggcttgccttcaccgccgtcgactggtgtctccgcctacacggctggcctattatgccgccgttgttgggcgtctacgacttcaccgctggcctgcctccttcgccgccgactggtgtcctcgcctatacggttggttggtcacaccaccgttcataggcgtccacgtcttcaccgaccggcttgcctttgccgccgccgactggtgtctctgccaacacggctggcctattatgccgctgttggtggggatcttcgctttcaccgtcaaccgccttcgttgccgcctactggtgtcttcattgttattgatggacgactttgttcccacgctggtcacctctgccatcatcaagcggaatattacgaagctatgtcatcattaattttctttatatgatatttttcttttcctctgcctcactacgtcaactggttcgccgttgactagtgagtcgggggctacagatgttatatcatattttttaaacaattttcataatatttatcttgattgcttgcgacatattctgagtacaaaagtgcctatcgagttatggagttccatcttcctatgcttttcgtttggtttgccaatagatagttgcctttgggccgattcctagcacccgggggcttggtggatggaccgaataacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccggtgcttggtggctatgactagtcgggcagagtgtttaaacgtaatgagtcatctgctcggggaaatcaaaattgacaagagaagaaatacatatttataaatattttaaaatacttgaatttttcttgagtattatatttatatcagatactactcatcctatatgtttgttctacaggatccagatatagatatgcataaaagggattcatggctttaagcttatctcttacgatccaggaatggatcagtcagaacatcaccacaggcttgctttcgccgccgccgactggtgtcaccgcctgcacggctggcctattatgccgctgttgttcggtgtcaacgtcttcaccgaccggtcgtctcgtccaccgccgactggtgtcaccgcctcaacggctggcttattatgccgccgttgttgggcgtctacgtcttcaccgaccggccgcctcatccgccgccgactggtgtctccgcctaaacggctggaatattatgccgccgttg

SEQ ID NO: 39888 - DNA, 1060 bp, Oryza sativa
ggtgtcaccgcatgcacggctggcttattatgccgccgttgttgggcgtatacgtcttcaccgaccggccgcctcgtccgccgccgactggtgtctccgtctacacggctggcatattatgccgccgttgttgggcgtctacgtcttcactgactggccgcctcgtccgccgccgactggtgtttccgtctacacggttggcttattatgccgctgttgttgggcgtctacgtcttcaccgattggtctcctcgtccgccgccgactggtgtctccgcctatacggctggcatattatgccgccgttgttgggcgtttacgtcttcaccaaccggccgcctcgtccgccgccgactggtgtttccgcctgcacagctggcctattatgccgccgttgttgggtgtctacatcttcaccgaccagctgcctcgtccgccgccgactggtgtctccgcgtacacagctggcatattatgccgctgttgttgggcatctacgtcttcaccgaccggccgcctcgtccgccgccgattggtgtttccgcctacacggctagcatattatgccgctgttgttgggcgtctacgtcttcaccgaccggccgcctcgttcgccgccgactggtgtttccgcctgcacagctggcctattatgctgccgttgttgggcgtctacgtcttcaccgatcagccgccttgtccgcctccaactggtgtttccgtctacacggctggcttattatgccgccgttgttgaacgcgtacatcttcaccgaccggccgcctcatatgacgccaactggtgctatcgtcttcacggctggccacgttgccaccacgactaataggcgtcatcatcttcaacacaagctgtctacatctgctgccgactggtttcttcacttccatggctgcattattctgccacttttgattggccttatcgtcttcaccgccggtcgtctcgtctgctattgactggtgtccttgcctctacgtctggtttataccgctaccactattgatggacatcatcgtcttccgccgccgactggtgctt

SEQ ID NO: 39889 - DNA, 17991 bp, Oryza sativa
  unsure (1)..(17991): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagctccatggaaggaagaacattggtaggatgcattagctacctgctttatctgcatggatccaatgtcgccctggccgtcctcgaactcgaccagcagtgacagccagaagttcgtcgagccctcgtttacacggaaggctatgttcttcccgccgtacttgcacgcagtcctggtatatttgaacactgcactggtcagtttcgtcgaaaagaaacacaaaatttcggggttcgtactaactgttagttgaatggacggtacacgtggcatgcgacagcttttctatgatcaggtagactgatgaacggagaagcagcattggcaaaggaattatagacaagaggttaaatgccatttggatatctgttgctctgactgagttatatcaagcagagctgcagaggcatgtgtaactcagcagcaggcagatctaaataaggagctgagctagcacattcaactctggacgattttaattccctgtatgcgcgtaggcaaatcactgtgctagaaaaaaaatttcaggcaggggtccagtgaccatgcatttactttgcctgtggtctctcctaataacctactgtagatgcatagctaggggggaggttgtagatacacatcgtaacgggccaagtgttatggccgctgctcatctctccaaaaggattcatgccatccgtaagaatcgggttacgttgttgcatgctgctcaccttctgtagacgaccgacagctggcctcggtctcgcaggtggccgccggcgccggcgaccgccatcctgctgaatgcggcgccgctgaggtcgaagtgcgtgcggccgaaggcgcacagcccgccggggcactcgtcggtgacgatgaccgtgacggcgcggcgggagcagatgccgtggtcgaggcacttcaccttgtagcaggcgccgcagccctcgccgtccttgaacagcaccgggctcaccgaccccacccgcgccttcatcggcaccacgtccaccagcgatccatacccacacgccccgcctgaaaaatatgacaagaaaaacgttttgctttggttgaacccaacaaagaaattatcgccaatggcaatgccaaattgcactatactagattgtagcgtgcaagaactggacggacgccaactgtttggccgtaatcagtgatcacagagtcaagcatgtggttacagaggaaaaacagtagtagtactacaacggaaacagtcaagtcagagcatcaaagcttaattacagaacacagagcaacttgctgtaaacagggcgaatcagtggtggaggaatcacaggttgtactgttccgttgcggtacgacgacaaaactgtaggtagtctaatgcaagatgttgtgactgcaaagcgtaaatggcagtaaaaaaacttcacttgtactactgattcgctggattttactcgtaacaggagtactatatttaccagcagtgtcggtggagggacgagtgacgagcaattgagtgcatttatcgtgaatatctcagccgttggtaccgagtaaaaatcgcggggagttattggaagacctgacacggtcttgctggttgctgggctgaacgcactgaaagcctcgcagcacgaatcgtaaagcgccggagcgactcgatgattgacgcgagtacacggtgtgtagcgggggcccgccgaaattccttccggatctcacgcgatccgcggacgccggaggtcgcgccaaaaatgccgtaacgggcggaatcattgtccccgggaggagaatgatggaaaaactaagtgcatgttcacttcgatgtcaaaaaaaaaatcttactaaattgacaacttgctaaaattttagtaggattttttatatagttataaaaatttggcagcaaactaaatgtagctatttttttttataattttaccaaaatttgatttgactaaaaatggcataaagtgaacagccgcccgatgcaaatgtgacggatgcgaacacaataatcctcctacttattttacaggtatctattcctaattatcagctcagtgaaaaaaaaatgcgaggtacagtactactacgaaatacagtactgattcctgcgtatttgctcatatggtatatgcttccaattaaatgctacaggaaccagtatgctttggtactctctactgaactgtgaggagctgaaaatggagagacgagttcagagagtttaccggtgctgccgtcgccttcggcgtcgccgtaccacgtcgcggtcgccggccgccactccatgtcgaccgccgccgcagccgccgcggacttggacttcccgccgtcgaacaagaacgaggcggagatggggggcgcgagcagcagcaacagcagcagaacgcagagcgagaaggagcgcgaggaggcagccgccattgttgggtgtgggtgtggttcccctttcctccccttctcgcactccccctccactcgctagcactgcggctgcggctgcggctgcggcggcttggagttgggagagttggtaggcttcgttttggggagctttccccttttatggcttcgagaaatcccaagccccaatgcgcggcagagatcagaggaatgggtcgctctcgcttgggcgcttggctggctagctggctcttctgtacaaatggcaatgcagggtttagcgggcaggggggctctgggcgtgtgtagtgtaccacagtggtggcctgatttataatggaaagctggaaaagaaataaccggcgagctgcgaggtgtgcaagtgcaactgctgtgctgagacctctcgctccatatgggtgtgggtgtccagtgaccagtgtgtggatgggcagtggaagtgtggaagtggaaccccctgcccgcttgtgaagctagccgtgatgaatagccttgaccttttttcaggaagagaaccgtggagagagagaaggggccggggaaaggcactgatgactgagcttgtattattgcgtagctatactagaccgttcttttcttcccattactacagtgtgtttttctcgtgtaccactatcgttacaagcactgtaaaacaagcatggccgtggcttttctcgtcacgctttgtcgccccggacactccgggcagtgggcaggcaggcagcgggcagctcctctcgtctcgccccatgtgcgcgcgacgtgctgggtgaccgggtcgggcagaccgttgatgtgcgtgacccaccgtgcgtgctgcatcgggttcgcttgaccgttgccgttttcacgtcactactcaacggcacaacacgcgccacaggaagacagtaccagactagcagttgtatttttaacagtagttaggactggtttagtttgagagctaaattaggaatttcaatatttgttaattttaatagtgtttagtatctatttgatttgaagctaaattttagcatatataagaaaatagaccattttaatagtaaacttatacaattttgccttaccaaaattagttatgtcaaaatttactaaaatttagcattgacaaaatttgataagacctatttagactacaaaccaaaccaacccttacggccctcttttacaacgtgggagtgggatcgcggtgacaccgtatgtattcgcggccgtatttttagttggtcgttggcttttgcagccttttccctccggtgaacgtggaggcgaacgtgtccgactgttcgttggcgccagacagctcctcactccacaagaagtcaggaatgatctaccgaggctgagcactaagctcgctgttcgtgatgtgtaatctccgttgattttccgttgtctattcctccagcttagtacgcgtcaagcagggcttatttaagaacgagcgagaatctgtcattctgtctttgaagccgtcacgttctttgattttacggcacgaaacaaatgatctgcccaagaacgagcacctctcactctctgttaaacgatgatggagtacattgcgtgtcaaagcgtggaagcctaaagcggcgggaagggaaggaaggtacacagcctacgctgagtggtgatccagaaaaaaatagcagtagggtacttcctctcccatctacatatgataaaaaattttagtgggatcttcgtagaggctcttattatctttacattaatagtgggggctcgagactctgccgcccccaatgctggatccgcccaggtgaagcagatggatgcctttctggtctcgagtccaggctagcagagggtacaagtacaacagccaaggggtctgtctgttcatacgcaacgagagatccgatacaatcgcacttcttcgcttccgttctagggacgggtaaactagtgcaaagtgcggcagctgcatgcaactgcaagagagaatctcgatccttggtcaatgaccgggttggagaccgttccgaaaagctccaagagggagtgacagacgtcgcggcctccgtcgcacgtggaacaaagcaaaaggacacacgagaacctgtgctacaaggtgagagtatatacacggcccaaaagataaacaagacttcctgctggatcggcccattttcagagccttcggcccaccatagactccctgtcatccgcgaccagccaccagccgcgagccgccgcctcggctccgccgccttgctccgtgctccagtgctccgctcctcctcccttcgcccctacggctctcggcggtgatcctcacggcatcggcgcctttccatcgcctgcggctggccccgcggagcgcgggtagggcgctcggcagctcgctcgacgccgttgcgccgaccggtggtgccggctcgtcctcggcgccggcggcttgggctcccgcgcaccctccttcgtcggcacaacggcagaaaacgaagctacagaggtgaaatgaatccccagtccgctgttcttactattcgatttaccagctgttgattttttaatctatattgctgaacatgaacctgaatgtactgtctcttgtaaaatcagttctctgtttaccttgcgtttagcaggagtggacttgatacaaagacacacttattagtagtgaaaatgctatattgtgttttcacttatttaaataagttttgtgataaatcttactgtactaattggtctcccacccgtaaaccttgcagatacgttggttggtatcttggtgaattcagggtttattgctgattaggagaaattccttgttgaatatgtcagagactcacgagaaagataagcaatttgagaaagaaggagaagaaggggaagaggaagagtatgtcttgcttgagttggatgattgtctttattccgacgtgcaaccaaatgcttcatatgtgctctctgtaagttcatccttctccaaatcagtggcataatggaacagatggcatgttttgagtttacaatttttttttctctgaatgttagattttatagatgttagggcctggggtaatgtaatatctagagatggctctaaaatcaaacatcaaggaagaggttgcttatttcgcaaaagaaaaacaaagagcctggttgatatttgctgaagagaggaatgtgtatgggcatatagctggagtagtgagcttgatgctgattacctaatactccatccgtcccaaaatataagaacatagtatgggacatttcctagtactacgaatctggacaggttgatgttccatctggtactaggtttttatattttgggacggagggagtagaactcttgccattagtttgagaaagatttaaactaaaattcctaggaactaaatttcatggaagcgcaaaaggataaagattcataagtttcatttattttcagaaataggaactgaacttagttcagttggttgacttgaacttgggtgccttgtctattaaattgatactaagtttctccttaatatccatcacttgtttcatgtgtttttagcaaccttcgttggcatatatgttcagaattcttcaaagtcctttctgctggcaattggtattagtttcagctacaaactacatagagcttctagtgtgtgttatttagccgttcgattcccagcaatttagagactttgcacttttgtatcatgatttatggacgtgcaaacaccaatgttttcacatgctcatatctattttaaaatgtttgttcagttcatttatgtatacttaacaagtttggtcatgttttccagggtctggatacattgactcctaccttgatactaggtgatggcctgaaaatggtgagtactttattagtttagtttctcttttatcgcttgacttcttgtttgatcatgcccctgagatgtggagtatggacttgttgatagtgatcgagatcctttgtgccctagattcattacagccatacattgcctgtaagttcttgcgagtatgcactaatgtgtcatggttcaagctttacctgagattatactagaaaatcagcgcgcctgttggcgtgcttactatatgaccatcatgtgtttattttatatgcccattagtcaatggcacatacatatgttttagtgaaataagttgatttttttgaattttctacaggagcttcaaagaacctcttaatgtgttttagctttcaatgtaatctgtatcttataatattgtagtgaagtacttgaaaacagaacataatatttccttttttctaatgctacttttcctcatctatttattttttattagtgaccaaattaatgaacctgtaaaggagtaagatggaaaatacataaatatatatttagtgcataatcagatcactgagctagttgggtattgaaacaaccgatgaagaataagagagcagacttctatttcattctagttcagatttgagaaagttctagacttccctttcttaacctcttccctctgtttttggtgcagcacaaatgagtttttcatttctttttttttctattagtaattgcttgatttatctcagtttttatagtgccatgtggtccaatcacaatctggtaaaactgccggcttgagaataataagattcaaaaaatatactccttccatactcataaaggaagtcgtttaggacaatgtttaagtcaaaccttgggaatataaatcatgaataactctcaagattatatgaggtttgaaaatataaaaattatatgaatagatttgtcttgaaaaatactttcataaaagtatacatatatcacttttcaataaatatttttatagaaaaaagaagtcaaagttgtgttttggagaccgtgtctctgtcctaaacgacttcctttacgagtatggagagagtatatttcaatacctcctacacgatcaaaagttagaacatgtttaactcttgttattggaaactgtctatgaagtaatattcgttaggaaaacaggtaatactgtactcgtgtatcttagagtcctgacaggacaaggtggacatatgacacatttgaataccatacgttatttgttgtagcttcagtgacaacgtacaacaatcaatgcattagactaaaaatatcaggttgacgctgattgctttgcatctgctcaggagactcgattgggtttttttttcctctgctaactttgacttctaaaataattggtttgaagattagcggtctgtactttgggtttcaaattataaacctgtttgctcattgaaacactaaacctccttgctgagctagctgtccgttaatgattgtttaatgacagattggagaataccaagagactattggcacatgctatttgttctcagaaacaagtaagttcttttattcaaaccattacccccttttcttcttttttgtaaattaaccggccttagatgccattaactagtatattgatttgatacctgtgaagatgctgttgttgacatgatatttcctgaagattttagatggtagctttataatttatacacggtcctacttgcacctcgtgttctaaacccccattagtgaatcctctattaggatatggttgaatcaaaagaactttatatatatatatatatatgttttgaccttgtcatcaggcagtttaatcaatgtttattaggacctaggagccccttgttgcagatagtgtaaagaaaacttctctttcatctaatgctgtttttacagctaattcgttcaatgttctaatccctttttattgtcagatgctccaccaaaacccattcacggtgagatggcacctcctgaagaaaacaaggacaagcaagccagctgtagcaaggaagtgccatcaaaggaggtgaagcatctcgcaagcgttcagaagatcctcaaatttcgctctatcaatgcggatcatgagcagcgtagagcctacagggataatgagagagaaatttgaaacagaacttgtagcgttttttttttctcatcaccaacttgtacagtatttatgctcatctcactgtggtcctctaatattattctcatcttactgtgacgctgtctagcttggtttagcttggaaagttgcaatatatgcgaaactcttttgcctcactgtaaacatctgagaggcttaaaaaaatcgagcatcatggtggacaaaagagcgaggctgtttttctgtttcttaactcttataaaggagtttagggtgtgtttagttcacgtcaaaattagaagtttagttaaaattagaacaatgtgacagaaaagttgaaagtttatatgggtaggaaagttttgatgtgatggaaaaattaaaagtttaaagaaaaagttgagaaataaaccaggctttactgctgcatgctatccagcacttccctccaattcttttttaccctcgtcgtgcgcaacgaaacggatctgaactgaacctccacaaagtctttaaacatttcgatgcgaatctgcacccgtaccacttgcagcatagaaaatccatggccatggccgccgcgaacgtggagaagactctaaaataaacgtgaaagtccaggcatatgcattcgggctctccttcattacatctgaacgggtgcagagcgcgcagcgaagcaatgctgcagctgcttgccacaacatcaacgcccctttcccctgtcaagatgaggccggcggcggcggcaatggcgacgaagagcgagtaccggaggatggaggcggaggaggaggaggagctggacaaggaggagtgggcgcgcagggcggaggcgcagcgccgcaggcgtcggagcggcgggagatacgtcttcacctgcgcgctcttcgcgtcgctcaacgccatcctcctcggttacggtcagtctccctctcctgctcgatcgatctcacctcctccttgttcttctttctcctggctcctgccatgattccaagcttccaactccaagcttcagcagttcctcttaaaaaaaaagctttgcgtgatcgagttaaacgcttgaatcatgcgaaacttgtggcgacgcgaggacacgaacttccagatgggccaaaaaacttgccagttggttgcctggttacattccaagtgtgttgggagttttatttctcgtcggttaggtacgtgtacattgtacagtgtactgagatagttatatatatgcgagcatgctgtttgcaactttgcaaggaaatgtcggttgctacaaagtgttaggcagacgaataggagcctgtgatatgaatgatattgttgatgtagttacatggaactttctgtgatttttcgtcgtcgtactcaaggattgattagtccaaaccaccatgtctttgcttaaacttgtaggaaagtgacacctacaaattgtactatactactgttagttctgttgctgatttacacatttacaacagattttttaggtcaggttacaccaaattaaagaatttagaccacttccgagccatccatcttccacgataaaagaatcttaaacacaacccagatagttttttctacgctctaaatcactccattctccagtaacacatcactctcatggtcgatagaatagtcatatacggtaggagcgtccggacacgtagctcgtccaagtccagctcccgaatttttcctgtcaaaaccgagtggttgaccctgacaaaaccaacagaaatgttgatcaaaccatgaggaaatccacaaatttatttggagccctcgagcaacccacaagaaacgaagttggattcaccagaccgttccgagaaaaaaaacagggagttaacgttttgtcagtttcaattcgggaagtccaatttttggcaaaaaaaaaacaaaacaaaacggtttttattggttttgtaaaccctggttctccttctatactactctctcgttacataatataaagatttttagggttaaataaaataggtagaattaaataggggaaaattgttattgattgaaaagtggaggtatatgataaaattgaatggtggagggttgtgattggtttagaagagaatgttggtgaagaagtagttatattttggcacaaatcttaaggactagaagttattatattttgagatggagggagtagttgataccccgcgctttgctacatgatatgtagatgaatgcatcttatgtattacataactagtacatgtatatatgaaaatgatgtgaaaataataatttgacgttgtttgcatattatttaaaatactctacataataattactagtgagtgatgatgtgacacacttataaatattagggtgagtttgagagggggggggaagagaaaattaagatacgcaaaatgaggtgagccattagtacattattaattgagtataaactattttaaacttaaaaaatagattaatatgatttttttaagcaactttcatatagaaaatttttacaaaaaacacaccgtttagtagttcgggaagcgtgcgcgtggaaaacgaaactaactaactcacaaaactcctcctgccgaacgctccctagttttaggagttagtttatagtaatattaggattatgtacaagagaaaaatggtgaagggatcatcttgcaaatatttatagtacttgggatcagaatacacaaaacattagagaaatggaaatcctctctcctcctgtaggaaagggaacaggcaaccttcgagggcgaagcacatcgacatctcccacctttctcgcgcccccattggattgggggcgtccgccattgatgaccagctccgaatctagtacggcgaatcgcccgcggcaaggagcagcgtcgccgtcgcccgtggatcgccgggagcccggagggaggcggcgatggcgggcgcggaggccgccaatggcaggaacaagtacgcggttcttgatcccagcgacgagccggaggggcggaggaggccctcggcgtgggagcggaggagcaaggagcggttcgtgctcgcctgcgccatcttcgcctcgctcaacgccatcctcctcggctacggtgagttcttgcaatgccgttggcgtgcccccctccccgtccccggggatccgagcttacgaataagaacagcgcatttttcttgcaaattcgtgcgcccgtgagtggaaccgcagtttcgttccgacagtgatagcacttcgttaatcgtaaccgcttagagagcatgctttccgtacattcacgagaaaaagaaaatctttgatttatttctgaacgctatcaacgacgagagagagaggggaaagggggcaaagtcgcagttcttatgatttgatggaaatgttttgttatctatagttatctggaatctggatggtcctcatgcaggattctgtccttccttgctccaaaacgacgagcaaatcagcatctgaaataggacaactgagttattaaaattaaagattccaagggattgattccccgcagctgccaagatcttttataacccagtgctcatgttgtatctgcagatgttggtgtaatgagtggcgcaataatctacattcagaaagatcttcacattaccgaatttcaggaagaaatcctagttggttgcttgagtgtggtttcactcttgggaagtctgtcaggaggaagaacatctgatgcaattggcaggaaatggacaatggctcttggtgcaattgtcttccaggctggtgcagccataatgacgttcgccccttcattcaccgtgctcatgatcgggaggctccttgctggtgtgggcattggctttggtgccatggtatctgcagtctatatcgctgagatatcccctgcagctgcccgtgggactctcacatccctccctgagatctgtatcaatttagggatcctccttggttatgtttccaactatgctttctcgggcctttcagagcatatcaattggaggattatgcttggtgttggtatcctcccatctgtcttcattggatttgcactttttgtgatcccagaatcacccaggtggttgatgatggaaaagagagttccagaagccagggcagtattgctgcagataagtgagtctgaagctgaggttgaagaaaggattgctgagattgaggaagctgcaaatcttcttaaatcgacgaaatccgaggacaaggcagtgtggatggagctgttgaacccttctcctgctgttcgtcggatgctatatgctggctgtggtatccaaatgttccagcagatcacgggtattgatgctactgtctattacagcccaactattttcagagatgccgggatcaagtctgatcaggagcttcttgcagccacagtggctgttggttttactaagacagtgttcatattggttgcaattttcctcattgataaagttggacgcaaaccgcttctttatgttagcaccattggaatgactatgtgcttatttgtcttggggattgcactcacattgcaaaagcatgccatgggacttatttctccaagaattgggattgacctagcagtttttgcagtttgtggaaatgtggctttcttttcaattggcatgggtccaatatgttgggtcttgtcttcagagatatttcctttgagattacgagctcaagcatcggcactaggtcaagtaggtggtagagtgagcagtggtttggtttccatgtcatttctttccatggcccgtattatatcagtggcaggaatgttctttgtctttgcggttatctcgactgtctctgtggcctttgtgtatttctgcgtgccagaaacgaaagggaaaactctggagcagattgagatgatgtttgaaggtgggaaagaatggagagggagtgagatagagcttgaggatacacaacatttaatacagagcagcaagaagtctgtgtctctaggctgacactattagaaacaataaattcgaaatcattcgatgttcaatgatgaaccatacttatcctgcttccatcgcctacgggattctgaaattcaggtctgcaaaatgatcaggctgccttggactgctacggattttgagggcttaacacgagtatattaggtgtaggcgcaaaacagcatgtaaatgtctgctttacacaactacatcccaaaatgttacctgggaggacacagatgatgttgtatatggcggtatcttccacctaccaaaaaatatagttgttgaagttccttattccacagtttaattttaatagaggaagaggtgtgtgatttccaactgaatgaattctgtgtgattcttgatccagctttttgatttagtccttcatgatattgtagtactgtggctttgttggtctagtataaaaccttcaagaccatgccatgtctatagctttgcattgacgtgcagagttctgtaaataccagatttggatgattcattctgtcaaattaattatttactgaaagtgcactgtgactctgtgagtcaaagattagcatagcttcatatacatatttttttttttttgccgtgccgacaaaatcttacaagtgcaaagccactgttattttgtcattgcttacctgccaagtgaagatgtacattttgtctgacatcccacatattccaatctcgttatctctttgcatttgtgcaactattcatactttgcaaacatggaggaattgcagaacaagcagctgtctgagagtaaccttccaatcacactgccctcctccatttccaggctcctgctctccctgttccacagatggatgccaaagctctcacctttgatgctctcaaccttggccttcacccacctctcgcccttcctgtccttgggtgcaacgaacagcccgccgatcttgttccagtcgacggggtagaacgccgccggcggcagcaccgtcaggtcagcctccgcctccggcctccggcggcgacgccacctcgccgccaccctcgacacgaggtacggcccgttgtggccccacttgctgccgtcgaacttggcggcgaactcagcgatgaactcgcggagcagcgggtggccccggtcgaacaccatgacggcgttgttgaggcgcatccagtcgccggtggacgcgtccacggcctgcgcgccgatggcgttgcggaggtcggagaagggcctgagaacgacgacgtcggcgtcgaggtagacaccgccgtacttgtagagcagggcgaggcggaggaggttggagaggttctgcccgagcgggatgctgccggggctgacgtccccgcgctgcaccgcgcccagccacgcctccgccggcgtgccgttcaggaggtaggccatgtccggcgaggcggcggcgacgcggaggccgcggtcgaggaacgggccgagcctgtcgccgccgccgtcggagtccatggtgtcggaggcgatgaggaggcaggcgtcgcggtgcgacctgaagaggctctccacgacgaggagctcgcggcggccgaaccgcgcgagcggggagagccacgtcatgaaaaagcgccgcgtgcacggccgcggcgaggcgaagagctcgcccgcgcgcgccgcgaaccgccgcgtccggggagtctccctgagcagcagcttgaggaggctcttgttcctcttcgcggacgccttcttgttgctcttggcaggagaagcaggaggagccggcggcggaagaggaggtgtcggtgtcggtgtcgtcgtcgtcgtcggtgtcggcggcggcggcgacgatgcatggaaggctcgcagcgacttgtccatggatacatcaagtgtaggaggagcagcggccaccgtcgtcgtagccatcgtcgtggcattcggcctcgaagttggccgcgggaggagtgggcagagcaggaggctgaaggtggtgtgcgagaggaggaagacgagggagagaagcaggaggaggaaagggagggagagggagaggaggagcaatggcaatggcttccgcggcgtcggcggcggcgccatcgtcggaggaggaggagcaggcgccatggcgttcgccttggtggcaactggcgccatgtgcacgtacgtgcaccgggcgcctgcctcttggagccaagggattttctgcgtggacccttcgaagcaggggaagggagagcgcgctatcagcgtgtgccgctgcacaacacaagcacaatgctcgccgataggttaaaatttttctttaagcacacttgctagttttgtggcgttttgttttggagaggcactgcctgcctcagtggtgtcaatgtgtggtgtgctgtcatgcattctctccaatttaagtctagtgtatgcttttacttagtacggagtattaggatatctgtacatatatgagtctttttgtgtccacttccaacttccaagtttgatttgcgtttttccttaggtgcatcaagtttatttctgaagtgccttgcatgcatgttctgatgatgtaacaggctaaccgactaaacacttaaacagtatataaagtgaccactacttgatctcataaatcatggctaaatttttgatgcagtaaaggagagcaaatgagcaaattagaccatcatgatcctaccttacgtactgctaacttttacatccagtcagcttatgtatgatgtatcataacagacagcatattggatatatcagcattgagaaaacttcgcattcagatcggcacgcccatagcattcaggcagcacgaaatgtgcgatgtacgcagcttaattggattagataatcgacttgcatgtggcacgctataaaatttgacatggtatataaactgaaacagctaggagataagtcaaagcttggcgatgccaccgtgcgaggatctgaatagatccctctgaaaaatatcaggaactactttaagaaactactaatcgacttatattgctgggtgaattccttatagaaagtagaaactgtccctcgacttatagtgcaggacatattttgctagcctcaccattgcatcacagaaacgtagttggagtgaggtgcagtagttagatcaaggaattggcgtgacgggattatgagataaaggacaacaataaaaatttagacctgctattctccagaatttgcagtctttactacagcttgtaagttacaaactactccaattttcaccagaagaacctctctcggtgccatgagctacataaatttgttactcctatttgtgtttggatcagaatcttacacagtaagattaaatctgctgcacttaatcagaactttagacaacggagaaatgaaatatatgctaatcataaaccagataatggtagattggatatgcacacaatcatatgcaagatacaagcattagaaatatcattcgagttatccattcatctcttcaaagttttaaccgtaggttactctccatatctggaaatggatacattagtaaatttagcgaatgtgactcaaagttcataacctggaaacctagaatcaagggggttaatcatgtccagaaacaggtaagccattccaacttgtccttcaaacaaggaatacggctcatcaccactgtgcatgatgccatccgcaatcagttgtttagctcggtcaaggagaaagcaagcgaaagctttagcacggtagaggtgttccttctttttcgttaggcggaaaagtgctagaaatgtataggcgttcccacttactccatggcatattccaactcttttgagcagccctctattccaaacaacctctgccgcctctgcaattgcctcaaggaatcgttcttctgggaacacctggtaaggatatgacatagtatatgcagaatgtaacagattgccagaacgaaacatgcagccaaagcaggtggttgagatgagatgatctgagaatagaaaacaaacctgtgaagcctttgctaaggtgagggaaatgccaggagccccatggcaccagtgcacaaatcgatcatgcttatcctcctcagtaacagggtaattaccactagggaaccggttctgaatcatgtagcgcaaggttccctttacgcattccgtgtcatctttagtcaagtccatgtccagcaaaacatgcatgatcccagaaagtccatgagcagcaccccaatacttctcaccataccattcatacatcaatgggcagcctatcgtggacagtgttctaccatctctgataatatctctcatgacagtgtcctacaaatagttcaatagaatgatgatgatcatccatcgcatgtgcccagcgatcatccaacaagtatgaatggaagaatgacaaatgaaggcactaaagattgaactgtgtacttactgtagtggttggcggtatagtattatctccaaggtgcttgtttaggaaggtgcatgcccataggtatccagctcttccatatagaagctcatcaggtgatttactatgaattttgatc

SEQ ID NO: 39890 - DNA, 2567 bp, Oryza sativa
  unsure (1)..(2567): unsure at all n locations
cgagatttatcaaaattcaaaataaaaataaaatcaaatccaaaattagaaaaaggaaagaagagtccaagtagaaatacaatttaaaaatagctgaaattcggaattaaaaattagcaatattgaaagaagtttccatataagaacccaatacgagattaatcaaaattcgaaataaaaataaattaaaagccaaaattagaaaaggaaacatgagtccaagtaggaatacaatttaaaaatagctgaaattcggaattaaaaataaggaatattaaaaaaacagtccatataagaacccaatatgagattaattaaaattcagaataaaaagaaaaataaatccgaaattaaggaaaaagaaaataaagaagagttcaagtaggaatacaatttaaaattagctgaaattcggaattaaaaataagcaatattgaaagaagaatccatataaggacccaatacgagattaattaaaatttcgaataaaaatataataatatccaaaattagaaaaattaaaagagagttcaattagaaatacaattttgaaacaactaaagttgaaaataagaaataaaaacattaaaagaacacaatatggtattaactaatttttttagaaaaaataaattctgaaattagaaaaaaaagatttcaattaggaataaaatttataaataactaaaatttgtgataaaaataaagactattgaaagaaaagaccatctaaaacacacaacgagataaattaagtaacaggcctataaataagtagagttggtggtggttgatatggtatataaaaattgttaatgaaacaccaaatagaatcctaatgacgattaaaaggagggatgtcaggtaggatgtgaagcaaacaagtaaagcggttgcctagacttctagaaagtaaaaagaaaaaaaaaccacattgataattattttcgatttttaaaatcttaatgacaataaaaaggagaagcagtgggcggggtgtataagagtatagttgcagagcctccgacggttgacggaacttctagaaaataaaaaataaattgcaataatagttatgttcgatttttagaatcacaatgaaaataaagagtaggcggcggacgagagctgcagaggggcatagtggcatcgtttgatgggacttctaaaaattataaaaaataaaactacaagtccaatttttaaaggttcggaacttctaaaaagtaaaaaaaaaacaatgataatcatgttcgattttaaaatcttaatgacaataaagaagggaggcagcgggcgagccgtagaggagcataatggcaaaaccgctgacggtttggcgggacttctagaaagtaaaaatgaacccaaactataattatgttcgatttttaaaatctcaatgacaataaagagaagagatagtggacgggagtataatggcaacgtttgatgggacatctagaaattataaaaacgaaacccaacgtgacaataaactctaaaaactataaaatccaatttttaaaggctccaagaataataaatagaaatagtgatagattgagcaagcaaataaagaaggagatgacataagaggtagcaactggtgtgattttaaaaactatgtaattagaaacacgaggatgataaggtttggtcttttaaagtcttaacattgagatagctctttaataaattttaagtaagattatacttaaaaaaatattatttttttctgctagccgcgtaattgcgcgggctacccagctagtttataataagccaaaatagccaatgctcatttctattgccattccagttttaactgagatgaacctgcacctatagcatcatccaagtcaaactacaaatttatcgagttcagaaggctaatcatcacaatcacgttataggcatcatcagcagcagcattttacgcttaatcacctccttaaacgcgctcaggtaatgagcaacgccagcttcatctccggcgtgtttggccaccaccgcaccgagggcgcagactccagctcgcccacagatgaacgtggcgatcctgcacaaatcccccaaaccccaccgagtcaccaccttaccaaaccaaaccaaatcaaaacgctgctgcgcccgacgaagcggctgaggaacgcgcagattactcggcccccatggatgcggcgtcgcaggcggccacgatctccgcgcacgtggcgaggtccgcgcggtcgccggtgaccaggtaggccctgaagagcaggagcgccgtgccgagcgcgccggtgtagagggtgaagtcgcccactgcctcccccgctgccgcggcggcgcgccgcctcttatcccacgtctcgtgcaccacctgatcgacgaggagcacaccagaatatcaatcactcaatcagcgcatgaggtgacgaactagcgatacggtggtggacgagttaaccttctgcttcaggtgaagcgccgcgtggaggaagcgatcggcgaggtcggggtaggggagggagaggaggtggtggagagaggaggagtangtggaggggatcgccgccgccgcc

SEQ ID NO: 39891 - DNA, 5561 bp, Oryza sativa
acactactcccatcccagtttaaagacagcttgaggtcgttcaagatcttattcctatgttttgttcttctaactgctgatcctatcctttagtggccgcattacattgctgccttacaaaggaaacgctttttctttcaattaaaatttcagaacttcataactcagtaaacataactcgtcttactttttttttcctagggaatatttatgcttgtctctggatactttagacttccttacgacattccgaagcctgtttggagataccccatgcagtacatcagcttccattactgggcgctgcaggtaaattaaatcccactctttgacaggggaaacacactaaatttttatcttgaagaaaatttgacaccaaacttttatcaacctgacaggggcaatgccagaatgacatggatggtctcgtatttgacaaccagtacccagaccaaccgaagatccctggagacttcattctgaagtacatattccagatcaacgtgcaccggtcaaagtggattgatctctcagtaattttcagcatgatcttcatctaccgcattctgttcttcctcatgatcaaggtaaatgaggatgcactgccatggattcgggggtacattgcaaggaaaaggcttcaaaagaaggaacctcttggcaagacaccctccctcagaggctacgttgtggatccagagcttggtcctaacgaaagctagaatataaactgttagcagatataggcccatttcttgccggttcttggtggaatatgtatctaagatcagagaaactggtatttatacgttttgaaactgaagctcaagctgatcggaatacaggtatatacagacatgtaatgtgtgaaaaatggcatcagagatgcagagttgacacatagctggtggttcagaatttacctgtctcttcttttacagataatttacagttctacattcagtaaaaaaaatccttcctctagaatggcagtaccgcaatattaacaatgaaagaaatggttggggccctaaaggcgaaagcaccgttcaaaatacgcactacaccatcacattgattctgctcgcttgccgaaagatcagtaccaaagttgtaacgtttagatagataaacttgtttcaaacaaacatttggcatggaaacatggaatatttcaagttttatttgtattttgtaaaaaccaacacttttttttgttaaattactgttagtactgcataaaaaaactgttcgtaggattatacgttccatacatgtaagagcgtcgaggtggctagtacaggacgcgtgtacaggaagattaatgattccagtgattttggtccctcttatgccagaccaaggacatggggctcaagagtatacatttgccccatgcaatcattgataaaaaaatgtttcatttgctccaaaaatgattactatcttcatacactcaaaagggaagtactgaaaattttgtactcggttaataaaaaacataattccgtaattatcatttaccgtaaatctggtttccttttatttttctatgatactgagatctggatgtttgaagcagtgggattgtaaatagtagttaggaaatagatcgcatgcataggagactggctcaacttggaacgaagtgatatcacaacaacaatgagtggaagcagttcagttttgcaggtatcgataataaaaatgctatgttccaaaatagcgaattattgctgagccaacatatattgagtccacaagcaagtcataacacataagatagtaagatattgaacagaaaggtacagtagctaagctaatagtattgcatatccttagatgatatcagaagcaagtcagtaattaccacgctgtaatatgtttaactgccagggtcaaggactggaagcctgcagtagaagctaatggacttgtccgtcagtctagttcctggaatgaaatactggaatatcacagtcaagcaagcaccaccaggagaaatacctgtgccattaaaaaggacagtatttaagcaaaaagtgactctccaacacaaatttggaacttgtcagtaagattacagaaatagctggaaagcacaccatagaaggtacagtcgggcttagccaaatgacattgtagacttttagctaggtgcttcatattcacttgctgtaaaaacacagaaagacagaaacttgtgaacagctgcatgaaaaatggtaaaaaaaaaaaacgtgaagctcttaggagtaataccactgagagcgcctcccctctctcaattgccatattggtacgagtggaagcactcaaattttgatcaccaacaggtgcggttgctgaaatgcagaaaattcatataaaaatatggataagataagtaatttcattcacgttaaaacaaaaaggtaatttcaacataatgacagcactgctaaaaagacattattgacacttgctttggaatgtagagcagcttaccacgaacaccaaggatacgaagtttcctgaattctgaaccaacagtaacaagagaagtggcaacgtgtagatgtaagtcaccatattgagtaacagctactgtcagaagatcgccgacattttttagacgatcgaccaaactctgcaactgtggcagatctggaacctgaactagagtctacagaaagaacagaaaccaagtatcaacatgacaacatccattaggatttagggctacaatttttgcaaagaagaataaatttagagattagaatcatcgaaatagaagatacttttagttgtctgtgattcttgacgtttatattaaatcaacataaacctccctgagtgaatacacaattccccaggaaaacttagttggggtgtctaatttagtctccttgacatggtattataaagaagcatgactaagatttcaggacgaaaataaaacatgaatggcagttccagactagtatacttgctattctacattttgcttctgtaatactaacttagtgtgtaccgcctgtgatcggtgatcctgagtcttgttggctatttataaattttctcaaggtacaaacaaataatgcagttagtttcttatgactgaaataaactggactagtgcttttgctatagtgaactatgagtatgtcacgtgaggtttcaagtttcaatttgataaggcagcccaagttgaatccaactcatcactaattccatagttcaagctttcgaatgagaaaagcctacactaagggatgtacatttgatgcctccatctaaagccaaaataatcccagcagagattgttcagtgaaaacctattcaactttgattaactagttccacatttgggcgtccaaatccgactccgaggaaatctataatctaatgaaatatcacgagcatttcagtaaaatgcatcgcacctgagggagctcttgggcggagtcgagggcagcctgcagccgctcgacgtcggagcgtgaaaggggccgcgagatgggcacgtcctgcacgacagcagagcgggctcccttggtctcgaaagtgaggaacggcgaggcagaccgggacccggccggcagcttgttgacgagcttcacctgtatcgcggctgaggcgtccccggcggccggcgactgggcgtggacggcgagcgcgctgcggagggcgcggtggagcagcgcgacgtcgacggcgaaggccacgcggttgccgttccgcgacgacacgctgtactcccggaagaggaggtccttggcgaactgcgcgacgcactgcggccctccgccgtcgggccccgtccccgtgggtccgaggaggttgtggaggagcatggcgtgcgtgggcgtgaggtagacgtggcacaggcggcccaccttgtccatcgccggcaggaaccctgcgggggcagacaagacggcgcgacgcgcgtgaggtgctcgacgaattgcggggtagagagagagagattgggatcggcggaggaaaagtcgtgccccccgagggccttacgcttgtcgaggagagcgatgccgtcgtcggtgaagaaggccttgaacttcatggcttgccctccgctacggcgtcggcgggcggcgaagctgctgctgctggcggtgggtgcgccgctggaagttccccaggggactttttgcgcgcctgggagttcgaggggacttcgcgagtgaaggacaagggttgatccgttgatgtgtagcagcagttccgcagttcgggtccttctttgtcacgcctcgcttgggcctagatgtaatgggccgtcttccttctagagagaaacatgggctatggtctcggcctatcggaaatttaggccctttgggtcggatgcggctgacatgggctatggttttggtcctaatcacccgcagccttttcctttcatcttctcccttctttacaggccatggtacttggtacatgtcagagaataaatattggaggaatcatctccatcgaaaacgaaaatggagatttcattctcccctccaatctcttgcaatcctgagtgatttctgttgggcgctttactttgtgagtgatttttgtctatcgtttcagcgaggaacacgaaccaaagccgctgaaagtacacaacggcaaagcaactcgggaagaaaaatgattccagatggaaccacctatgcatctgtcgggtgattttttctcaaaaatcatccagatttttccttgcccttagattttcatccaatagagttaaaaaaaaaccgaacagacagccaaaaaaggccaaaaatgactgggccaacacactaaaaaaacagataaaacatgggctgcaatctggcccaaacaacaaattagaaaaataaatcaaacaaagaacatatctgagaggcccaaagaagtaaagtcaaccctgtccaaaagcatcaacttggctgccaagaaagctaaaagaaaaaggacaaacacaaatccaaattaacacaccagatccaaaaaagcaacaccacgcacaccatggagaacgagtaggagagaaagaagagaaaaaaggttgaaccaaagcaaaattcttcaaatcaaagtgaaatcacaggggagaaacaggaaataaggaagaaatccaaattaggtatgttccataaacctgtgctcatcctcaaaattgtctacaaatcttagatcatagcaccatacgtgcccccatcccatatgcataaggagtgttttgaacaaaatacagggcacagttcatacactgaaagtaaaacttacagtgcatttgcactaaaattacatttgtaaaaacagtatatatgacatgtaagtgcactgtaagtttagtacaaatgcactgtaaaattatcaatcaatcaaacaagtagaccatacagaacaacttctgttgtttactacctaaaaattgaatacatctattcaaacatgaactcaggagttccagcaccaaatacatcatatattccaaaacatatatgtatcagttgggcagcacaaaaaagaaaataaaaccacaatagtgagtagtatggtgatatgggggctgcaggaat

SEQ ID NO: 39892 - DNA, 31966 bp, Oryza sativa
  unsure (1)..(31966): unsure at all n locations
aacatgaaaatcttcacctccatcagaatcaacttcaatgggatttttacccaaccttgatgtttggacacgaggcatctgaaagaacaataaataaacatcagcttggacatgagttaaaatgaacaaacaatacaaacttcactttacaacaaaaatcatacataaaaaacacaatcatgtagaaacttcactttagcacaagtacaacatccagatccatttacattgacataaaaaatataatcactgtgaagctttacaaagtaatgaacacatcatgtatttgctggctaccaaattcagtaattcagtaaaaaaattcactaatacaaacataacaaaaagccatgtcatgattctgaaaaattgcttcacgcctagaatttgccactaaatcacacatcaacaagcacaaaaacagaaactggatttgctaagcaaaaagcacccctaaaatcaaaagcctcccctaaaacccccgaatccgcgggctaaacaaccattccccaactcaaaagcaacgctttgcagcaacaaaaacaacaaaatctcagatccattccgtgaacgcttcccacagcccaggaagaacaaatctccaaacctggaagcgcaacttggcgaagcagcagcagcatcacgatttcaccgaccaaaaaacattggatgccacacaaaaatgatgagacaaactaaacaaaactacggcaaccaacgtctccggcgagctctccatcgtattacatcgattcaaaaacaactaaagccgagattgaaccctaacacaatttgaatcggacctacactgaatcaaatcgaacaaaaacaactaaaaccgagattgaacccgaacacaatttgaatcggacctagactgaatgaaatcgaacaaaaaaaaatctagacactaaatcttgccagcgaccaacctttccggtgagcaaatcggacctacactgaatcaaatcgaacaaaaaaaacaactaaaaccgagattgaacccgaacacaatttgaatcggacctggactgaatcaaatcgaacaaaaaaaatctaaacactaaatctcgccagcgaccaacctctccggtgagcacgcacaccgacaagacagtcctctccggcgagcacttacaccgacgagacaaacctctccagcaagcactcactccgacgagatctctctctcgcctcgcggagaaaacgagaagagaagagaagaaaaggggaaagcgagagagagaaatgcgaggagagagcgggatcagcgaggggaaataaaaaacggctacggacaagcgcggaaatcgaaatttgcatagtgcaaagtaatcaggccagggaatccaacgcgaggccctatccacgtatgaccacgtccaccccattcctggcacaaatctcggcgcagatccaacggcaacaaaaacgggaaatagcaacaaaaaaaatcacccgacagattcctagcaaaatcgattccagattggtttcagtaatctctactccgctttaaacaacatgttttggtcgtcaaatcacataaaactatgtttgaacgatggtttttacacagttattctattttgatttgattgatccctccatgtttaacggcatgagagagaggaggcaataataaggatgtagtatgatgtatgaacaacgagatgagaaaaccaatcgagaagacgaatatgacgtgtgtgacccaccacagatgacatctaccgttgattgactacgggacatggatcggaatagagaagccacatccccttgggctggaacctggtgcaaatttcatggtagcatgtcaccagatagtcaaatccaaattgacaaattcgtatagcaattaggaccgccaattttttatttccttccttgaatttacatttgattttcgtctgtagctatgaggaaatgtaaactaaggttgcgcttagttcgtgtgccaaattttttttaagnnnncggannnaaatttgcagtatataacactncnaagcanacctctnngctttnnatntannnnatgaaccttttgagcctaattaatccgtcattagcaaatgtttactgtaacactatattgtcaaatcatggtgtaattacgcccaaaagattcgtctcgcaattttacagttggattgtgcaattggttttttctcatctacatttgatgctgcatacatacgtctaaacactgagatggttttcattgagaactgaattcaggactgatctgtcagcccaactcgaactgactggagtaactggataactgatgcgttcctcatggctgtcgcagtaccaaaatggttacagcagccctagcagtcatgcatagtactctgcaaatcagcatcagaaattacagcattctattcctgacaagaaattcatccaaagatcaataaaattatcaggagatcaaccaccgatcaccaaatcataatgaaatcgatcaccaaagctcagcgaaatgaacaacaaagtatacattgcaaatgtcaccgccatggttacatcctaaacaatgtatcatcaccagaaagaacgcaaactcaaagctgaaacggcaacctatcttgcccctacaaagatgagaacctgactacaatctccacctgacattgttaagcaatcgatgagctcaccggagcagcacgaacatcggatcgcgcattgacagcgcctccgccgccacgatgagcgctgcgtccgcgttgagcattgccagttggacccacccgcgaacggccaccaccacttggctcctgcgacgggagcttctgcttgccctgccacgacagctccagtgggctgaccgcgccgctgctgagctgctccacctcgtcgccgttgttggactgcgacgctgtccatgtccggtcggtggaatcgacggaactgggctcccacgagggcgtccacgcgttgccggcaaagctgttgctcccggcggattcctgcggctccgcctcgcctcggatgtcacgcacggagacgtacttgtgcaggctcggctccatcaggtcgtccttcacaacaacctccgactcgacgacgagcgtgccgccgccggcgaccttgccgtcgccgtacctcccgtttgccgagcacttgtcgttggccgaccggtccagctcgaagctcttgttctccgacgacgaggagttgaggtccgcgaccgcctcgaggatggagcaggccttggacacgcaggccgggagcgagaacgctggcgccggggcggcggcggagccggtgctctgctggtggtagttctggatgtcctcgaggagcagggatgcgtacgagttgccattgttgtcgaagtcgtgggaagatctcctcgacgaccggcccttctggttgacgacgctctcggccacaatgctcaccgagtgcgtcgccttcatcctcccggaattcccccctttggtgtctgatgatgccacgggcacctccacgatctcctgcttctccttcgccgccgtccggcttgcggctacctgatctttagcccactccgccaccttctgcggcagggcgccgccactctccgtaggtttctgcaatgcatttcgatggtttgagtaattcggcgaggagaaatgatggctcagattgggtgaactgaagtgtgaagctttcatgcgtctgttaccttttggggcctgccattgttgttgcaactgtggtggttgccgagcgtgttctcgtcgagctccgccatggggttgcgacggtacggcgagtgctcggccttccgcgacgagctccggctcagagacggcccgtgcgccagctgcgcggcggcgttctcattacccgcggcccccgccctcgccggggagttggacctgggcgacgggtacctcttcccggacgcggccggcacgggcgacggcgcccgccccttctccctggccgggaccgacaccatcttccccggctgctgccgcgaggcccgctcgccgctcgccgtcgcggggacgctgtccgcgcgcctccctggcgaacggctcactctcctgcttccacttccgccgctcctctcgtggctccccgaccgcttccgctccggcgtcctccggcgcggcgacggcctggacacggcggcgccctgcctctcccagtcgcagtcgtcgtccacgccgccgccgccgccgcccctcctctcgcggtcgaaatcgtagctcctcttagatccagagtacctccggtgcccgccgccgccctcacccgacgccaccttccccgacgacgacgagctccggctgagccggccgcactggatcaggatggcgtccacctcttccttggtgcagctcgaggtccgcaccggcaccctgctgacgacgacgggcttcgcctcctcctcctccggggcgggcctcttcgcctcctcatccgccgcctcgccgctcgccgaggcggcgacctcggcagcagccgcggccgcggccgccttgacgacgaacaccgtcctcttgtcggccgccggctcctccgccttgggaacagccttcctgggcggcggcgccttcttggccgcctccgggactatcgcgacctccttagcaccagctttcttgccgccgccggccttcctggcctcatggcacggcggctgctgctgctcctctcgccgccgcctcacttgctgcttcttgctgaaacagagacccatgggtggtggcggtgtttggctccggtgaggcgtggatgattaggggagggttttttgtgcgttggagagtgtgttttgaaccgtggcgtctgtagcaaccgaggaaaaggtgaagccagctgcggtggacggaggagggaggggggaggggggaggggtgggtggatttcaaatttttctgttgcgtcgtcggggttcgtgcgcggccgcagcggcgcacgacgcgcgtgctccacaggagaaagccgttggggtgacagagtatgctttggcacggcgtacagtaacagtaacagtaacagtaacagtacaactcactcaacaagcttgaagttacaagtgctacctccaaatttacagtagctacggttctcgtcatctactcccccagggagaatttgggtccatactaatcccagggatttgtgctgataatttcccaaaaaggagttctttactgcaaaatacaccataattactcagctgtctggtcccaaggtggcagaggcacgcgttgatgcatctggaaggaagcacactgtactgtgtgtgtagtcctaccgttcaaccagctagtaggagtactgtatcagctattgagtggattcaaaattgagtcctgtatcaagccgtaataagatacgatgccgtatgatagtatatactctactggggtacttcactgttctgagagaaggccgggtgatagatagatgccgatggaccatctcgcatctatctatctatctaactattatatctattatattattaaaataactttaaaaggagacaccacgttcgctgtgagggctagaaattcccacattaatcggaaaaaagaaaaaaaagaaaaggagagtccaatagaaatacaatctaaaaatagctgaaattcgaaattaaaaaataagcaatattgaaagaagtttccatataaaaactcaatacgagatttatcccaagtagaaatacaatttaaaaatagctaaaattcggaattaaaaattagcaatattgaaagaagtttccatataaaaacccaatacgagattaatcaaaattcgaaataaaaataaattaaaagccaaaattagaaaaggaaacacgagtccaagtaggaatacaatttaaaaatagctgaaattcggaattaaaaataatgaatattaaaagaacagtccatataagaactcaatatgagattaattaaaatttggaataaaaagaaaaataaatccgaaattaaggcaaaagaaaataaagaagagttcaagtaggaatacaatttaaaattaattaaaattccgaattaaaaataagcaatattgaaagaagaatccatataaggacccaatacgagattaattaaaatttcaaataaaaatataataatatccaaaattagaaaaactaaaagagagttcaagtataaatacaattttgaaacaactgaagttgaaaataagaaataaaaacattaaaagaacacaatatggtattaactaatttttttagaaaaaataaattctgaaattagaaaaaaaaagatttcaattaggaataaaatttataaataactaaaattagtgataaaaataaagactattgaaaaaaaagaccatctaaaacacacgacgaaataaattaagtaacaggcctataaataagtagagttggtggcggttgatatggcatataaaaattgttaatgaaacactaaatagaatcctaatgacgattaaaaggagggacgtcaggtaggacgtgaaacaaacaagtaaagcggttgctgggacttctagaaagtaaaaagaaaaaaaaccacattgataattattttcgatttttaaaatcttaatgacaatgaaaaggagaagcagcgggcggggtaagagtaggcggcagacgagggctgcagaggggcatagtggcatcgtttgatgggacttctaaaaattataaaaaataaaactaaaagtccaatttttaaaggttcggaacttctaaaaagtaaaaaaaaaaaccaataataatcatgttcgattttaaaatctcaatgacaataaagaagggaggcagcgggcgagccgtagaggagcataatggcaaaaccgctgacggtatggcggaacttctagaaagtaaaaatgaacccaaactataattatgttcgatttttaaaatctcaataacaataaagagaagagatagtggacaggagtataatggcaacgtttgacgggacatctagaaattataaaaacgaaacccaaacgtgacaataaactctaaaaactataaaatccaatttttaaaggctctaagaataataaatagaaatagtgatagatcgagcaagcaaataaagaaggagatgacataagaggtagcaactggtgtgattttaaaaactatgtaattagaaacacgaggatgataaggtttggtctttcaaagtcttaacattgagatagctctttaataaattttaagtaaaattatacttaaaaaatatatgatttttttctgctagccgcataattgcgtgggctacccagctagttctttgtattattttgaacttgaatgggtcgaccgttgtaatcctgtacagtacattcgtcgcttgcaaacaagcaaaccattggtggcttggagcgactcgccgagctttgtttggagagcatctcagtttttcacgtgatgggaattcgcagctgatgtttcagttcctggggtagaagacgattccgtcacccttgattcgttgacattctcttatcaatttgaccggattggagtatcccactgaatttcaagtacgcttacctcctccaaccagccggataaaacttcagctcacgcagtgcttcctcattcccataaaaaacaaacctagtattgtatgtgaccttagcccagatttattgtactagaatgtgtcatatcttatcctagatttattttttttagacggagggagtacgtgcatctgaacatttcattaccatgcctactagcaactctcacatgtgaactggggcaaacgaagaagctatatggtctcatcttttcacttatgcttatgcttatgcgccaaaatttaaattttcaactttaaaattgaagctgattttatggtattttcatcgaagtttatttttcagcatttgcttttagatcgctaataacacgtatataaaaattttattcacaaattatttttcatttgcaaatatgtcgaaacaatggctccgacttcatagttcctgggttaggattgctctaacggcaacggccatcaaccatgcatcaagggttaactcgcaagtggaccattcacgtcaggtgagtacaactgtagaagggcactcgaaagtcgattgcatagcattattttccaacacatcgaatgggctgagggcatctacaatcagggacactctataggtgccctcacttactgagggcgctctctgggaaactccccttacaatagaggataccactagtagcccaacgagtgtccctaacccaaagagcccatgtaggtattttactatactacccctctcttctccccccctctctctcttcccctcatttaccggcgcgcctcctcccctctgcctccacgcgtgctcgcctcctcccctccgccgctcgtctctctctctcactctccctcgcactgccgccgctcgccactctcctctgcctgtcgcccgtctctaccccttctcccgtttttccaccgccgctccgtgctcccgctgtcgccagacccacgccccccctccgatctcacgccacaccgcgctagatccagcgcgccgctgctcaccggagatgcgaggcgtgccccacatccccttgctcggcgatggcgcggtccttggcctcgtcggacccggggagcggcgtcacggggcgccacgggagcgtcggcgaggacgacgaggagggccacctctcccgttgcgggcatccaccgtcgcccctctctctccctctatcccatcggcgtcctccccggcatcctccgcctcgcgctgtggccggtcgggggcgccagatccggcgccgtagtgggcggatctgggccccccgcagcgccggcgaggacgggcaaggcgccggcggaggaggccgggcaaggcgcgcgaggcggtgagcacgggctcctcgaagccgtctccgcccgtcgccggctagtggccgacggctgctgcggcgctcggtggccatatctggtcatcgccgtcgtggatccgtcgtcgtcgtcgccatcgcctctttcttctctctctctctctctctaaggccatcagcaatgcatcgacggtggcggtcccggcggtggtggacgtggcaccggcgatgtcgggcgcgacacgacgagaccgaggggagagcgagagtgaggcgagggtgcaaggggaaatttggggggacgatgccgtacccacgagctccatacgcgctcagcgtggcgcctggctgcgtctcccatgaaaagctggtgaggcgcggagagagccgcgtcccctaccagagcgacgcgttccatcgcaaggagacgacgccgacggaaaagcgaacagctgtcgctaggggcacggtccgaagcaccacattggtgatggcctgagagataaatcaccaactttctttcacttcgtaataatagaatccaaagttttcagcagaacccaagctgacgtttactgtacaaagttggcgcattcacaaaagctgaaaagctgaacgaaaacaggatctagcaaagtaaacaaaacgcttacccgctagaagtacaatgcactgctacctcatgtctcattctctaccctcatcacacccaacttttgatgatcacaactgtcaacataatcctacattcctacgtattaatgggagacatggaacacatgattgtaatttgtacgagcgcctaaaacgaataaaagacatatcacatgcctcatttggaagacagtctcatgaccaaagcatattaatatagtgcgatagtgtaaaataaaagaagaaagctttgttcagataagaccttttggaatatctgatgcaattccgtcgattcagagaatgaccaagttccatgtggtaatgtaagcattaatttccattatgcaacgataaataaagatttttctctaatttctacgtgtatattgacctgattaactatacatccagagaatggaagaaaaatgcagcatactgtcagttactatgttgaagtgtaaccttcaacagaaatatgataaatgaacaatgtttcagaatgtgaacacgttccaacagaaactcaggatccagcagaaggggaaaccaaatccacaagttgagaccttatgatcaacaaataatgcaggatgtgatagatcatgccagaacagatgcatgttctttcagaaatccataccaatgaaccacaaaaacatctgttcggaaataaagggacaaaacctgattactcttctttcaatatattttgttcaacataaaggaaatgaagaaaatattttccttcgaatgaacattatgtcagacctctagaatttgttactatcatctcccacagtaaattgcctccacagaatcagtatatcaccaccagcatgcaaactaaaaagaacattaggaatggttgaactcagcttgaatctctagaatttgttactatcatctcccacagtaaattgcctccacagaatcagtatatcaccaccagcatgcaaactaaaaagaacattaggaatggttgaactcagcttgaatttgaccctcatcaaggtatgattcacgtcacaatcatgcaaaatcaaaagttcgtttatacttttaagaatgagttttcacaattggaagtatccgtttaaagatgaatgatagatagtcttaaaaaaacacttattggtccttgttgaaggtttgtaaaaaaatagagaaaattgacgatttacttttctttatataattcccttgcatattctcattataaatgggaaaagaaaacatataggatttcccatgtatttaccggtaaagaaaaagagttgtgataatttcttgcacaataaaaagaatctaccccccccccccccccaatcaacaaaaataaaggtctcacagcaaggtccccatcggttgcttacgggttattataagtcataacggcttattagcaattaaaaaatgatatgtgagtaaaacttttgtataaatgttcttatcgacttaaaagccaaacttgaaaaaaataactatgttgaaaaaacatcaaagtcaatttcaaaatcaagtttcaaaattaaaattttggctttggcttaaaattaatataagccatagggcaatcgataaggccccaagacaaactctcactcttgatcacatccagactagcgtcatatcataaaatttgttagcagcaattctggtgcaatagcaggttagcaacctatggtgatgtgtactaactttgtgaatgaactagaaaaaaattaaaagaaagaacttacgctatttttctagcacctgaaagcatagagaagcaaatgtctaatttctagatcaaaccagacttgaaagatatactgcaatataacactcatctccttggataagataatatgcaagatccctttatcacctacaaagaatatattcagatcatccatattatagacttaaaaagtaatagtcccttcatcaagctattgcttataagtaagcactccatcaagcaccgtagaggacgaggagaaagtatatccacataagtaagttttccagcattaatgacctggtgtaatatatctggagagaatcaccaccaacatgtgctataaataactatgtgcactttaccttcacacaggacctaatcacaaggtctaaagttgaggcaaactacagtagcttaaatatccctccacaatccagttcatgtgccatctatgtttggtcaggtccaaatatgtatgtgcacaggccaaacctaaagcatggctctcactcgacagatcaagattcaagggaattcaaccagaacagtgaatacatttcaaaccatgtaactcaattggaaacatggaaggctaactcagcaaggccacatttgatgggcagagggacgaaacaagcctacggtaaaatcctggtgaacactactggtaatttactagtttgtggagtaaaccgagccaccaacaataaccgaggtcttgagaaaccaattgtgctactaagaattaacatgtctagtttagttggctagcaaccctgagccaagttctcaatgctattactgcagcaactaaataagctcataacaattgaaattgggactgtgggataaatgttcaagtgaacagaccaatagataaatacgatccgatattccaatcaaatgctaaaaggttacgctagtcagagagattgatttccatcctgatgagtaacatattcttataagcagcgaattctcttgaaaagataactggaaaaaatactactgaatacagccaacaacagaaccatcagtataaccactttcattcataattgtcataatccgaaccgttctcagtttctcaaatctcaaaatgttggtgtttaacagaactacaaaagagtgaggaagagcacgcgacaagtaaacaaacaacaacttacttgcgatctcctcgcaccctcttcaatcttctcttctaatatacagatactgcatctgcagactgcagacgacgagagcacattattctgtaaaagagacctattcagctattcgtcttcgacgagctcgaattcgtcctctcgaaggtgggcgaagaaccggaccggtttgtcctgcccatccaccctgagctcgaactccaccttgaaggggagattggccgtgatgcgtttgcccttccagatgccgacgtactgcttgaccacaccctccatgccacagatgtccaggtccggcgccttggagacgtggtggacgcgtaccggcgccgtgacgcgcacgcgcttgccgatcttgggggccgccgcggactcctcggcggccacgtccgaggacggcgaggagacgtcgccgttggcgacaacctggcgaacggtgcggaggcgcccgcggcacagcggcggccggaggcagcgagcggccgtgggtgttggcgagaggaggctgcggtgtaggagccgggaggaggtggagggggacgccacggcggtggcggtggcgggtgccatcggcacggttggtggccgtgtggggaatttcatcgagcaggtggtgcgcacgtgaggataagagatgccgattgccgagccagctgaaggttgggggtggatggcgattggcgaggtggatgtctacactgacctgcgaccatcccaagggtcatttggtcctccgagccaaccagtttaaagaagccgaatttcatgcatccttgagattaagattttttttctagcaaattgtattcaaatttgcaataatctgatccccttttctttaacactagcatggtggctagcattcttatatttctcttatataatagcatatatatatatatatatatatatatatatatatatatatatatatatatttcttattttattattaaaatatattaaaatgacaataattttaaattttgtactcactttaccaaactagtaatgtggaatattcaaattgtattgtacatacatgatagttattagttatttttaatatcaaattttagttatttctaaattatattcctatatagagtctagattcgtcttccaataatctttattatcttttggtatttcaatcacaactttgggtgtttatatgttgtatttaaatttgggccttgtcagggttatagataccacatacctaatagtagttgactaaatctcaacatgatccaccacataccatgtgttatacggaaacaaccttcggatataggaggagttccgtataaggaatgatgactagagttctatatggaaacgacaaggactactcggattgtatccatattggtttccctagttctacttggataagaggacacctatgggtataaatacaaggccccctgggaggagaggggacacggacaacatagacgccacaaagccacaaagccaatacaagtcaacatacgccaagacaagacgccggatatcgacttcagggataagcacgactagtcccctacggtgtctccggatactgtcaggagagacgaaagcgctatctctgatctcgccgggcacggattcgaggaggaagactaccctgttgtcgactacgagtcagaccttcagaccgccatgtcgacaacagttagataagctaccccaaatattgtactggtgtgattatggtgaataagagtaataccggcttcggccaacatgatgtagggttattacctgacaattcaggggcccaaacctgtataaaaatcctcgtctccatctcttttactacaatctcgcatatatcctagtactaacgatccccatactatgcaaataccaaaatcgcgacatcaaacgtcgacaggccttttattgtataaattttgcatggacacttatttgcatatctgtttattttattctaaaattttgtgattgactaatttaggtatgacgttgtacagaaatcaaattgagtaactttattatatttttattccaaattttatcaacccatattgtgttgtatatggagtttttttattttctaaatttcagatattcaaattgtatttacaaatccaatcttctattttatcatttgtttttaatttgaatttaaaatttttaaaaactgtatttctacatggactcttcctcctttcctttactattttttaaatatgtatttcttgttttcttaaattgtatttccacttggggtctccttttaatttcagaaatttttaagtgtatttcactttggactctgtcgacgggggatacccgtagaccggatatagagggtattggagtacgttggaacgaggatctacgtaatacgacatcaagcaaacaaaagataaggattatactggttcaggccccttggtaggtaatagcccttatccagttggtatgggattatatgatggaaaccatagattacaaagggaatagtggaactcgatgataccgacgaaaccgtagtcgagttggttcgactagatcacccggcgacttggctcctataagctccgactctgtaggctgtggtggatatgttggcggtaagattcgatgtcttcgatactgcccaaggggtcccttttataccgcgggtcagttgatctccaagtaggactcggagatatcggacccctcacgatatggtaacgacccagtattgtccgagtaggactccttccatttgtggattctgtttctatcatgtaatagatttccttaacgtatacaggaactacccgtgtacgcgcgggtataccgtatcagtatacaacgtatatccaagtataaagggtataccttatccgtaacactgacagactcccctctgttttttgtcaaaattgtatttgtacatgaactcttctttttttacctttattttattttctaattttgaactttgtatttctagtttgactctttcttttcctttctaaattcgaatttcatatactttaaattatttttcgatttggcttttttctttttgggtgaataactaatatgggcatgcagtttcgtttcggactcagtttagtttttgaggtttcaaatcgtccaaacaaatccttcaaattaatcaattgggttaatatagtacttggaccctcaaaaagtgtcacgtgagcatgtcaagtcatcctcgcatgcagcgatatgaatgaaatgaccattctacccttatataccatatagaaaagaaagaaaaaaaaagaaaacaagtatttcacacatgtatgatcgttttagagttgtcacttatgattgctgcagccaagcactgatcgtataaattcctttctcggccaccctccgcaacaatgttgggcttgggctagcctgttattattttgtttgtgtcttttatttcttttctatatggtatataagggtagaatgttcgtttcattcataccgctgcatgcaagaatgacttcgcgtattcacgtggtattttttatgggtccaaggactatattaacccaaatgattaatttggacgatttgaaacctcaaggactaaactgagcccgaagcgaaatttcagggaccatattagctattcaccatttctttttgcttttgtctgattaatatgacaatttcaattaattattaagacaaaattaattgaaaggaaagattgtcggcgtgattgaattaattggattgcgaagagaggatttctgctagttaatgttgacgaagcggactgtggtgaaaaggtttctatggtgctaattgttagtttgaattaatttgttgtgcttggagtatgattttgttgacatggcatgtaagtattgtttaaattttgataacggataactgatggccatacaaagtactataattatggttggtttgtatcacgtggatttcaaagaatcttggtctgttgcacaatatttatatcattcctttgacttttgtttcctttttttccttgtccgtttccacttaaaattttcttgtccgtttacacaacctaatcctaatacactttcattttcatttttttttcatattttctttcgattaatgtgggattttctatatcgtgagagtgaacatggaggctcatttttctactaatttattataagttagtaatagacagattttggatacatttgttacacgagtggtctacgatgatgacaacacgtgaacccccgaaatcgtggacgagacaacagacgcaacggagtaggttcaggactctggagaaggggggctcctagcgcgcgcgtacgcgccagcaatttagctggtgcgcgcgtcagctgggcccccacgcgccctttttttttctttttttgtaatttttctcgacgcgttttttcatttcttcctatttttttcaatctttcgcatacctctttacaaatatagaattgaaagttttcaaatttgacttgaaagttttcaaatctgggttgaaagttttcaaatatggattgaaagttttaaatttgagttgaaagtttttcaaatttgagatgaaaagtggaaagttttcaaaatttgatttcgaaaaatttaaatttcaagttgaaagttttcaatcttgtgttgaaagttttcaaatttgacttgaagttttcaaatctagatcaaaagttttcaaattttaaatgaaaagttgaaagttttcaaattttgacttcaaaaaattcaaattttgagtggaaaggttttcaaatctgcattaaatgtttaaaatttcacgtaattttcaaatttgcaataaaaaaagaaaagattaattaatacggttattatggaatgcgatttttcctccaatagcgcgtcagcatgtgctcccaacgttttttttttttttttgcttggaaaagtaggacttctttttcactggtgggtcggctggaaccgcacgcgactaactgggccggagatatctaattagcacgtctgcgctaattagcattctcgccggagaggcctattgactgttcggcccattaaagtggtccgaaggattcaaccacttccataccatgggcctatcaagtccttcacaaatctaaacgtaaagctttttttggaccccagggcccagaggccatgattatctaggcctaatctgcggcaacatgcatatccactagtagaccgctagaactccagtagtccaggtccaggatgcatgtccacagtactctcctactacctcacaagtcacggcacggcatcagcagattggatccgcggacaccgacggcagcgcgcacaaccgcacatgtccgtgggaggcatgcggcatgccgccgatcaaactcgatcgccacccacccaggaggaacacacaacacagactgcggcgggcgtggtgctgggactcctacacggctacacctgcagctgggtgacgacgaatttaacgagcgctcgcgtggcggcgtgagtgagagcatctctaacagattggctattttgagctctccaaatactcatttgatcatccatctaaaaaattagagagtcaaatttgcctttcactccaacagtctctccattcatcctctctattttagccatgggacccacacgtcagcccctctctccttttttccccttctcaaggctgacgcaggccggggggcgccgctgccaccaccacaacgaagcgagacgccgccggcgccgtccagcccaccaccgctgttgccgccgaaggcgagggccatcctgctcctgcgcatccgggacccgccgccgccgccacctccagcttcaacgacggcgatggcgtgcagggcgaagcctgcctcctcgccgccctcccgagccgcactcgcagcgccggggaggtgtaggcggaggcggcggaggccgcgcgacagaggttgccccctcctcccgaatccacgccgcgccgccctgaacccacgtcacgccggaggcaacggaggtcgggcatatccggatccaaacgacggcaacggcaacctcggggacgacagcggtggatggcgacgactggcgacggtgcagacgacggcgacagcggctggcgacctcgacgacgatggtggcgctttggcgtgggttcaagacgcgcgccgttgttctctccgccgccggcccgcccttctgcgccgcatcgaggaggtcgtggctgcgccggcggtggcgttgagatcgtggctgtgcacggcggcggcggcgtcgagtcgtggctggaccgctggagagacgaaggagatggggggtggtggagaatctgtgtggggcccacgattggcaagtgatttgtggctagccaaatttggctagtggaggggaggttttggccagccggatagggtttagggttagagaggctgttggagcacgtttttttttttttgctagaatagctaaaatttagcttggagagtgagatggggagactgttggagatgctctgaggtcgtcgattggtcgatcggagactcgcgtgtttccctgcacgtacagcactaaaggcacgtaagttaagttcacggttacatatacatggcggcatatggcagcgcacgttcttatcagtcggagtgtcggactaccacttgcagggttgcatctgatataagtggttggccacctatcgtggtgacgctgccatagtcaagttgcgccatgccttgattattttgccgtgtgattcagttgcgcacgctgtcacgtacatacgttgtgagttgtgtagttgacaagaactccccggctgctctgctcgctcgaacttacgagagttataatgtgcttgcctttagtacacgattcgcaacagtttggcatcgtttgctctgaactatctgcactaaatatctcgagaagcaaatagtatgaagttactaatcacctccccagagtatacacaaaaacagtggaatgccagagatgttccagaaaacggagggtacaggataattaaatataagtaaaactaatcatcacctgaacacatacatgcatgaaatattctagtagctagtaaattaactgaagtagtaattaatctccccaagaatcaatacctagttagatcgacaaagccatcgcatgagtaaaagaaaacatgaatacttcaaatcttttgaagtcgagttcaacgaatatctgacacacacaatcttgggaagatacgaaataaagggaattgtactgtggtcaccccaacaagctgacctaaaaatcgcagcctagaacaggggttcccttgtggtttagaagtcttgagaattgatataggtgtggctgttgtacgtagagctgtgtgatgctgcaaaattgtctttaaaactgcaatctgcaagcatctctaccctaatcatacctttgtggttgaagtcgatgagtaatgaaagagatcgtcgaagtcgatgggagatggaagagatagtcgtctcgtcgaggtgcgtggctgtgtgcatgcatgcttagtcctccttccacatgaaggtaggagtctgaggtgtcccttggggagggagatctgaagaagaagaggttaccggaacatcatcgcatggcatgctcatccctgccgctgttgctgccactgccggcacggttgcttgcgtgccggaatgatccatgctagtttcgtcaccggtgaagcgagggtggaggaagaggccgcgagcgctgtccatgtcgtagtcgtcccagaaggagctgccagggccccacgtgctgaaccatgactcgtcgggagcaacccacatgccgccgcacgccgccggcgcgtgaagcatttcggccgggtacggcgcagctgcgtcgccgccagagcacccttcttgacgagaggttggagctggaggctgtggttgtttcttctccatggacactcctgccgtgtcccgctgttctcgctgctgaggagcttgttgctgcgtgtttgcgtcgtcaggtgtctccggtggcgatagcgacgacgacgagcacgacgcggcggcagcggccgaggagcttacgctggtgcggcctttcccgccggcgcggcccttcccaaggaaccggtccggaaagttgagccgcgcgttctcgccgcggagcttgaaggcctcgcggtcgtacgccatggcggcgtcctcggcggtgtcgaaggtgccaagccacagccgcgtgcggttccgtggcaggcggatctccgcgacccacttcccccagtgcctctgccgcacgccgcggtaaagcttctgcggcggtggcgggacccggagcagctgctggtacagccacggtggcacgccaccggggccaccgcgcgggctcaggttcagcgcctcgctccagtaccgcagcagcatctgctgctgctgcgcgttctccgggacgacgaactgcgtcgtcgagcacggaggcgacgcgccgaacgatatcatctgctggtgctgcaacggctgctgctgctgttgctgtggcgacgcgggctgggacatgctggattgctgccacgacagcgggtggagccttgggctcccacccaccgtcgtcgtggaggcctcgtacgcgaaggggaagatgtgtcgcgccgacggtggcgagggcgacgacggcgacgacgagatgacgcggactggagcatcggaagccgaagaagagcgaggcgaaggcggagccgacgaggacgtggagagcgacgatgcggagcggaggaggcggtcggggctccgcccaatcttcttgagcggccgcagcaatgccgccgacgagtcctccaaaaccgtccccagctgccgccgcggctgtatgggcgtcacccccttccccttccacctcctgccaccaccgccgccgccgccgccgccgctctcgccgctcggagcgtccatgcggagaagaaacgcagctagcgccgccggtgtatcggctgtatctgaacgcctgtgcaaacgtatcagccgcgagacagggtgcagccaaacgtaccccgcgcccgccgtgctgcagcaatatatagatcagacaaccttgtaattaaactgatcctgacaccaacttgcacctcttgccacgctgtatagacgtacgggcgcggtggcgattgggcgaccggtgaaacagtgcgagacgagacgatcgcttggcgtccgcgggcgagtgggcgaccggtgcggcgcgcgcgggggagcgcgcgcgcatgcgtttgtgtggtggtggggtttggttctgattccgcgacgcgtgcgaccgataacccccgcgcttataaaaaggtcgagagaaaagccagagaccggtgctcctgtgaaaaaagagagggcggaaacaaacggttctgcgcgccaggaaaaagatcccggtcggtggtctggccccaccgcccattgaccccgacgaggggccctccgatgccgacacgtcacgggagcacgaatctcaaggacgatgtcaggatcgcgacatggcgtctttctgttgctgtcacggctgcgtggacggtactgatctggaaagaaatacttgtcaatgtgggctttgctagattgacccctcccattgctttccttgtactccaatctctcgagaggactagcttagtggctcgtttttatactcgagtttatgagttttccgccaatccgatcacgctgccaataattgctttgttagtttcatgtttaagaaaaaagagaggaaaattctgatgttcctgaatcctgttggaccgtgttaataacatattcagtaggtgacgaagggcctagggagattagttttcttaatgacatatgacaacccggcttgtagggcttcgcgattggcatgttctagcggcatgccagaaggggaatggattaattaaatcatatcgaactgttagaactgtataatatcttatctccccgaattagttaagggaagtgataagctttgtcgcataaattattaacaggctaacataatcagagcttcttttgtcgtactgttagctgcttaattaggcacctcaccacgtgatttgtctggacgatccatcggcgtgaatttctcgatcagggctagcgatatatctctctccttttctctcagaggctaattaagcacgcctgttggcttcctctcctgatcaccttgcggtcacttgctacatgcactgcatcatcacggtgaggttagcttgctattttacgagctgtatatctactgatgtaaactctgctgttttctttggaacaatcgcggttatgaaaggctacgttaccccgatacgctgatacgaatacgcgacacggcgataccgggatacaccatcttcctaaaaatatggatacggggatacgcgaatatatatatatatatatataaaaaattgagtgtggaatatagactgaaaaaataggaagcaaacagcatcaaaccaccaatgcaccaatcatcatatatatgatatctcagtacgacagattcacaggctcacagcatctcaccaagtcaccatttattgaagaggcatgcataaataagtgcaagactatacagtagatgaaatcatgaaaataacatagttcttcaaatagatggtagacattaggcaacattgttcacatagtagatgatgcaggatttacctcaagtcctcaacgtcgttgtcgttggaggtgatgcaggattgatcagaggcagcggcgcaatgcctcgtggaggagtctggagctcctggaggagagtgcagaggagggggcgcggagaaggctataggccgcggcgcggcgcggcgctggcgaggcggcgtagcgacggcataggcgcgcacggcgcggtgcggcgccggtcgctggcggcgggccggcggcaaggcagcgcagcgaaggcgtagggcaggccggcggcgaggcgacgcagcgacggcgtggtcggggcggccgggtggcgctgcgatggggattgggttttgcaagcggcggcgcgtttggagggggagaacgggagatgcgttttgttctgtgtgatttagggctccccgtatcatgtacgtatcccgccgtatcgaaggagtatcggtatttttttaattatctgaaaaagagaaaaatgagggatacgtatgggatatgtatccggccgtatcccgcacgtatccgtatccgggcgcgtatcagatactgatacgagggtcagctgccatatcggggtaacgttgatgaaagggtacgtaggccttgtaggtccttatgaacttcaattagtactatgatgaaactgaaaacgaagtaaaatagtcaatactagcaacgattattgttattctcccatctgtgaaaggccgaacgagactgagaccacgacgagcacaaagctctcatggtaagtcgccatctcacggtacagagaaccagtgaattaaagctccccgggaatgcacgcatatctgatcttctctggctgctcgatcgccatctgacggtaccgaaaaccggtgagtttaaagcctccgaggaaagcacgcatcgatcttctccggctactcgtatagcgatcgattggcgccgcaggcaacgctgtcacttgattctcgaaagatcaagccatggatgcatcaaggcattgtgtgattgccggtccacttccatcgaccaagttcagattccccggggagatatgtgacaaaaaggaggagctagccagatcgatcgaccgagatcgaggcagctagtggccgttggttcgcgaccgctccccagctttctttttgggcgcatcttggggcacgcgtgcgtgagtacgtacatcctgcccagatacctaactctcgcagcagccggccggggccggggccggcgccgatctcgcatcgctttcggcaagagcggcacaggcattaggggctgtttagttgctgaaataaaaatttttgggtgtcacatcggacgtttgaccggatatcggaagaattttttttgacacgaatgaaaaaactaatttcataactcggctggaaactgcgagacgaatattttgagactaattaagccgtcattagtatatgtgggttactgtagcacttatgactaattatgaactaattaggctcaacagatccgtctcgcgatttacatacaaaatgtgtaattttttttatctatatttaatgctacatacatgtgttcaaagatttgatgtgatgtttttgcgaaaagtttttgggaactaaacatggcctaatctctagtaatctctactatataggccgtgtttagtttccctcctattctcaactttccatcacatcatatcacataaaaattttcctacacatataaactttcaactttttttttcaaacttccaactttcttccaacttccaacttctttcagaaactaaacacaccctgccagcacggaaaaaagtccgcgcgcgtacgtgccagtgtgccacactgccacacaaaaatctactagtacaaaatacggcagggcatcgaagctgcaggctgctggcccgcgcggccaccaccacccacgtcggccgccccgcgtgacggtggacagccgcccaaccccacccactcccaacggagcaccggccgcgacgtacgagtagctacgtgcgcttgtggctaagcccatgtatgtgctgtgcgtgcgccgggcgcgcgcgcgtggccggggccgttgcaacggtggtgtgggcgccggcgccgtcagccgcgaccgaccaagctggcgttgtgtggtttcaattccgtgcagggctagcttattgctcgatggatcgcgtgcattggcagctccggcgctgaccttgccgcatgtaagtagtgcgcgcgatgacttcttttttttttccttccctttttatagcagcgcgacgtcaagctgcacgcgccgccaccgcgcaaagtcattagcactcgaggcgtgctgccgtaggctgccgcgttgggatatttatcgatcgagtccgaaattgtacaagtggttttgactagccacaacttagtacacgccacatatagattgcgttgaggagcaggtatattactacgtactggtcaccacttactccccagtctccatcgaaggtgagatgattctgtcgcgtccaactttcacactcttgcaaggtacgaaaaatacgcgttgcttgcaactatttagctcgcgcgcacaacgagtactcaatgtgaggcttggctatagtactatatcaaactaattttgggggcaaatgcgcattgtatgctctcgtaagctttgtgagagaaagcatagcacgtttacacgtcacccaccgccattgacccacgccctatatatacatacttcatacggtcataattattatgatgctactctccagtaccaatctacctatacaattttttaaacaaagtacatatttaagaatttatatattggtggtcaaaatttcaatagaaaatgataaaatcttgttaaatatttatgaccagagaaaaaatgtttattgttggcacactatcacagaaacaatcatcacttccggttctaccattgcccatttaccacagtttctcacgatttcctgcccaaaccggcaagtcggcagtgacactcattatttctaggttagtggcactaaacgtcagagggcatgtttggtacagctccaactcctaaatttaactctaggatcgagttaggtctagagtggagttgtggagctgtctaaacccagctccacaactctagtttattttgtgagagagctccactcgactccactccctttttggtggagctgaaaccatttggctgagctctagctccaggaggggtggagctggagctagagctgtgccaaataggcccttagtatcatagtcggttgtgccacgaaaagacaatggaacactctcgatcactgcttgccccacggcacaaaccgatagtggtacaacactgtcacttcttgccaccagccgacagtgataatatcgacaggactaaggtacaccattgtgcagactgtctgagctatgtactccaagggagatgaaacaaatagaccaatagattaagagaagtaaaattatcatgttgtattggggtaagtgtgattgaagtatcatgttgtatgcattacttcttaattaaaaactagatgatgtgtataaatttagaggtggctatcacctccactataaaaacttgctatgagccgataacacaaacggttcacgaggagaccagcaatgattgtccatatttcacttgcaatatgctccacaaactggtagtgatacttcacttattgccatataattacgccatgaactggcaatgatacatcggttctaaaactaatgatgttgctctcatttaacattgtcgacggcctaatccagacggaaaaccgacagtgataacaaattccgtggtaatgacatcttcaaatataaaacatatgtacttcacaagggaataaaaaaggcctttcagtttcacctaaactctttggattacgtagtatgtacgcatggctaaattaagtcttcgctcaacaaatcgctacaatgagaatttagtattcgattgtaatgttatgctgcatttgcatctgagcatcagagcatccaagaaagctagcaacgcatatactagtacaaattaacaaaattatcaacacaattggtccctggtctacattcctatttgtatgtaccactgacaatgtcagctgggctgctagaatctatacacacttcacctcacgccataaacggaatcactataatgaagagatggaagatgagatctttagactctagaaataggatattcatgagcaaaggacatctgtaacaggtatattgacattggtagcatgtgcttgcgtgtttgatatacatcacaatgctattgaagcatggttatagataaatactctcttcattttaaaatataggaacatattttgttttgttgggacaaactttgattaactagcttttgtatgattatattttttatcacataaataatatattagaaaaatttgttagtcaaagtcttgtttaaaacaaagtacaccatgtattttaatatggagggagtaacagaagaatattaatcaaacagttgcattaaaaggagcaactaagataaattggagaattaaattgccctaataaaaattaaagaataaaaaaggtatgtgataagtaaacatatagaactccctccgttaaaaaaataatatgtattttatttcattgggataagattttgaccaattattttattggaatatagtttttcttttacgaaattgatgttattagtaaaaagaacttacgaaattggagtcgtgaattatgattatgctttgtatgtctattttcgaatccttgctctaacctatgtcttataacaaaaaacataggaagtatcatttaatcctacacgcctaattaatttgaagtttctaacaatttgagagataaattgtataaatttaatattaatagtactccctccgccctaaagggttgggttttagtatctagttaaaatagattgagtaaaatattaaaatactattatacctttcattattgtagagggaaaacgaaaagaataaaatgatattcatttgacggacgagtctacgggtcgggcgcccgatcggtttggagaaaaattgggcgctgttgtcagcacaacgtcagcgcccgatttatgtgcaaaactactttaaactgatttttctcttaaattacttatccaaatcatgatccgattgcatcattaaattcgttgcaattaaatcttcaaaacaagaccacacatggatatattccgatgaaaaaatagcttattattaaattatttttaaatgttacacgatattccaccaggtatatcggaattgttccactaagtagatcgaaaatgtttcactcgtttaaatcggatgttgttttaccttatatataaacaatatttcagcaaatagcgaaagaatgtttcagttcactgcaacatttgatccatacataatgaaacattataaatacactaggtgaaacatttttcggtggaacaaaaaatgaaacgaattcccttaatagggggtttctaaaatatgtgggtttttttgttgcaatgaaatattttagttcactgcaacattagatctatacatagtaaaacattgtgagtacactaggtaaaatattttttgtggaacaaaaaaataaaccaaattctcttaatagaaggtttctaaaatatgtgggtgatttgttgcaatggcaggtggagcagagaatgcggtgaggcccaggacctgcatgcacgcgcgtggggggaggggcgcgcgggggagcgcccgatcggctccacccctgtcgggcgcccgagccctgtcattttcctcatttgacaactaaaacgaaaaggaaataacaaattaatatataatggttcttatttggaagataactttttttaacaaatcttagaaagaaagacactaaattttaaggatgctgagaggattagactcggtggagtatagcatacgtgaatttagtttgggtgtgtcgggcactcgggctagccttttgcttgtctttacgattgctaaggtgaatctcgtcatcctatcatatagctagcggtgctaggggtggcttagatgatgtcgtccaactgaattaaaatggatttgtttcagacagtaaaacgacaatcttgataagcatgggatttttaattgagggtcgcgattgttgacaagcatgtttttcgtggtggactctaccttactggtcaattgacaacgacataacggtataacccacgataattgaactgtgagcagcaagacaagaaaaaaaacattcatgcaactggttcaaacaactttacgtgatctcacatttagtgtttaccgaatgaataattggtgcataaagaagacaacatgcgaaagaagagatcgacggaaaccttcacgtttaatataaccaactcctcctacgtacgtatattcttgtccgtttatgagtcagaacgtacaaatctttaccttgacgaaatgcactacgccttaaaagtaaatagagaagactactgtatatgacaatccttgaggctgatcggttctgatcgctgtttattaaaactggcttttttaggggaattaatagtagcttttaactcacagcaaaaacatgatacttgttagtcgttgttacttggatgtctacctttttatgggcgaaccacttaattagatccatttgaatatttgattgatccgcgcttcacacttaagagatgtggatgcaaaatggttgcttgggttctggattggctttggatctaatacagaaagtagctgatcagtaacgcttcaatgagatctaaagcatttttaggtttttatagcagaaagaataaggtttaaagaaaaactataatacctggctgggagtacgttaacagcccgtttggttggagggagtttttagaaaggattgagagtttagagggatgatgctattaactgctttgtttggttgggatacatgggaattttggtgggatgaggatgtggaattgagggaggaactccctcttttttcaatacctgtgtaggggtggtaattgggagggaatttctcctttactttgactaaacaaatctcagccatccgttttcattaatgacctaatctccaactaaactccctatcaatttccaccaactctaccaaacaagatactgggattaaaaatcaaattctcattttaatctcaccatcaattccctcatgtaaactcccaatccccttccctcatatcgccaaacaagccgtaaggtgtttagggtaaaacggataatattaaatgagatatgatgaacgggacaactaaaagatgcttatgttatactcctatataaaatttgaatgctaaaaatattgatattaggaacggacagagtagaaagcaccaagagtagctaatggtaaaatattttgaaccttttattgtagcatcagctgactagcttgcaccgtaacagcgaatgctagatgaaaaattgaaaatacagcatggtgtactgtaggtaggtcatagtacacattacgaacaacaccaagtcaattacaaatggaactaattaattaggagtaatcagaggatctaataaaatgacactgcagggtgaacagaataattaaattctggcggtcttttttttagatcccttaaattaaagagcagatatatcaatatgatctatgctaaattgttcatccgtccggctccggaaccagaagatatgatcggcatcatcatattgattaaacgaaccataaaaaaaatgacatattgcttaaacggcacacatattgctcaatcattgcgatgcaataacacaaagtgaaaatcggaattaatgtggcatctgacatagcgacatttcactgcgaacctataagagatatgcctaggatcaagttttccagtgtattgccggttcagacgggcaggctgcatctgcgtgatttgctgattgcacagctatatagtccatgcctccactgtgaactgtaatgttctgacaatactaagcctgtgttcgcgctccagcctgttcccaacagtacgcacgaaaaacaaaacaatacattagcgcatgattaattaagtattagctttttttcaaaaatagatcaatatgatttaagcgactttcgtatagaaacttttttaaaaaatatatcgtttaatagtttgaaaagcgtgcgcgcgaaaaactgagggggatgagttaagaaacttggggataagaccacagcctaagcatgagtgcatgaccctcctcaccgcgtgttcgcaaaaaaagaccctcctcagtcctcactgcggcatagcctattcgccggaaattcttcagacttcgacggtttcaataatgggccacctgcagacctttggaccctcgaaccttgttttgaagcccaatatctaggcctggaccgctcagtccctgcgatcactggaagaggcttttaatgaggagatgacaaataaagctaaggaataagttcacctatcgcccctcaactttataccgagtttgtttgatatcccttatcctcaaaatccagaaatctccacccctaaactgtacaaaaccgttcaatcgcagtataacaagggttttgaattgtttaatgtgggatttttgacgaggcgaaaggaataaagcaggaggagtttgcaaacaaactttacatctaccgtccctcaactttacaccgaatttgtctaacatcccttatcctcagtacgagaaatcttcacccctaaactatacaaaacctcccaatctagatcctatagcagtatagacacctggtttcgctgacgtgacatcctagtcagcaaaaataaataaataaagtatatggggcccacacgtaagtgagagaaaataatgtgagccccacatatcttcatt

SEQ ID NO: 39893 - DNA, 4829 bp, Oryza sativa
cattaaacaattcaaaaccttgttatactgcgatttcggttgatatatacgccattcgagttttatgcaaagaattcaacccgcagtcggcaaggccccttgcgactggtccgcacagtacactcctatttgatttggccatgatcactgaacactcggatccaagcgacaggccaattgcctgctccacaacagcccatcagattctacgatgttgtcatttgtcaatcacaactgaagaaccggatgactttgatgacatcacagcaacacatgcatgacactggttctcaaaagcctccaaacacatgacgcaactagcctagctaaaccttaaaaagctaaccaacggcctataactaaccaaataaacaaacctataggctacagctgacctgtgaatgtgaatctatatctaataatatccctatgtgcacctgtgcaattacgcttgcagatcttttgtcacagcccgtccaaacccctctcttgacaacatggccgtccaatcattgaacacaccctgcgaccatatcacgtttgctgtatgaaagtcacataaggttgtgcatgctacaatattcctatctagaggttggcatttggtcttaaccaaaaaattggtccggcgacttcattctttaaaattttcggtcttcagaaaatgagaaaccgaacttgtaaaataaaacaactaaccaatagtttaattaaatcgatagtttggtctttcgtttgactaacctacctaaatttgttacaccggacgatatattatcacaggcaaggtacaaaagcacaacagcgacaatggtgaggtgcaataggtggtggcgcaataaaagaaggaacctcggtagcacaccataacaagcgacgagacgtagcagcagacgacacgccacggaaataggtggggttgcagtgtagcatggtggcgatatagcttgagctagggagggtactgagccatcacatctagggtttaggagtagtcatatatctgtgggtggcccttgaggtggtaggctatcaagccagcggttaaatttgggctaaaattaggtattttggttaaaattaggtatacgaccaatcgacctgaaaaatgattggtcacaaaaaccaatgttttgatcgatgactgatcttttgtatacttcggattctatctaccttttgttggtttttttctcgcccatatcactttgtgcgttaaacccaatacttgaccgcccaaattattataagacggtaagctgaaacgcactacatcaataaatcttaaaatgagatagttacactatctattaacttattaaagtaattcaaaaaggagcctccacgtttactcgcatgacctagaaattctcacattaatcgggaaaaaaagaaaagtagagtccataaagaaatacaattttaaaataataaaaacttgaaactaaaaaaaatataggaagaggagactagagtccatacaagtatacaatttagaaataattgaaatttggaattaaaaaaaagaaaactaaattagaagtcagagtcccacaatttaaaaatatctaaaattgaaataaaaaataagaaatatttgaagaagattctatagcccatatagaatataatttagaaaagctgaaattagtagttaaaaataaagaatattaaaatatgagcttagagtccatgtagaaatacaattagaaacaatggagattcggaattaaaaaataggaatattgaaagaaaagtctagagtatgtgtaggaatttagaacaaattgaaagtcgaaattaagaaaaacaaatagagtttagagtccaagtagaaatacattttagaaataactaaaattcaaaattagaaaataagtaatattgggagaagagactagagtccaattaagcatataatttattttggaattaaaaaaattaatattggaaaaaaacttagagtctacatcggaatacaatttataataatggaaattcggaattagaaataagaatattggaagaagagtataatgttcatataggaatttagaactaactgaaaatcagaataaaaatttaaaaaataaaagtagaatttagagtccatataaaaatacaatttataaataactaaaattcaaattttgaaaaataagcaagattggaagaagagtgagtccatataggaatataatttagaaataagtaaaattcgaaactagaaaacaattaataactataagtacaatacaaaattcaaaattatgttgctatttttaatatattttaataataaaatatgaaaatatttaagctattatatgaaaaatatatataacgatgctagccgcataatctgtgcaggccaccatactagttgcacataaaactaattatatgcagtaaagtttattagcgataaaaaataatttatggataaaaccttttacatgtgtgttcttacctatttaaaagtcgtgctggaaatacgatacatcaaaatcaactcaactctaaaattacatttagattttagctatgactgataatttgaaaagcaaacaatagtgttgtctaggacagtgagttttgacggttaactttgtctcatggaattctttggactaattgcactacatcttttacggacagctagcgaatgtaaatatataataaaggaatgataattgtgccgaccattttttttgtcttttataggtgtgttggatcattttttttaaaaaaaacaaatatgtaccgggccaattgacagagaatgcgcctaattaaacatcaggtgcactgcattccgatggatcatcaccaccaacctccaatagcgcgtgcacacatcgaattctgctttcccggctctcgcggtctcctccgccacaagcaaatggcgctgtggtttgattcgatcgaatccttccgctgctgctcatcaacggagaccgtggcgtcctgtcttccccccccccccccccccccaaaaccaaattaacgtcgtcggccaatccagctctcggcttcgatccctcgagctggcgatcgatcggcccatgtgatgggagatgtcacgagtcgcgcacagcgatctcattaacgctaacaaaacttcgaatcagattggtgtggccgggcagtacgcgttgtaatcggttaattagcttcaactaaaaagcccgatgcgagctattcccccatcggttatctaaagaagaaagctattctcccacatgcaagtgagaataccgtcatggccacgccgcatcgggcaaaatcgacaagcgagcaagacagggccatgtccaatcggttaaagctacgggacacatatgggatacagtggacgtgtaccatcgctcagcgcatgcagcagcagccggagcagccggccgattgacggcagattgaggcgctagtatactactactaggtgctgggaacctgtccgtgtcacgcatcacaagtctcgtctcgcagcgccacgcaatagccaccagactgacaaccggagacggaatatgcgtcaggccgtgcatccatcgtgaatagggaaaagggggcggaaaggagcacagtgaacagattgtcggctcccggaggaccatggccagccacagcgatcacatactccctccacaaaaattaaaaaaaaaacttgttttctgtatctaacgttttgaccgttcgtcttatttaaaaaaattattaaaaaaattaaaaagacaagtcacgtataaaatattaatcatgttttatcatctaacaataataaaaatataaattataaacaaaattcatataagacggacagtcaaaattggacacgaaaacccatagtttatcttttttaggatggagggagtagatcagtaacatgggacaacgccccagtttcgagtgaactaccaaagcaatgtagggctggattaatttgaggcctaaattagacttaccaaaattaatcatgtcaaaacttaccaaaatttaacattgacaaaatttagtaaggcttatttagaccacaaaacaaaccaaaccaaccagtcatatcccaaagcctttgattactgattaggtgctacgacgatgaaaacaacacgttcatacgcaactgcacatccctcgaagcctcaaactagcccttgagctactactaataagccacgaaaaaaaatagcaaagtaaaaataattatggatatcttttttctccgtgttttgggacaaacaaaatagggatagatggagaataggtttctcaagctcaatgcctaacggtgattattaatagagttattatctcatttctcattgataatagccgagcagtaaataggaaagttacaagcatattcttaaaaacggaaacccgaggataatcccaaacttcacattttgaggccattaagctaagttgttccaactattcaggatcgaactaaatctattagctcatggccacttgtctattcaattagtgtaagttagatgtatacaagagtgtataaccaacccaatttactctaatccaaatttattcctatgtttttcctaccgtttaatcaaacactcattcctacaaattttatgagtttttcaatcatctgttttgaatatacactggtggagaagtgctttttagtcccggttcgtaacccccctatagtcccggttttcaaaccgggactaataatccgggactaaagatcgctatctttagtcccgggtgaaaaaaccgggactaaagatcgatctttagtcccggattattagcccgggactgaaaaccgggactataggggggggacgaaccgg

SEQ ID NO: 39894 - DNA, 18985 bp, Oryza sativa
  unsure (1)..(18985): unsure at all n locations
tggcccgcgcccggccgccatcccgccgccgccggccggccgccgccagccccaacccgtgcctggccaccaccagcccgcgcccggccgcctccatcctgccaccgccggccggccaccgccagcccgcgcccgtcccccatcccgccgtcgtcggctgcctctgcaagaggaagagggggaggggaggaggagagggggtgagagaagaggaaggggagaggatggagataaggaaggaaaagaaaaagatataaggatgggagatagagagagagagggggggctacgcatgcgcttgtgcgtgggctggtgcgtacgctttattcccggttgatattatcaaccgggagtaaagatccctgggatctttagtcccagttgaccaaccgggactaaagatcctatctttagtcccagttggtgttatcaaccgggactaaagatatcggggggcctgacaaggcctgacagatttagaaccgggactaaagatcatttttagtcccggttggtacaccaaccgagactaaagatcaaatatgcccgctgtagccaccaaccgggactaaagatcatctttagtcccggtttttagtggaaccgagactattgtggatttcgggcgaccgaccaaagatggtttctccaccagtgatatattcgtataatactcctttatttttcatattcctgtattttcttagtcttacgtttcaaaggtaccatataagtatacgctgaaaagtagactacgataaaaacaacctaatcctaaaatcaactttataattaagtgttaaatcttttgttggctgattagctatgaacggatgagagtgcagatccattcatcagttgcacttgaagcatgaggccgggtccggattggacgtgcgctcgtgtgtgaaggtgatcgtgcatgcgagggcccaatcgaaacaaactgactatcctggaattgcgatttgtgggtgcgcggttgcatcggcagctggcggcctggcgatatatcgatcatcatcagggcgggttagcacatgatcgaggcatctcgttgctcccaattatatgcgtgaagctccttttaggaacacaaacaggagcctagatatacaagatatccaatgcggcaaaagctcttgctcttttctgtgtagaccggttacttgattagggaggtcgtaatagtcaaaagagggattagttggcaccagcttgttttggtacaagtttatcctagtttagtaacgactcgccaaatcaggagggaagggcatcgaccccctcgtgctctctagttctcattgacacaggaagctagattccaccaacttaggttattgttttatcggaattgctaaatatttgttgacatatttttatggctaaatctttcactttctaaaccgttggatgtgtcctaaattcatactaacagtttaatacgcatcaagatatgtacttttaggaagaaaaacaaaatcatatttaggaatcgatcatgtgacctcatgggatgaaggcgtgactgccccattgggctactatatttttatgatctagattaaacttacatcttacttatactataattacatgcgagtttatatatgtaattatagtacaaatatagtgtaattatgaaaattacatatgtaattatagtataaatatagtgtaattataaaaaatatattgtaattatgttacaattacatttgacagatttttgggctaatttttagtcgaatgttgtatagatagtcccttgttttatttgagctataaggacgcgtgcttggttgatagtttaacaacacgtacatatataggccatatagtaatgcagccgtggtgatgcatcgcagcttgtccctccaaaaagtccacgaatcccctggatgcgtacaatgcatgtggcgaatggcgatccatctgatctgtaatgttctgcatacttctcaatcatcacacgtacaccaaccacgcaaatcgatctgataaaaaatatactcctactcgtaagatccgctcagtggcattctgcacacgtacggctactttaagctagggctacagttaattaggtatggatgtttgtcccctgcaggctgcagcatctgcattactgcttgaacgtcgagctgcgtgttatcgtcccgtccaagcagcacatgcgcacagtgattcagtgtgcgatactgggtgtgagctgggtggcgcctgtccggtataactttgccgatgcgattgtcctcgtagcgtagcacattccttcatcttctgaacatgttttgtacaaatgcgaaccgtacactacctatcagccttccgatattaattgctgccatgcaattcacctatcagccctaagggcagtagcagcgcgtcttgagattttaccgaacctcacccgtcaactagataaaaactatataagcaacatacttcacgatgcaaagttaccttatagtggatcccaccggtaccgtatttttcccttttcatctcccaatctctctcctcttgttcttttctcacgggaatccgaggccgatttccggctcggcccaggcggctccggcgccaggcagcacggcggtcgagtagcaacagcgtcaggcggccgggcgacctgagcggtgacggcgtcgggcagcccgagtgacggggcggtcaagcggcgacggtgccgagtggatctagctgctccacgacgccctccttctttgctaaactccttcacggccgtgcgagctcgggggatctggcagcgagcccgatgaagctagcaacatcctcacctcccttagccccctcccatcctcctcttcttcggcggctgtcgagcatgaaccttgacggagcggatgaagctacctcaccagacgatagcaccgccgagcttgccagatccgccggctctagccttgggcgtcggcggcagtagctagaccgtcgccatcttccctttctcccttttcatcatctggcacgcgtaaagtttaggcagctctgacaaacactgacgaggaatgcggtgttttgtttggctccgcgttcttcagttggtagcgactgaaactaaggtggcatgaaatctatgatgtggaaggtctaatctaaataacacgtatatgcaccgtgaacgctgtgagagtaggggtgtgtttactcctgaaaatagttggaagttttggaaaagttgggaatttgaaaaaaaaagttagaagtttatgtgtgtaggaaagttttttatgtgatgtgatgaaaaattgaaagtttggggtagttggggtgaactaaacacggcctaggaatacttattgtcactgcgtcaaatgtgatatgctcatgatggtgcgctactagtgaaacggttcgtatttaaccgtgggacgacgtcactgcacatcactcatggagatcggagtagagtagagtagactggcagagcaggtacgtacagcctgtgggcaatggcctttaagggccttgtgtagttgtaaagctgctgatcatggagtatagtacgagtactctaggcgcacttctgaccatgttagctctgaccgacgagggggggtgttaatgcgatcgatgcgtacgtacgcctgccggtgtgggcgcgccaccggccacccgacccacggccacggggcacgggctcgatcggatcgcgtagctacctagcgtgcattgctccagcattcggatttttcgtcgtgcgacgcatgcgcatacatacctatatctgcacgcacccgtgtcacccgcgtgctgccgtgcgagacgtcacgtggaaaaccgccaatcgccatcatcctcttgccgtgccgtgcccccgtgccccgcggcccgcgcgctatgccgctatcgagaagcaatggccgcgaagccggcgtacatagctactgtagtagctagctttcagttggtgctttcgccgcgcgcacggggcaaacgggcaaaccggcgaactgttcgggcgatctccgggtgatggccctgatggggatgggtacctatggtggtgggttttggaacaaagctagcgatcgagaccgggtcatggggggaattattggcggagtggcgcgccggtcgatcggtcgatccattgttccttctttatgagcacggtacgtgatgccctgatggtacaataatgcatggtcgtcgtgggctgaattgtggtggaacaccgcggagcgcattagctggagcccgtggacacggtaagtaaacccgtccagaattggtccgtttcatacgattttttctgcagagtccatgtcacattattctcctcaatcggacttcgattacagctaagcatactgatactaaatttaagagcgacatttcactgcggatatatataccaacgagaagctaattaaccagttttattagtagcggcatgctaatacttttctaagagagggggagagaaagagagtaaaaaagaaaaagctgggacagtacgaaagacctaaacccaccacacactgactgcatccgatgtttcctactgtttgcacacagaagctctctgcaggagttcacgtactacgagccagatccctgtgacgtgcaggatgcatcaacggtattggttgcataaagatccacagcctaggcgtggaggacgactcttggtctttgcaaacttctgcgctggtgcgtacaggaattttgtacagttgtactgttggaggctagaatgactctgcctgcaggagggtccaagcttaagcaatgttcacttccattattagagttgatctattattaacagaagggacagcataggtgacagccacgtaccgctgtggttatatgttggtttcattgtttcacgatatatatgcatgcagctaatgtttcgtgttccggctttccggagatccgccactacgtttttatgatcgcttgctgagttcgggagcacgaaaaatggtgttacccattaacacatgattaattaaatattagcctaaaaacttaaaaatagattaatatgatttttaaagtaattttcctgtaatttattttcaaaaaacacactgtttaactgtttgaaagcgtgtgcggaaaaaaaaagaggtgagttaggaaaagaggggaaataacacaacctaagtgtgtttctaatttcatcgtaaatcaggtttgaacgagtctatacaaatagaaaagtaatattaacatctactgcatactttctatgtctctaaaagtctcaaaccctaacatcccaataagactttaagaagagaaatagaagatcataatacccttaattaatgtgaaagttatattagcggatatgtaggagaagggtattgaagtaatagaatttctcattttgcggattggtggtaggtaagaaggtagaaacttgtttattttgggataatttttaaactctagaagttgatttattttgggatggatggagtatcaaaatgaataaataaattataaacatacattttataatagacttaattatgctcatttgatatcataaatattagtattcaatgaatttaatcagaattacaatagtttgacttagaacaaaactagcaatacacttacattttggagtggagggagtgggacctagctacaacatgcacaagtataccaaaaatatgtaactaaaagttaaattcactaatttaaagaattgtgctctgtgagggctatcttactctatattttatttacatggccaggcaaaaaaaaacttttatgtacacaataatattttgcatataataaaattttaaagtaaaactagagttaattaatatatgcaactcctagattatgtatgttttcaaagatacaatatataaattacaccgtcataatctagactcatcattatctacttatattcatcctaaaatataaaatattttatatgagtaaaattcgttatattatgatgtagtaataaagtaagtattttttttaattaacatggtttttttatttaatctttgcggcaaatatagattaagtataccatcgttaatacttcataagtctcaaaataagttgtttttagagtctaatcatattgtcccaaaatcagttaatttttcatctttatctaccttttctcataaatcgagaacttttttccattcaatatgttatctatccatctaccaatagtattttttcattaataacggtattttgatcttctctccaaaaactaaatttttgttgggatactagggaacgaacaaacgagatttggagggacactaggaatctatttattttgagaatccatacatgcaacctaattaaatagcaccatacactatgtatatgtatggatctacgtactgaagcagggccatcgctcatacagtaataatttgctcgtacgcactcaaacaatgaaggagacaataaaccaaagcagcagggtcaccgtgacaccaacccatgttctcagctcactggagtactggatgcttggatcccttaatgccactgtcatggtccaactaattcccggacatagcaaatgcgtgtcctacattgtacctatcacattctnctccgcagtttcgcgtgcagctagctgcatgcatgcctagctttgtcagccttcttccagaggtgaagccaggataaaattatagtggggctcctcagccttctgagccttataacaatctcagacaaagtctattttagccctcttgtaataaatatatggatttaaattttagggggggtcttaataggggctctaatagtttattagggggtagggggctaaagaccccccgcccccacacactgcctccaccactgccttcacccctttctcactatgagtgtgtttagttcacgctaaaattgaaagtttgattgaaattgaaacgatcggacggaaaagttaaaagtttgtgtatgtaagaaagttttgatgtgatagaaaaattagaagtttaaagaaaaagttgggaactaaaccaggcctcggtcgatctgcaagactgcaagggtacacacggtaggtgagagctacaaggaaaccgtcctggccgccggcacgagcacggttgcgtgaccgagataagagaaacgcttgactactcgcgcgtgcaacacgcacaaccggttgaagaaaagaatggcgggacgccggccagcacacgcggtcgtcgtacgagagctctcgtgctcccgcagcgtcttcctcgcggtcgcggagtatacaatatacgtggaccggcacgataggccgggttcgttccagatctcgatccactgcaggcaggacggccgtaagctagctacaagaacatgtgtcgaccgatcggaggtagggtgtcaatttgcactgcggggaaggcgattgacatcaacggcaacgcggtgtgttcgatcgccaacttggttgacataagaaccaggcggcggttcgcaggctgctgcctaattaacgttctgccggagaggaggcatatgcatgcatgcaaggccccatgattttgttgggcgcgacgaggatgtcaatcagagcatgatatgatgatgaccaatatgcatgtgagaatagtggttccgccaacgagattttttattagataatgaaataaaacatcccggcctttactcatcagagttacagccaattgttacaaaagtaacacccaatcactgagtgtagtttaaatgaattaaacacacacccaacaaaataaaaaatcaaactaagataaggagagcacatttattcaagtctatttgtgaatctccatccatagtttgcaaagagttgcatgaccgttgtctcaagcctacgacatgcaaccttcataagctctcgatcatcttcatacatttgcagctgtgcccaaaatcggagccaatatgttgccctgaaaattacatacatatatgagatagatggtaatttgtcagaaaccatatcattcctagtcaaccacagagcccaacatatggcagaagctcctacaagtatgagtttactcttcttcttgtctaccccaaaagccaaccatcaaacatattagatatggtagtaggaaggtataaaccaagagagaactgtactgctctccaaacaaattttgtataatgacactctataaaaagatgttgaatagtctcatttttcatacaaaaacaacatcttaaactgccattccaatttcgtcttgccaaattatccttggttagcacaacccctttaagcaagtaccacataaaaatcttaatcttaagtggcatcttaagcttctaaataatcttgtttctctcaatataaccattattaattaaagctagatacatcgacctaacagaaaatattccattctgatgatattttagctaataaacgaaatatcatatttgcaaacgaaaacagtggttccgcctaccacgacttctgtttaaggttttggagtagcagtacatgagcaatattccaaatttaaaacataagatgccattctatttaaggtaacgagatgatccgtcgtagtagagtgtacaaggactacggatgtctcaagacacatcctaagttaggccgtgtttagtttgtgtgctaaaatttttataagtatagggacacacatttaaaatattaaatgtagactaataataaaacaaattacagattccgtatgtaaactgcaagatgaatttattaaacctaattaatctatcattagcaaatgtttactgtagcaccacattgttaaatcatagtgtaattagactcaaaagatttatctcctaatttacatataaactgtgcaattagcttttttcttcatatttaatgttttatatatatgttaaatatttgatgtaatgaaatttttaaaaattcgaaggaaactgcaacattgccttagctagctggagtagtatttggagaagaacgagaacgacagaagtacagaaccaagcgaccggccattccctccctacagtggaggctgtctgttttgcatggctcaacgcgcatctccacagtgctacggagcatacgctatagtatagcctataggcaacggatggtcctatgcaaaaaagaaatgcgtagtctggatctggccaagtgtccaaaaaataacaatgcatctatccgtcacatgcggagaaagctgtcgcgtacattggaggccatcaagctatacaaccagttaggggtgtctagatagatacatataaagttttggcgtgtcacatcggatattatataaattattatatgaggtgttcggacactaataaaaaaactaattacagaatccgtcagtaaactgtaagacaaatttattaaacctaattaatctatcattagcaaatatttattgtagcaccacattgtcaaattatggagcaattaggtttaaaagatttgtctcgcaaattagtcgtaatctgtataattagttattttttcagtctatatttaatactttatatatgtgttcaaatatttgatgtgacatgatgtaaaatttttatgtgcgatctaaacaggacctaaaattttagcataataccatatcaaatcaatgtgtttttgctgagaccagcacttttcctacagtaagtttccccgcggagtaatcaataaactcccggtgcctaatgccctaatctcatagtggggcccatatggcagcgccctgcactgacgtactgacagctcccagtgccccgaactctcgcaaactgccgccgtctcacacacaaacgtggccacacccccacacgccagtacgccacccacgccacttcactgcccttttggcccgaggccgagggcgtggatcgacgcctacgtgccgcctgccgccgccaccgccgtctgggaggatacggcacagtgcatactggattattaccgggtactttggtagagtggtgcaacttagagcaggtacaatagcagattataaaagctataaatatattttaaagagataaaagaaaagagaagagcaacgggctacagatctatagccagctacagcacggactgcaaaacgtaatgtgtgtgtgacagtgggaccagatattaattgtatagtaagcaactattgtatggattggctattacattggttatagatgagcaagtttaatagtatagcccgctagtagctccaattcatctatagccgatctaatagccaattcatacaatagctgcttattatactataaacatatggttccacctgtcatacacacattgcgtcttgaagtccatgctgcagctggctacagatctgtagcccactgctattctctcatcttttatctcattaaaatatgtttatagctagctaatagtttactattgtgcatgctcttagggcagtcccaaccctccacataggatggtgtatatggcattaactacattgctatgtaggacttttagcttatgtggcactatattaattaagagagagagtgaaaagaggaagaaactgggtctcatgcaagacagtttcaacacgagaacctatgcactagacactatcaggttttgtattgggagagaatagtgtcttcataataaatgaagaataaatatgattggtagagaagagagatgatgtatttattaatagcccactttaagaaccatgagttatagaatgtagtttctattgtgatgtcttattgacatggtactataaacactatttatataccctatgggttgagactgtctacgccgaaggatgcctcctgttcggggacaacgaaatcggcgacggtcttgagaaggcagcaggcatacctcggagagctacacacgtttcatctcgcatttatggttttacttatctcaaaaatgatgattgttggtcgggcgagtagcattttcttttccgagaaaattgatatcttgccattttcaaaatagagtttcgcttgaatgtcattctcaaaagtggtttcgctaaaatgacacctttaattagggacaacacgttataatgccatttcatctatttcttctcattttaatgattttttaatgttttttcttgctgagacagaccaaaatacccttggatagtctcatctctccctctatctcttccttctatccgttgcaaatggtgggtagcgccggcggcggcgcggctggggacgaggacggcggcggcggcgctgtctccgtccccagctgcgccgccgagccgagcagccttccccacccacgtcggcgccatccccgtcctcgtctctctctctatctcttcctccgccgccagacgaagcatcgcgagcagccgtcgttgtctcgcgaagttgccacagtcgttgtcgccgcaaccatcatgagcacagcagccgcagccgccgccgccgtcgtcttacgaagctggtgcgggcagtcgttctcgccgtagccgtctcacgaacctgctgcagccttcgccttgctggatccgcagaggaagatgccgactcgtcggatcccttcatcctgctgctttgcttcctagcttgtagctctcgtaggcatgaagcatgtgaaggaagcagaagctaaagccacgttagatgtgcatgtttcattgaatcaattggcagctagctgggaggaatcgttgaaggttctgatagatgcgtggatttggggattaattttttcacctgtttttctgtttcttttttccttattgatgtatgcaagttgttcattaaaaaaactgtgtactacattgatttctttggaggagtgataaaaaagccaaagatttgtcatccactacattgatttcattccaaaccgagtggcgctggcaccggcgccggcgctgcccaccaactacaacggataggaggaagagatagagggagaaatgagataggatccaagggtattttggtcatctcagcaagaaaaaacattacaaaaattattaaagtgagaagaaatggatgaaatggcattacaacgtgcacgttgcccctgattgaaggtggcattttagcgaaatcacttttggcagtggcatttcagcaaaaccctgtttagataatggcaaaatgttaattttctcttcttttccggacaggtacctttttagaaaaagcacaactgtgatatgcggaaaacattcacgcccctatatctgttgctgaatttgccccgttgtttactgcctacttcccccgtgggccccgtccaaagcaaaacgtttctggtagtactcactccatcccaaactagtacagtataaactataaaaagtttctggtagttgtgattagtgaaatactgacaaatcattcagtggagaaaataaataagatattgttgcaattagttgatatggatagtaggcacagggtaacaccgtttaaaatgcatgattgaaaaaacacataaatagaaaaaaaaacacaaatgaataggataaaaatacatatgcaaaacaaagaattggagaagaataaattttatgggaataaacataaaaatatgttaattggattattagagtttaggatcccttcaaatcaagactatttgtggaagaaagtttcctacatttttctcttgctcatttatacaaataaaaaacaacgagttagtcacaataatttgaatcattggctgttgctgtgtgatgactgaaataatggtaataatttcgattagtgagagcctagctgtgtaggatcgaacacaagcaaccaagcctatcagagggggatgaatggtagggaaaaccaaaaacccaaaaacttttagcggaaataaaagttaccctcaaatcgatggaaatctcgacgtagtcctatcgccgccggtcagactgctcgcacgccaccggttagatcgccgccctgccacctgaaaccgaagaaacacaaatcgaagaactctcaaagtagatgacaactttattgcttctctatgtgtttacaaagtgcaacaacatcactccttacaaaaatctcgagtaaactcgaaaccctaactaaactatcaactccacgctctgaaaaacgatacaggaagcctcacgctccctctctatttataccacgaaaaacctcctactcaaagtaagtgtagaactcctattcatgctgctgccaaccatcggcatacatacatacatgcatcagcatccatacaccacacatgcatcgctacatatatgcatacacgtcacgctacagtacccagagtactgtagcacatatacttatcctccaagaatcctgactcagtcaccttctcagatggtatcccgaccgcaatagacctttgctccttcctgagtatagtcccggtcctcaccattgaccaaggctgacctcaagttacctgcacacaatcagacaaaacaatcgtttctgggcacagatatcacaacctaacccacattagtcacacgcactcacaccaacatccacacatcttttcaaaccaattcgttgattaaatcatttgcaaagccaattgttcatcacaaatattaaccatgacaatgatttcacaagctgaaattaaatttcagtgttggtcatttttgctcacttctagttgtggaagagtagaattgacgtgtcaggctggtcgatgtttctccaagcagaagtatgttgaaaaacctaatcaaatttgctaaatggcactcaatagaaatttggtatgaaatcttatggattttagaccatcggatgcatgcccatgcttcttctcatccaactctaacaagcatgttctcttctccagcgcctgtggggcacaaactctaacagaagacatacaagtcagagtttgggataggggttggagtaagaggggttaggggagggaggggatggggctttctctaaaacatagagggatggcagcgagcaggatatgggcgggtggtgagatgccggtggcggcgcggagccacaggggtggtagctgggaatggattggtgttgggggcggggggtgaacaacacagccatgttagtggtgaggaggcgatggcttgtggtggcggatgcaacggtagggggcacctcgctaccgctagcttgaagataaggacatgtgagaatgaggagggggacgacgtcaccaagagaggggctcaccaacgctattcacgccttccgattaactgatgaggtgggggttaatgtgataggcggggaatgcggcggctaaacgacgatcttccgctcactcactcgcgtgcgagcggggaagaagggagagagggaggataagattacttatgtgcatgaatcacaaagcccacattaaatggtcaataatctatcaacatattaaagtaataaaaaaagaagcctccatgttcactctcacgcattagaaaatttcatattaatcagagaaaaggaaaaaaatagagtctttatagaaatacaatttaaaaaagcttaaatttaaaattaaaaaataacaaatattgggagaggagactagagtccatacagatatacaatctagaactatctgaattcggaattaaaaaaaataaaagtagagcttatagtctatatagaaatacaacttagaaataactaaaatttaaaatttaaaagtatgaaatattgaaaaaagagtttagagtttatatatgaatataatttagaattaattgaaattataaattaaaaaataggaacattgaaagatgagtttagagttcgtatggaaatacaattagaaatattgaaaattcataattaaaaaataaggaatattagaagaaaagtctagtgtccatgtagaaatttagaaccaattgaataaaaagtaaaataaaagtagagtttaaagtctatatagaaatatcatttataaataactaaaagttaaaataaaaaagaaagaaagattggaagaagagtctatatttcatatagaaatacaatttagaaaatagctagaattaagaactactccctccgtttcaggttataagacgttttgactttagtaaaagtcaatctgttttaagtttaactaagtttatagacaagtattgtaatatttataatactaaattagtttcatcaaattaataattgaatatattttcataataaatttgtcttggattgaaaatgctatacttttttctccaaacttagtcaaacttaaagcaatttgactttgactaaagtcaaacgtcttataacctgaaacggagggagtaaaaaaataaggaatattagaataagagtgtagtggaatacaattataaaataattaaaatttgaaatttaaaaatattaaaagaggagagtagtgtccatatataaatgcaatttataaataaaaaatattgaaagaagggcttagagttcatataggaatataatttataaatagcaaaactttaaaattaaaaacaaggaatattaaaagaggggtctagagtttatatatgaatacaatttagaaataattaaaactcaaaatttaaaaataatacaatataaaaattacccattggttagtttggttagtttagtacaaaattttaaattatgttaccatttcgatatattttattaataaaatataaaaatatatatgctattacgtgagagaaaatatataataatgctaatcgtatagtttgcatagactatcatgctgcaggtacacatgatataagaaggattcgtgtcgtaagttaatcaggcagtctcaaacctaattgtaaccagtcaatggttgggagaagtcgaaagcaagatatacagagacgtgcaactattttccaagatagcaacaggtcatctggcagcactttacatgtggtgcttccattgcagcaataagccatggccatggtaaattcatgggcatgcattgatggggacacatgtttttagtgatccttttcagccttttccacccagtaccaccctcaccctatgcagctagtaggtaggctttccccgatctaccttcctctctgactctctactttcaccgaaaccaaagaattgcttagaactaagctgttggttagcgagttaattaatcaggatcctagtgctgttgctatgtacggagtagatgtatacttatcttatccattaccttcccttgcaatcctggcaactcttgttcacatgtcatcacaccgtgcctttccactcttgccactgggattggacttgattaaagtaaagtaaattcgtgctcgcactgcaaatcctggtcctcatccaccttattagtcaaactcctgtgggtgtaaaattattatcccaggcttagagctaaaaaggtatctacctagctctttggaggcttgctttgcgactactaatatactattcgccaatgtcttcctcatgtgcgcgatttgatgcattgttaaatgcggctaattagcatccctaatcctacttcacgtggctaatgtaggtttggggtggcaattgttggtggcttggtgctgactttgtagcagagcacaactcagcaagtatgtatgtacagcggaagggcagtctgagccaggttaggagcggattacggatgtgcatcaagttgcaccaatatactagtaattatcatgtaagaagcgtaacgtctggctgcagctgcttaccaaattcgcctactaccggagatttttaattacttggtaagaagaacaaacaactcgcaaaatacaggcctactcggtcgctgttctaaagaaactcagttgctgttctatcggtccttttcaggatctgtataatccataaaagaggacgaaaaacccttgatcaaaaggcatgggctttgctttgttgaccccgcaataattcgccacctctatatcgatgggtcggtggctcggtgcgtagccatccatcgcaaggagaccgcactggacggtcatggcgtcaaaaacgacaggggcatgaatcgcaaaagcaataaaaacaggggcatgtacaggcagacaatccagtggtagttaacctcgttttcatcgcatcatttccctcaattccaagctccggcggatcgatgcacaccacaactccacaaggagacgcataacgtgaaaccgatcgctcgctattttactctgcaaattatctcggccattcatgagcacgcggtgttcagtacgttcgagacactgagacagcgacaatgtgttttgtgtctatatagaaacagatcgatcgcacagtaacacagacgtcgaataagtaaacggatatactactactacacggctgtaccgcatatacttggagtgatccgtcccgattaaacggacaacttaatcccttattaatcagctagtggcacgtactagcaaggagaatctcataggagcagtaacaatccagctgcaaactataggagctactactacctctggctgacaggggcagaaaaatggacggggcccggccggaccatgggtggtccgcggcctgcgtctcgatgaaagccggcttgattagcgcacgagacaccacagctactcgaccgggtggtttgtgcttgcgctttgtgctttgcttaatcatgccgcgcccgcccgagcgggccgacggcttatgcaccgctcgcgcgcgcaggggccaaaggaggcagagcgacatcagatgcgtgcgtgccgccgtgccgtgctcctctgcacgccacggggaccgcgcgctctgcgtcgctcgatcgggccgagggggttttcctctgcttttctctgaggccttcacgtatacgggggcgcaagcgcaacgcgggcaccactgagagctctcggccgtggtgatgccggcttgggcatcggatgccgttgtcggtatagagggggagagctttgatggagtactgcgccagtgtgccgggcgcgtgatggtcctggccctgtgcatgtggtgctaccctggtatagcctgggaggtgtatccgttctttttacgtgcttgggtttagcatctcctcttttctttccacctttctttctttcggtttatcaaatgcatctgcgcaacgaaacttcaaatcgtgcacaccgctgcaggtcgtctattggaaaaaaaaaaggcttaacagatgctgagtggagatttcgttggcatactcaggggtaggagtactattctagggtagtacgctgaaacgaagagaggacaaatggcaccatcaaacagtgccaacaagtcaatggtatgtgcatactccaaaggacgcgtcgtcggctgctggtgacgggaaaccgaaaagtaaaaccaaacgacggcgcgccacctcctctccgtttccaaaatcgcattgcctgcctagtccacttccccgaaacggcacgagcggttaacactgcctcgcgccgcggccgggcacaacccgctgaagcctgggcccccgcggtcgcggaattttaactccctctaccccctccatccccaaggacaagagaggagaggagaaggagaggccgcgcccccgaaaggccaaggacgagcgtaccaccaggtcaccaacccgacagtaaacagtaacccccggtggtaacaaaaccgacgatgacgacgacgcgaggcgggcagagaggggggaggggaggggaggcgttggcatcaccgcaataacaacgacgacggcaccagcaccaaccaccagtcgcgcagacaggcagcagctgacgcgcgcgcgggggcgagggcaggaacccgtcgcgattgggcggacgacgaaccggtcgcgcgcgggcgcgttcgggaatcgtggtggatctgacgccaccaccgccgccgccgccgccgctcggttgctcctctcctcgccgcgccgtcgcgtgcgtcgccgtcgcctccttgcccctagcgggcggccgggcaattccccgcgcgcctgctcgatctgcctcggtggtcaatgcgggcgaggagatgagcggcgccgaggaggagg

SEQ ID NO: 39895 - DNA, 2207 bp, Oryza sativa
tcctcctcctgctcctccacctcggcctcggacgacgacgaccacccgcggcgaggtcgggatgcggcggctgctgctgctgcggcggcggcggcggcgctcgacgtgtggacgtcggagccagcgcccgtgcaggaacgacgccggaggcttctccagatgatggggctctccggtgacccctctctggcgcgcctcgagatgggtcgatcggcctcctacgacgggcccatccggccggagacggtgtcgcccatctcccgatccagatcggatggcagcgtgccggcctccgccaccaagcccccgctcgcggcccggtcgcgccaaacatcgtccgactcctccgaggccacgccagggggagatgacgcggaccccaggtgcctaatccgaaacctcgacgacggcagcgagttcgtggtgaaggaggagtccgcgctccgcgaggtgggcacggggaggcagctcaccatggaggagttcgacctctgcgtcggtcgctcccccatcgtccaggagctcatgcgccgccagaacgtggcaagctccggttcgagcaacggagcgtccgctctcatccagaggtccagctctgattcaagcaacggcgcgacgcgccacaggcggcgcggcagctggctccggagcatccgcaacgtcgctggctccatggtggtcggctcccgcgaccgccgaagcagcgacgagaaggacacctcctcggaaaagggagggcgtcggtccagctcagccacagacgacagccaggaaagtgccagcgccgtgcgccgtggcccggagcgtgtcaaggtacggcagtacgggaagacatgcaaggagctcagtgggctgttcatgaaccaggatatacaggcgcacaacgggtccatctggagcataaagtttagtcacgacgggcggtacctcgcgagtgctggggaggattgcgtgatccatgtctgggaggtgtcggagcttgagaggaaacgggagggaaatggggtgtgcaatcaacttgttgccgtcgtgtgcaatggttcgccggagccgatattggcattggcaagtgttgatggaagctgttgggagaagaagcatcgggctagaatcttggaaactcggaagtctgcgagctctgaccggttgatgtttccagagcatgtgttcgcactatcagaaaaaccggtcaaaacttttgaggggcattcggaggatgtgcttgatctctgctggtctaaatctcaggtaatgttacaaggtttctgttcattcaaaattcctccactgttgatgctccttgaatactcctataaaggaaaaagggtgaaggttgaacataatctcacaacctaaattccactaaaatttagtagtgacagagtgtgcttcttaactctcagttaatttcaactatagtcttaacatctatggtgaaacctcgaagtgcattgttttccatcaaaccatctttgtcataactgttagtccaactgtgtcagaacaagacactggcatcgagtagtcaagggctggtacagttcaatccttatcacactttggtgtagttcttctgaaacatggagcatattgatgcaaattggtgtcctttagctctgaactaatccttctttgttcattggaaggaaggttagaagtgcataagcagcaatctggcgaattgcctgcctatcgattgcatcatatagaagaggcactgcccaaattctgccatagactagttacttaccatgtccaagctcatcaattctattatatctgttacatgatgtgacatgaatactcctgtttttcatttagtgactaaattttagaaatgattcactaataagatacacaggaatgctatgatctacctttcagcatgctgtaatccctaaaatggcgataatgtaacaattagaaaaataagtttgttggattatgtcctatgaatcaatgtaaaatatgttgttctgcaaaatccatttagccttaatataatctcccatactagtactagtagataatataaatatatttgaggagtttcagccttcttttggtactacgttacaggttatttcatttattcatgtttaagatggatataggtttcaataaaggtcccgatgcatgactctggtgactcctgtatacatagatgaagttaacttggtaccatgttatatcattatttgtccaaa

SEQ ID NO: 39896 - DNA, 2734 bp, Oryza sativa
aaagtccaaatgcatgatcagatgctcttaatttgttgggcccttgttgtaagaagatgttagtatctaattggctttacattgtgtttggctggagaagataggaacttctcccaatgcatgcaaaacggagcggctcattagcacatgattaattaagtattagcttaaaaatgaaaaatggattaatatgatatttaaattaactttttttttttgcaaaaaaccacaccatttagtagtccgggaagcatgctcatggaaaacgagaaagtagaagatgggaagagggagtattgaacacacccagagggtagttaccttttgcagctagttatacatatatggtttctatataccttatgtggctagttacatatccagacttcacatttgtcaacaacagttacatgcttccagcaatgcatccccaaattatgattgctacaattccatgaatcttgtagtggtattcttatggttttgtagctattccagattttaatttctttctttttcaaacatcgtgcagtacttactttcatcttcaatggataaaacagtgaagttatggcatatgtcaagaacttcatgtttgaaaacattttcacatagtgactatggtaagatctcgagttgacattagcagttttgcgtgttctctctctcccccaagcacatatgacgtttctcactctgcgaacatactctaaattttcctttgctgctttgcgtttcagtgacatgcatccaattcaaccctgttgatgatagatacttcattagtggttctctggatgaaaaggttcgcatatggagcattccgggacgtgaaattgttgattggaatgatctgcatgaaatggtcactgctgcttgctatacacctgatggacaggtttctacactatatactgatgtatgtgaccgaaaaggtctttttgtatgttagctctaataccttgtctcatattttctgaagagagcattagtcggttcccacaagggcagctgtcatatttatgatacatctggtatatctcaccctctcatgatcctcatatcttatgagtgtatttctgtatgtttttggcttacttttccttcaggaataacctgtctctcgatcttatggccagataataagcttctccaaaagaaacagattgacttgcaaaataagaaaaggaagtccaatcagaagaaaatcacagggtttcaggtgcttctaacacacttttgaatatgaagcaaactatgtgcagatcacagatcttctcttactgaattgtagttccttgaatagtttctcccaggaagttcttcaaaggtgctcatcacatctgcagattcacgaatacgagttgttgatggttttgaactagttcataaattcaaaggtattaagttttgtgccttggaacttattcatatcagattgtttttgttcaaggtttagtatcctttttctcagatatacaaatactcctgaatgttacttacctgcttcttttcggttgtactaagtacagtcccagtcaaacttcttattcatccataaaccacctttgttacttgttacttttaccactcctttttttgttgcagtgttgcactggaatccaggtgtatagagttatgctaggaagtcataataggtctgcagtaaccaaatcatgctgtgatcatcagatcacaaatactgcaattccctgctcattgattaaaattttgaacgtgactagttaaaactagtttctcctgtcgttttctttcaacaaagtgccaaaactgtcagaatccactttgttgaggcaatagttgtaatgttcacttaacatgttataaaatagttatatccatctttcgatgagtccaatttctgtatacctttccccgtgaccttctatcattggttgttttgagtttaacgtcttctgaattctgataccatgcaccgtttcaggttttcgaaataccaacagccaaatatcagcttgcctgtcttcgaacgggaggtatgtgatctctgcgagtgaggattcccatgtgtacttctggagaaacgatgacaattctgcacagggcagaagcaaggccgttgtgtctgtcacaaattcgtatgaacacttccactgccaggatgtgactgtagctgttgctttgccatctgctggatcagcaatgacgtccagaacaaattccaggaagaccgaggagcaggatagcataccgcagcagcacactcaacctgacaaacagcaagattcctctgatttccaatgcctaagcggcaacggcctaagcactagttcaaaccacagtggtgacagaacatctgcaacttggcctgaagagttgatgacaccaagtaagcagagccctccgtccagtaccagccttcccaacggtgctggccaagcaccaagccggtcggcctggggtttagtgatcgtcacggcaggccgtggaggccagatcagagcatttcagaattttgggtttcctgttcgagtatagcagctattatcctggtgaagatgctgcctgtactctgtagtcgctgcccctgcggcagagataattttttgtgtatagctaggaggatacgtgggcaatttgcacagcggtctgggattggatctggttacttgttaccaaggtgcacaaagctccgttcttcgactaacttactacggcctgggcacacaaggtatgctgaattcatttgccc

SEQ ID NO: 39897 - DNA, 2995 bp, Oryza sativa
atagaaaagcgaaaaaaggagttgcatagagtggtgaaattctttacactagcttcgcaggcttgcagtatttagtgttacgcgggtaaagtaattagaaagagatgaaaattttgggttctggagcttgtagtccttgctcatggacaaggctggaatagttgagttacatttctggtgtatatgttctctcgttcaatgttcaatcgtctactgctcagcattttcttttgctgtttctggcagtgtcttttatcttttgtaatcatgtacgccatatatgctttgcctgtgcgccatgtattgctctcaacttctcgtgtaggtgtgtagaccgtagctgcaagaaaacgccatccagtcatatacgccccctgcgtctcaaggagtcgcgtaccacggaccacggtacgtcggtaccagaagtcacggaactaaggtggtgtttggatgcagatacttaactttagtctctatatttaaacactactttagagtattaaatatagactacttataaaactaattacataaataaaagctaatttgcgagacaaattttttaagcctaattaatccataattagagaatgtttactgtagcatcacatagtctaatcatggattaattaggcttaatagattcgtctcgtgaattagtctaagattatggatgagttttattaatagtctatgtttaatatttataattagtgttcaaacatccgatgtgataggaacttaaaagttttaatcccatctaaacagggtctaaaaagaagccgtccctcattttcgggaagtattcacgtaataatgaatcaaaagcagcaggcatgagatgtcgaaactaatcatttctgtgaaaaatctggtagcgaagagatggttttcagagcggttgttaaattagagaacaattttgaaggatcaagatggtctgcaagaagcaaaagcactccaacacatggcagtgaaacatacatgcgacgactgggtgctccttgttttaagagtaaattgtattatcagcacataaacttagtaaattatattaatttagtatataaacttgatacttgggtgtaatataacgtatgaacttgtaaaatgttgtaaaatgttttgtttgatacacgaactttgatacatgtgaaccaagattaaaaggttatgacatggctagtttgatcagcataatgcaatcttgcaagacaagtgtaaaggaaatctccttggttgttatttaaagtccacatcgtagaagcctcgagtatttgctgcagtttcttacatgcaaaataaaggaaaagactatatgtactaacttttttttactaaatttttactaacactgatgtgttatgctacgagtgtatctagatttttcataactcccatctacctaaatcaaacggttgagataattgttagtaataacaatttagtaagaaaaaaattgtatgtgagcatcccatttttattcaaaccagcctctttgcatgcgaattgaatggccaacaaattagcatggaaaccaaacaaccatgcgtccaccgaggataatgtgctgatcaattttgactatttcgttttacttaggcgtcgatcaaacgtgaacagtggaagtatgtgacaaggacgccggtgaacagtgggagtatgtgacaaggacgccgcatagccatgtctttttttagaaggcataaaaaatcaatgaataatgcaagggtagaaagtaagaagaataatgtacttcctccttcccaaatatagaaaacctagtcatatattagacacaacataatactatgaatctagatatgggatgtgaagaacattccatccaaattcacattactatattgtgcaccaagttactgttttgggacggagggagtagaaaccaagtttacaaatataacatgtctcatgcaaatgtcataattagtgtccaacttggtaaaattaatcttgccatgccatttgccacggctcgatacactggataagttcgtgtatcaaaatgaacattttacaggttcatgtacaaaatcgtattatctaataaatttatttatcaccaatacaatttaccttcattttaaatatggcttacaccagcatttcaaaagaggctcatcccgctttaacatttttctcatcagtccctcctaccttagactgattgtaagtaacgcgagaaagatatacttatagaaaatatatatgatgctttatatagtattaaaagtaaaaaagaaaaatcaaaacatacacccttccacaatgctaatctccgtaggagacaagtttatatttggactttggaccctaaaaatgagggccactctcacggccactctcggccagcaccaggcgcaagcggtggagaaggggagacagcaacggctgaaagtacaagcgacaacaaccagtgaagcacagccgaagttatggctgactggtgttactccccacccgcctcgtctagcttctaaataaagcgtcttgcttctgctcttcctccccactcccccacccctcccccaccacaccagaccagagctgtatcaaacgcccacccctagggtttttacccctacggcctccctcccccactctcccctcctacccgagctccccgccgccgtcattgccgcatcccggggcgccgagcccccctccggcccggaatcggcgaggaatttgaacgccatgtgaagcaaaccaggcaccgtaaagagcacacgcgcatccccgcgcggacgcttgacaggaacagatcccaccggttttacggatctccgggagtcaggaccggtggcgcggaatagattttttttttggacctaaggatttggaagcctctggaaccccaaccggattcgatccgaggacatggtgatgatgatgatcaaatccgtggtttattacgggagcacctccattgggcatgtggaggtgtggcccaagggcgggacggacctggcgg

SEQ ID NO: 39898 - DNA, 2231 bp, Oryza sativa
ctaatgatactgactggaacctattccagaattcacttttcttcatgattattgtgtgtactggacttgattttattctatctcaattttcaataattgaactaatcgaaatacagaatctggcctgatgctgttgaatgacagaggtttcaggaacagcatttcatgtttcagaaatggagaagttttgatttttgagtgtgacacttttaatggttgttgaaacatacccaatgcagcgaagaatttgcttttcttcaatagttcttgactttggacttgacacacttgctatcaggagttcattgctgcaattgatcatgaaccgtgaactgctgaactctgcgtattgaaagacattgtttgagggatgagtgaaggttacttgaataatttgaacgcattaatctaactcatctgctagcaacttaatgtgtttcttgcttccacttgaattatttgataattacatctatattaagaaacacactattttcggcctaatatttcctttacatagttggattaaatagcatttaactgtggtcaggacagtgctataaatattcctggtattgatttcgctattttaagatttggatggatatagagtttttaatccacacatgccttttttttaacaagtatccccttttttgcatttctgttgtaccttttattttctgtactactttgtggatgttactctgatatgcaggtatgtgaacaaatgtactagatgccatgccttttacatgattgcattttgtattagtgacgaacatttctcctttttcttaatccttttcatttcctttcattctctcctgcttgcagactgctgtttttcctctaggagcagaagagatccatttagtggcaatgacttccaagagaaacttgccgaatcttgcttgtttttggggctataaggtgccatcgggcttgtataattcttgcttgagcatgttgaatcttcgttgccttggtattgtgtttgaccttgatgaaacattgcttgtcgccaataccacacggtcctttgaagacagaattgatgcacttcagagaaagttgagtaacgagattgatcctcaacatattagtggtatgtcggcagagatcaagaggtaccaagaagacaagtctatcctaaagcagtatatagaaaatgatcaggttattgatggtggcaaggtttataaagtacagactgaggttatcccacctttacctgataatcatcagcctatgacacgtccaatcataagattacaagagaaaaatattatcctgacgcgtataaatccattggtatgtatttcttcaatcaacctttttctagagtcatgtgatgccagatgtctgttgtctctacatctgttacattgattaacataaaaatgaaataccacaattcactttattttgcatcatgtgctttgattgagtttaccatcataactcaattaaatctattttgtactctaattttactaattttatttggcactgctttttaaaagaaaaatatagcaaccttttggttttggtgctgtcagttcttaatgtattacaaatcatgtaattaatgtgactcaaattgaattggcaaataagccttgcttagtggttggtactgttgagggcaagttgcattagctggtgtggcaactgaaaatttgatctcctattgcgatattttgagcgctaagcacttcccgtctattcagctttgatacaaccatgttccatgtttccatgctgttatactgcctagttgattttccctttttcttaattagataagagataccagtgttctggtacggttgaggcctgcatgggaggatcttcggagctacttaattgcaagaggtcgcaaacgttttgaggtatatgtgtgcacaatggctgagagggactatgctttggaaatgtggaggttgctcgatccagattcaagattgataaactctgttcaacttactgacagacttgtctgtgttaaatctggtaggtgttagcattactattactttcaaacaacacaactaccaaaggaatatagtgtcatttggtatattttgtacaccgcaatcaatgttttgtgttgtctaatttccttcatacaaatttccatgtgcatgaacataatgtcttggaattttccatcttttgacgttaatgctacaccactcttataggctctcgaaagtctctgctgaatg

SEQ ID NO: 39899 - DNA, 720 bp, Oryza sativa
ctgtgatttgccctgactctgttacccgtgataccccagtggagtgtggatattagaagcatgacagttggtaaaatggcttccttgcgtgcagtagattagccaattgtattgctcgaattaatttgtttcttcagatcttagatttagggtggtagcttgattggacagttttgctacgtagtggtagcttcaattccatgggggtaattcccatggctttgattccagttttacactgcttcctgctgctcttcatggccatgtttggttcatacagcaaccgggttcggctggtgttggtccaaggcttaaggaggttggctatgtatacagattggtgccatactcctgcattgggtgatgcatgatgctgaattgctgattgatgctacagagtatatacctgcattggttgaagatctttatgagaagctcgaatcttggtgctacgtgcacaatgttgtccctctttctgtttatctgtatgcttgagataagcagactttggccttctatttccgtgaggagatagaggccggagggtgtatttcttatcacctcaatcaaaaaagataattagaaaaagaaactgtgatggctcataccaagaatagtgaacttgctttgaatctttaaggtacctcgactacagtggctacaggcatcatgatttttcctctatgcagaaagcattttcgactacgaatgttaagatcg

SEQ ID NO: 39900 - DNA, 1017 bp, Oryza sativa
atttgagtcggtttttaagttcgttcgcttttggaaatacagattcgtgtttgagtcggatcttaagttcgtttgcttttgaaaatataaaaggagtcgtataagaaatctttttaaaaatactcgcatgctaacttgagatgaaagtcagactcctaattgtagcttataatcttctaaaaaaatatccaagcgaattcccacagtgaatttcatcatggctaaaccatataacaataataagattaaaatagcattcacccgttgcaacgcatgggcattttttctagttttatttaaatgatcatgttaatgggcagttatatttgttatcatgagaaattgtgaaaacttgtggacttcaggaaataaccttggcaccaggaatttctctatctctacaaagatcatgtggcttaaggcctaacttacattttcccaaattatttgaacttgttttttcccaaattatttgaacttgttttttcccaaattatttgaacttgttgcttcacgcaaattgttctaatcttcttgcagtcttataagattgcttcatgtttagtcatatctttctttgtgcatgtttcaggttaggattttaggagaaaaggtaggtgaaggaattggaaaaacaagaaaagcagcaaaacgccaagctgttaatatgtccttaagaaatctggcaggtaagttcgttgagaacttcttggtttcttgattctgcgtggcaaatgccaaatgtataactaaagtatggggccatggtgtttaatatttttgttgggtcaacagagaagtccaggttgaattttgttaagacagagaggtacacatagcacatctgacaataatgctgccaacaaattacatgatcacccaatggcgaacacagtactaaaatttagcgggtgctagttaattaaatctaccacacaagattatcatcaaagtaaatggtatttatatgttttgccatgatgccattgaaattaaaaccataacttttattagttg

SEQ ID NO: 39901 - DNA, 1501 bp, Oryza sativa
cttgcagaaaaatttctaacgtctgatccggataagatgatgattctgaaggagaatggttttagtagtaattcaaactcattcagatattcgggaggtagtagagatgacacatcaccagttgcaagcacttcaaacgagtctagatacatgggcgagagagttgatactttaagaaaacctgctggttctgttgctgctctcaaagagcttgtaagtggctgccttaattatcagcttttagacgagtgcaatttatttactgaactatgttgtgatgcattgcagtgtacggttgagggttacaacttagttttccaagagcagccatcacgtcctcgtggttcatcaggtaaagaagcttatgctcaggttagtacttcagtgaatgaatgtccatcgaacttctatatggtacatgattaacctctaaagtaggttgtttagaaaactaaaattgcaccaactttacaacttacaggccatcaaaagatctctttgatcaatctgtatttgatgtgatatgatgccctttaacactaatacaatggaagtagtataagatgttccttttgttgtcttgtcaagagctgttatccttttagaactttttgagtttgcatgtttcgtttacctgcatttggtttttcaggtcgaaataggtggtcaaatcctgggaaaaggagttggagcaacatgggaacaagctaagctgcaggttgtaaatagataagatagatgaaatgatttactctgatcacttcaatttgttaaagtttcaaaaccaacaaataaaccctgaggtctgagtttctgccttgctatgagcagagggagagggattgtttcgtttaactaagttcgatttgtggagtaaagaatctttatactagctgtttggactcatagtaactatttaaatgttttcttttctctttgggacttataaggagggtcatttttcaatgtgtacagcaagatgctgcctttctcttgtatttgttttaggaaaaaacatacaacatgtacaacattgacaacatcaaagataatagttatttaaaacttctagtaatgataaagatactactacgttggtagatgcagcaattgcctctagaaaatattaaaagtgcacacatgttaaatgtttacagactcaacttggttcttgtgtagatgttgtctcttccactagacaactttgtatgcgcccatttgtgcattattcctgcactgcttttttacttaatattatgttcttttataggctgctgatgaggctctaggaaatttgaaatccatgcttggtatctttgcacataaatcatctggatttcaaaggtgattttaatctccacaatattagtcctctatttaatctaaattggtttgtgcacatgcaatgccaatgtttataatatttattcttttccacaggtcatcggtatcaaattttaatcgcttcaaaccagatttccagcggaggggctgcaggaat

SEQ ID NO: 39902 - DNA, 1259 bp, Oryza sativa
cagcggcgatggtggtggtagtggcgatgaggggaagtcggaagaaagagagagtaagggaggggtttgaaggtttggttgtcttgtactccctctgtcccatagaaaacctaataggctagtacatatatctagattcattgtattagaatatgtcaaatctagttttagattttttttttgacgaagggagtagtacacaacataaagtaatcgggcggtctaaaatattaaaggattttttgtcaaatgatgatagaaggtccctaatttgcatagcagcacaggtgaccgtggaatgatgatctgttgagatttctgacagtgtgatggcttctctcaggttttgcagtactggaagaggcagacttgcctgacggtttccgtgttgcaggggccccatatgtaggccccgagctcacaatagacatggacagcatgtataattagatagctgatctctgcttttccagagtatcagatcagatagctctcactgcttttcttaaagtagcatttgcatggacaatacattgcacctcgccatcttgtatatacgattatgcatgtgtgttgtcggtttgtctttctaccatgcttatttaccagttggtgttggaatgcttttttgacagttttgctcttgtgctcctctacgcaatgtcaatggctaccactagttttctaagctgcccactgtttggaatagacctctccatttatgaactactactacgtactcctagttaactttgcattaccgagaattaaccagacccggtctttggtgccagtatgccacctttggcttagccttatcactcatactagaaaggagagaccaaaccacatcaggcaatgatcattagctcgatttctcagttatttatcaccattcaataatcggcaataagcgggtaaccctgaaatcacaagcttacaggtaggtgcaaacctgccatcggaccaaaaactcatatatgaatagccacaacactctcatatctgagcagctcctctcgaacaccaacagctggggagtcaggggactagcagctcgttcgtcagaagtccaccaggaccaccgccttggacgtcgccgccacctccgcctccacaggcggcggcgccggggcattggcgacacggcagttgcgtcgtatctctcccttcctggggttctgcagctcccccatcttgatcatcccttcgacgaaggccctgaagaaggcgccctggtcctcgccgaatttcctcac

SEQ ID NO: 39903 - DNA, 3380 bp, Oryza sativa
caataattgcactgaccagccaaacgaacctggaaattaacaacccaaatcttccaatgttacagcattgtgcagacatggatattgattgcaacgtatgatcatttatttgtatctacatttgtacatttgcatgcaaaacagcaaattcaacccaagatcgtaatgacaataagagcattatgtgttttgcttacatccaaattagtacggcccactcatgacagaacagttcagttactagtacagttaagagccgctgtttacgttatcaaatgtcagaaaatgaaaatgcaacggaaggataaatcatactcggctccatgtcaaccgcgtgaaaagtgtaaaactcaaaaagaacatggctagctagcaatctagcatagtgacaaatcggcagcgtgacccactgcgaaagcaatgctgctttgtctccgtcctaggtcctcctcctcccctcggcgatgagccatcaacaaggacaagttttgacagcaccccgacacagtacacgatcgcctgcacggaaaagtctaaaaaggactatacaactgcagctccggccgttcggcttcacgtacgtagccatggcccctagctcccccaccgtccggcctttcccggctcgctgcacggcggctacgtcaaacgcgcttgtcttgtgcacgccgaggggacggttcatgcaaccttgcccccgcttgatgttcagtgtggtggttacagggagcacgggtacatgcactgtaccgtccctatcaggggcataggactatagtgcacatgaaaggataagggagaggaaaacgaaagatggttttgacaattcgggtcactgattctttcggagattttcgtcagtccctatgattttcaaacacacgcacacacgcctttgttttggatgattccgaatggaattcatgcggagtaatccaaatttcaagttcatatgaaacggcatgtgacacacacgtgactacggccaccgtacgcacgatgacgagagcgccaaccgccggattttactcccaggcgaggcgattctcaatcgctcgttggttcgtcaacgaggtcagggctgtgttgtgccacctgggttgggggtgaccaaccatgcagcgaagagatgaactaactttttgttcgttacgcataggcgttgcatcgcacagcgggcagccagccatgacaaaaaacgatcgagatatttggcacttttcttccttgtcttttgcctgggggaggctgggtgcctcctgagaggagggaaatgccgggttggggagaggcagaggcggagcagcggattttgcacggaaacgcgaggaaaatggaagagaaacgtagtactactagtactactactagagtgggcgtggacgcggcggggcggggcgggagggggtgtgtgtacgtaccagggcgacggcgtcgcgggcggccatgacgatgatgtcggcgcaggagacgacgccagggcagcgctcctccagcgcctccttgatctcgtcgacgacgtcgaaggagcggagcgagttgatgttggagagcgcctccttctcccccgccatcgtcggcgttgcgtccatcagcaccgacccgtcgcacccctgctcgaacacgacgaaccaaatcacggcagatcgcccgatcagatggagagaaaaaccaaacaaaaacaaaacacacacacacacacacacagaaacccacgaagagtgaccgcgagagggcagatcggttcgcggcacggcggaggaggagaaacggaagaattcgaatcgcatcaccgatacgaggacgtacgttgacgaagcagtcgtggaactggaggcgcatgacggacgcgacgctgcgggcctcgtgcgcgcgtgcccgggccatggtgtcgcggacgacggcctcggcgtcggggcacgtctcggcgtagtacccgaccctgaggtccctcacggccgcctccgcgccaccaccgcaggagaggacgagcgcgacgacgacgaccgcgaggaccgtggccgcagcgaagccgccgccgcgtcggaggaggaggagcgccatggcgaggaggaggaggaagcaccgaaacagacacgcacacgcgcaggtgggggattgttgctgctgcctgcctgccctgcctccgcttccgcctgcgggtctgtctgtctctgctcgatctcctctgctgtgctctgctctgtactactagcgcccgggcggggtggtgggtagttatagaaaaggggaggtacgtgtcgggtcgggacggggagaggagtcgagactcgagacgggagggtgggagacacacgggccgcgcggtgcaggggaacccagccggccagtggtgcactgcacggacggacgggaggacgcgaggtggtttggctgttgtacagggtagagtacggccgggcgcggcgcaggctggcatgcgggtgcggcgttggtgaatggtgctgaccgtagcgtactagcgcgtgcgtcaaaaatatcagcacgggtgcatccggtgatagggagtagggaaggaggggggcattgacttggggcgcgttctaagcagctacttcacgtttcacaatgtaaatcattctagcatttttcatatttatattgatgttatgtctagattcattaacattaatatgaatgtggaaaatgataaaatgacttacattataaaacggaaggagtactagccttggctatctctttgtttttagggagagcgttttcaaaccgttaaatggtgcgttttttatgaaaactttatattactttttttgaaaaagtatggtgccgttaatttttcgtacaatgtttgatcattcgtcttattaaaaaattttagtataaatatgtaaaaatgtgagttaaattatattttatttaatgataaaacatgtcacaacaaaatatatgatatatatgttttgattggacaaatgatcaaacgctacacgaaaagttaacggcgttagacattttaaaatagaatgagtatatatagaagatatttaaaaaaatcaaataaatctaattttagggttttattaattaataatccctccatctatttttcacagtcatatttctaaatctaaaaaaattatttttgatagacatatttcaatccaacaacctatcatcttaatgattttctcgaatttaatgcgttaatctccattcttccacacaaaactgcctacatgggcatcgagaaatgtaaatattaatgaatcgcttgttacgaggaatgactagtaacatgtttaaatggatgataagtagacttatttatccttggtctgtgtgtcaagatgaaatataactatcaaaagtagatggaatgagtatttaattagttatat

SEQ ID NO: 39904 - DNA, 19733 bp, Oryza sativa
  unsure (1)..(19733): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatattcaccaccccaatatgtctgcatagacagaatcttcctattaaactgtcgttctacaagatgttggaaatttgtgaagactgagaaaacatcagacttattcttgagaagatagatccaagtaaatttactaaaatcatcaataaagcttacataatacttgaatctccctactgattgaggtgcaggaccccaaacatctgagaacactagatctaaaggagcagatgaccgactagtagatttaggaaaaggtaattgatgactcttagcttgttgacaagcatcacacaccacatctctatgaggctcactaacagtaacattgttttctctaagaattttgctgacaatattaaaagaaggatgacctaaacgactatgccatctagactctgaagaatttgtagttgcaagaacttgacgtgtttgacgagcatctattttctcaggaagaggatagagacgtcctcgagctctaccttgaagaagtgttgtcttcgtgacctgatccttgatatgaaagaaatcacgatgaatttcaacaaaagcatgattatcagaggcaagacgatgagcagagatcaaattctttttttgctttggggacatataaaactttattaagataaagatcacgagtaggggtatgaataatagtttttccaatgtgacttatgctcatacctgtgccatttgctgcatgaacttgatcactaccatgatatttctccttcgttgtcagcttatcaagttctgaagttatgtgatcagtggcagccgtgtcgacgtaccaatttgtgtcaacaccatatgatgatgccatagcagaagaggctgacctctgaacttgtctttcatctcctctgtaagatcgatcaaatctcttccaacaagattgaacagtgtgtccaatcttgctgcacaattggcacacaggacgtgtatcttcgccaccaccatgacctcgtccaccacggccgcgaacaaaaccaccacgcccatggccacgattctgatagcctcctcgtgaggcagtatttgcagaagattgatagcctccatcagcttggagcttgagatgtgcctcgaacgagagtagttgtgcatatagatcactcaatgacacataatctttagcagaaactgatgcgacaagaggattataatctgcatctagccctgcaaggatatatgagatgacatcgtcatcatctagcttcttcccggccgccgccatctcgtcggccaagctcttcatcttggtgaagtatacagcagccgaagaatctcctttctgctctcttgctagctgcgaacggatctgaataatccgttcccttgattgcgaggagtacatctccccgattgcagtccatacctccctggcactatctagatgtgccacttgaacaagcacctctcgtgtgagagatgagaggagatatcccaggacttgttgatcttgagcaatccaccgagaatacgccggattgtcgatcatctccttcacgatcttgtcatcgactttcttgacgacgctgatcatcggtgacggcacctcctttgtatcgtccaagaaaccagtgagttgtaccccacgcacagccggcaaaacttgcgcacgccataccaaataattgtctctggtcagcttttctgagacaggatgacccaacacgctcgaaaacgatgaggaactcgacgacgccatggctagatgaactatgtggaagggaatggctctgataccatgaaaaaattgttgtagcgttcctacctccaaagagaccgctgtacgtgtttatatagcaaaaacaggaagagtacaaatcagattacaatccgagtctgaataagttctttacttctatctacagcaccaacctatagcaggagtacatgactctatatctctgaaacagagtcagacaagaaccaaactaagactcgacaacaagtctgaaactatctctatgtttaacaaggcatatgtggtacgaagatacgtacgaaatcacgcagcacacatcacattaatttagatctttgttattctttcatgttcgtttaccgatttaaattgcggggccggttttataacatcgaagaccccgtgttcgtaggccgtgtgacgatgtacgttgttgtcagtccttttcagtgttcaaacaaatataatccacaggacaaattcgttcatatatactatattattatgtttcttcttttcgctctctcatacaatctgttttattggcaccaaccggaattcagctggaacactgaacacacacgttcgcttcctgtctcgtttggagaagcactgcactttattgactatatactccgtagatatgcatgtattgtcttcaccttacaccctgcaaaccacaaacacattggtcgaacgaatgatcagccgacatgcattctatcatcttctgatagtagtaccagataaaaattgaaaaatagaagtggatcgatgagattgagaatttgagatgcatgtatgcgagtatatatgtaacgtactggcggtagtcgatcttgatcttgccggcgtcggggttggcgatgatggcgaaggcctcctgggagaggtcgatggtgccctggcagccggaggggcagtggtcgacgatcttcacggtgacgctccggccggtgcacggccgcggcaccccctggttggtggcgcccgtgcacgtcaccacgtaccgcttcccgcacgccgccccgccgttccagaacacgtcgctcgccgccgcgatcatcgtcccctgctcctggaacccgaagcacgccgatgctgcacgcacgcacgcatttcacacacatctccacttttacttcacgtacgtgtacccagtggatgcatggtggagagagaagaaaaaatactgaacatacgcgtgtaaggaggcgtgtagaaagtcgcagtgccagagatgccagcgaccagagacaccatcgccaggcctaccacggctgccataacaaccgaagtcaccttaggcatcgtcgtcgtcatcgtaatcaattcagggtgtatctggaaactggagtacaagatcagagtgtctaaaagattagttctgcaggagggttgcatggtttagtgtgcaccggccgttttatagccaaaatcagaaggtcgatcgggtagaaaaacacgcaagggtgggtcgtgttttcaacgtttgcgtctgcatgtactgatgtacatggcgcgaagatgcgatatcttccaatgcgaagagaagacaggcgatgtactgttgcccgtggagaaaaatatgtgagatagcaaatacgaccggttgctacgcgtgactcaccacctctcgtcttgaagctttgcacgtcgttgtagtgtgtcactgcacgcttctcctcgaaacacggcgcagccggctcggttgtccgatgcgtgcggcggcgagagagagcaggcagccacgatgattaccaactgcaaactggggcgtagaatcgagcgcgcgcgcgcgcggctctccgaggtccaaggcaagccgcgacgcgagcgtgtgccgcatgacttgcaatcttgcacgagctacggcccggctgcttggagtgctggaggcttcgtcgatgggccggaggccttcgccgcggcgcgcgcaaaggctctcaaaagtccaagaaggccgatcaatgacagcgcgccgtcggacggactggatgtcttcgcagctacgagcgggccgggtcaccgcacggtctgaaaagcccaggaaacctgcaaacgagcgccgaaggaataagatcactttgactccctcaactgacaactgaatctaaattgtatccctcaactgtaatactagaaattttaacctctaaacttaaaaaaccggtgcaatttgactcccttagtggttttggagggcggttttgctgacgtggcgcacacatggcagtgttgatttactctttgtcccacgtggcattgacgtagggtttatgtggcattaaaataaaaaaaatatgcgggcccatttgtcattaaaaaaaagtgtagggtccactgacatgtaggccccacatgtcatattctctctcactacccttcttcttcctcctctctcctctctccactaacatgtattttcatccatctcatctgcatttgcatctgtttctccctctcactcttgcttcgtgttcgtcctcgtttggtctctgtttcttctcgatttggtttttctgctatggagcccatgaagcagcgagcagcagagctcctctagctcagcccctaacaacctaaactcctgaagaaggcacttacgtctgcgccgagcgtccatctgtacacacgttctttgttgacgatttctttgcctgttgctgaattgagcatcttgaggatgttgttgattcggtaggggtggagatggatgaggagtttgcagatgggtgggggcgtcaagccggagttgtcgggggcggagacggacgagcggctgacgggtgactgcaaacataagggcggcgcaaggaaggtggttcatggcgagcggggacgccacgggcacacatgcgctggtccttccttggctcgacggcgagcgcctcggcgtcgtctgtctccggcaccaccgggagcagcagtacggtgtacgggggaagcccacggcggctgcctcctcctcggccatcttcccattggtgaagcccacggcggcggcggcgtttctcggcctcgaggcagcagcgcgaagcgagtggtctccggcgacgccttccaccgagccattaccatctccacccgtcgtggccgattcggagttttggatctgggctggtggagcttggtgctacgccgcggagtcaccatgccctcctgagctcctcatgcatggctgcgcgacgccgtcgacggcgccaccaccatcgtggtccaccgcgacaagccaccgccgccgccgccgctcctgcacccgcttgccgcacacggccgaagaggtcaccagtgacggtcggtggcacagcggcggcggccatggcgtggctgcccgccctcccgcccgccgctgccgctccgtccatcggccaccgtcgccgccgccgatccggacgccgctccccacgtaggaagagaaaaagggagagatagagaagggaggagagtgaggaggaagaagggataagagaggatgacatatgggagctacatgttagtgggtcgcacacttttttttttttgtgaatgataaatggacccgcatatatttttttattttaatgccacctaagcgctacgtcaatgccacgtaggacaaagactaagtcaacactgccacgtgtgcgccatgtcagcgaaaccgccctccaaaaccaccaagagagtcaaattacaccggttttacaagttcgggggtcaagatttctggtattgcggttgagggataagatttagattcggttgtcagttgagggagtcaaagtgatcttattccagcgccgaacgcgtggctaaccctcccagcatttccacgcggaataagttcacttagtgactctcaaaggtgatcgaaatctaatccgtgaccctaaactataaaattggatatctcgacacccaaactctcaaaaccggtgcaaattgattcccttagtggttttggagggtggttttgctgacgtggcgcctacgtggcggtattgaccgggtctcctttacacgtggcgttgacgtggcgtttaggtggcatttagaattaaaaaatatgcgtgagacccgtttgtcattgacacaaagaaattgtgggacccacatgtcccttctctctcccctccgtccggttccttctccctcctcgccgctccctctctctctcccgctgcgggcggagacggcggcgagcggtggaggcgcggacgtggcgcggcggcctgcgagcggcggagacgcgggagtggcgggggcaggcactggagtggagacggtggcggcgcccgggccgagctctaccgcctcgtcactgacggcgaccaggtgttctacgccacgcgccgaggcacccgcatgctcaacatgtccgacttctgcgaccgctcccgcaccgacgcctgggacttctccgcgttcgtccgcacctacgccgcctacctcgacgaccggctcgagtaccggatgcaggccaagcacggcggtgccgcgcaccagggacgaccgctccgcgagcagctgtacgcgtcccccgggaaccgcttcaactacgacgacttcatcatgagagacgacgaggccacgaacgccgaggccgacaaggcgatggcgctcgtagcgagggagacgccgacgagcgagatgacgctggagcagctcctcgcgaaggcacaactcctcgtgtagtaggacaactttctttaaggatggccgcttttcactaaccacccgattaatccattacttagttaattactgtggttgcaatattaaaaattggagttaaaactaaatttagccgtgattgaatttggcttgcagctggcgccgcattgtcttttgctgccagtggcgatggtggtggtggttcttgctcttgagaagaagctgctggtggtggtgcttggaggagcacttgtagaagccggaggggtcggaggacatcaggcttctcgaggagaaggcatccgtgccgtcgtcgtcggagatggtgaagccataggggttggacgacagcttcggcttcttcccaccattgaaatgcccatgagaccgtgacggtgggagcaatgccggttatgctcttcttcttctctggaggaagcgggtggcggaggaggtcaagcgtcttagagaagggtcgacgcgggggaggaaggcggcggcggtgacggtggaggacgtcgttgtcgtcgaccccgccgcgtgtgcctcccgccgccgccgcccgccgtcctcctgcttgaacgcctggtcgccgtcggcgaggaggcggtggagctcagcccgggcgccgccgccactcccacgtctcccccgctcgccaccgtctccgcccgttgcgggagagagagagagagggagcggcgaggagggagaaggaactggagggaggggagagagaagggacacgtgggtcccataatttttttccgtgtcaatgacaaatgggtcccacacatatttttttaattctaaatgccacctaaacgccacgtgtaaagaagacccgatcaatactgccatgtagacgccacgtcagcaaaaccactctccaaaaccgtcaagggagtcaaattgcaccggttttaagagtttgggggtcgagatacccggttttgtggttttgggtcacggattaaatttcgatcacttttgagggtcactaagtgaacttattcctttccacgcggcacacggccgggtgcatgcggaagggccgagagcttgctactcctccatcctcctataaaaaacaatcaacaaaaatagtacggatcgtgatgtattctaatagtataaatttgaataaatatctatctaaatttatagtgctataatatatcacatctcatatttttttatagacgaagggagtagctggcaccattaataacccaacattttcatgctacacatacataaacgacatagtagcacacatatataaaaacgcggatatcactacgtaaatatgtataagcaaagctcttagacacctttaaatggacgaaagcctagctgtactaaccttaatatggggtagaattatatttcaaagtatactcatatatgtgtaatatttaaaggcatacaaattttaaccctaatatattgaatcatgtccccacaaacttaacaccacataaactattacatcgtttccaagctaggtgcattcccatgtcatagagatcttcaacattatcaattttatagtgaaaatgtattcgcatgtgtatactgtaggtgcatccaaatttaaaaccacggacaaataattatatcataaatttttttatgtatttaaaagagaccttcctaacacctatttccatcccggaacttttgtgtggaaccaaaacttttgatccgggaagaattcaagacaaagaactcccgctggaactaattattagaaggtgggacgtggaccggaacttctactccgggaatgattcgaggcggagagcttccacccgaacttctaggtgaggagtgaggaccaaaacttctagtcaaagagagatccacttagagcaagtttaatagtatagcccactactagctccaattcatctatagccaatctaatagccaattcatacaataattgcttactatactattagtatatggtcccacctgtcatacatacattacatcttggagtccgtgctgcagctggctatagatctgtaacccgctgctcttctctctcatcttatctcattaaaatatgcttgtagctggctaatagtctgctaatagagacattggatcgactgtaactttaaaaagacattaggtcagttttggataaatcagagttcaaatttgatggggttttaccctatatacgaggcaagatcacccctcttataaatataggaggagatttattgaacccctaaacaatcaatctactccctccgtccactaatataagggattttgacattttgcttctactgtttgacagcacgtcttattcaaaaaaatttgtgcaaatataaaaaacgaaaagttatgcttaaagtactttggataataaagtaagtcacaaataaaataaataataattctaaaaatttttgaataagacgaatggtcaaacagtgcaagcaaaatatcaaaatcccttatattaggagacggagagagtacttctttctctttctaggtctaggagtaatttagctttttttttttgctgttttatatgagtaaatcattatctactcagggtagccgaaaattaccatgtattgttttgtcctataaaccatcctgaatctccaggaaaaccagaaagctatttaccactcgaattggcgagttcttgctgatgtcttgctggtccgaaacttcaagaacttacggtccatccagagttcgctagggggctcagcttatcggtgtgctactgtgttctcgcgctaacagcaagtactagaataaccctaacatccataacttgaccaccatactaaagttgcttccccgtgtccgtgtgtatatatctcaactattataaaaattgataaaaattgaaaatgtttactttgttacgtcactcgtataggagtcggtttttaatttcgttcgctttttgaaatgcatatccacatttgttcgcttttagaaatacagaaggagtcatatagaaatcttctttaaaaaaactcgcatgctaatttgagataatcggactcctaattaactacaactcatgattatatatatatatatatatatgtgtgtgtgtgtgtgtgtgtaaattaactggtgctacatggagtatgggctccaagattcaaattgagtatatacccaatttaaatgagtatgaattttttttaaatgtttaggtatgaacattaacttctttactaacaagttcaaacaagtttgaactgagtttgaacttttttttttggttagattttggttctaggtatataacatccaaacatataattcgctaggtatgtaataatgaattgtgaaataaagttgagtttgagttattttgttttaggtattggtatgaatcaaattcatatacctaggtatatactcacaatttaattttttaaaaaaatttgagagattttgttttatcacggtgaattttattttaactaaaccatatgataataataaggttaaaatagccttcacccgttgtaacgtacaagcatttcttttctagtggagtatatgtgtatagagctagtatatttctttggtcaaagtcagactgctttaagtttgactaagtttataaaaaaaaattgtaacattttcaacccaagacaaatttattataaaaatatatttaataattgatttgattaaactaatttaatattataaaagttattatatttgtctataaacttaatcaaactttaaacagtttgaaaatgtcttataacctaaaacggagggagtataatgcaacttgattttaatttattggataaatgatccaaaggtataaaaatttacaacactatatacgctcttgcacacagtgatcattatacatgagctatacactaaatacactaccatatgtatttaatttcgtccaaaaaaatacactaccagaacatttccagtatgtagtttactaccgccatctgcgaatattttgcatgtacgtttaccccaccagggcacaaccgcctccacacgtatcatgagctgccgaaaccctgctcagtgacctgaactgacggcatgtcgctcctgaaccggagcctctgcaccatgggcttcatcttctcgatgagctttacgatgacaaagaagagcaccctgtacagcaccaccattccaatgaggatggcgaggtcggcccacttgctgtacccgagctgtacctgccagtagttcgtaaggatctcttcaccggtgatcacggtgccggcgccggcttgatcgttgtatttggggaaggtgaggcctaagaactcgttcttgtagaatccctggttggcgtacttgtggaacgcgatgtagtacatgggatacttccacaccggctttggaaggtcgttggggaggcggaagaagccgccgttgagcatcatgacgccctggacgccggcgccggtgatgatgcccatgaggaagtccggcacggcgctggccacgatcatcatgagcccctccaccaccatcatggtcgtgaagagcaccgccgcgaagtagccgaagtgttcgccgctgctctggaggccggtcaggtagtaggcgatcgcgcctggcaccacggagatgagagctaggtacggtgtagacgacagcgtgttcgcgatcacgaacgacgccacaccgtaatggccgttgagcctctccctcccaaatatctgcatatcatatcaaaatttatggagtgaacatttggttggtgtatatcttggctgttcaaaatatatcttggttggtgtaaaagtgtccttaatttgacattcaagaaaatcagtgaacaaaccttcatgtcctcaacgaaagaggggaagccaccgatggccatgaaggtgaggaaggcagcgacgaacatgagcatggagccacgggcctgcagagattttcagacggtcatgcacacacaattttgccaatgagtaatagatattaaaccgcgaacaaattaatatggaagactgtgccagagccatgcatggccagcaaacctggatggatccataggaatggccgacatcgtagtagatggtgccgacgcagaggcagagcgcgacgtaaatggcgaaacgcagccagtagtagcccaagtccctgtacatgttgacgaaggacctcttcgtcagcacccatgactgcgtcaggaaagttggctgcctttccttcttcaccaattgcccttcctgcagagataaagaaaattacaggatgtgtaaagcatgcatatattatatatatatgtagcagaaaatgctttgcgagatacattattggcgcgtatttcttcgatctgatgcatcactttcgccaagtgaacggaggatttgtatgagttgacaagtgtgtcgattgcttgggtagtggtcatcgtcttcccgtccagacctacctcaatgtcctgatgaatgcatcgtatagaagggagtaatttatttaggacatttagtcactttctttttgagaaaaaggatatttattcactgattcagtgcattggctagcttgctctcccatgatttgcttctcaccttgtcgaagtccttgttgatggtcctcagaaaatggtcagaagggttcatcagagacggacaagggaatccgctcagagcggagaactaataaacagtgaaatatagtcaataaaaaaaattaggaagtgcttagctagcaaccggaataaattctcatgatattagtcaatacaaaatagcatgtacagtcaatactcaattcaagtttgttaagtgcttcacattcagatcaaaatctcacaatatatatctctgtttcatttttaagaaaaacaatatatatcttggaccctcccgagatttttttttcgaattggatgaaaatttctgatccattcaaatttctttaaatctagttgaattttttgtttaaagtggttcagattcagaaaaaaaaacattgcatatgtattccttttcttttgtttaaagtggcggggatgctgttttgttcaacaaaaataagcggcatagaaaattttgctatacttgttcaacactgttttgattttgttccacaaatgctgttttgttcaaccctattttgattttgacagatcacagatttgctagggaggagaaatatgctttccatcacgaaactagtgtgacatctcacggtctaggttactccaaattagggatgaaaacggttcagaaagtttctgatttccggatgtattttcgaaaacagaaagtgtcggaattttttcggtaagtttcagaaatggaaacgaattcggattttttttcttgaaaatgaaaatggatacgataaggctactatccgtcagaaaccaggatcgatcgagaacttttcataaacaaattcggatttttttcctcagaatcagaaatgaagtacttctcacatacaactaatttgctctaaccttttctactctaaatgtttagatttatactgagtacactgagatggttaattagttgaatggagatattgttttctagttcagtactttagatctgtttttcttttttcctaattactatttttgttttactaggccatgccaaacaaaggttgtcaatttcagtttaaaatttcagtaatttcgccacccccactggcaagtaaatatgtcagccagaatttttgttttttcccatttttttgtgattttggaatattcaatcaatttttgttaatttttcaaataattttggcgaaaaagtatgaaaattcctgaaattttcagaaattttgagccatactacttacagttacagtatagatgaatatagttcttgttttcatgaaaagtgaagtgtgccactagctgtattattattaattgataaaaaatagataatgtcgatttgttgttctaggaaaaaaaaagagctacatcactttgtcgatttgagaagttcaatttgaggaggttttataatccgataaatatctgttaccatattagcttcgatttgtgttcgctctgttttcatattcaataataataaattcggttttcgtatctagagtttctgattcctattccgatgcccaaaaaaaatataaaatgaagtggtagagatgatttctgtttgtttccgagtcgttttcatccctactccatatcatagatataatgatccttgcttaattagcaaccagtaagttcagtttgcagatctgagcctagagtgatgctacacgtatgatttgccgtttacgatatttgtacgatgaaacagcttatgtgtttattgacgctgatgctggtatgcagcagtcgactcagtgccatgcatccatgtcatcccgttagatcgtaccatgattgtaagtccaaatcatgcgcacaacatttttctattgtcttaagcgccgatcaagccattcgccacaaatcccattgtaaatcagaaaagacgtttgttttctacttaacttcatggttttcttttgctacatatagtaacttctgcctatgtatattaccaacttcgtcccaaaatactaaaatttatgtgtatgtatcagttagaagtttctatattttggaatgactgtactacttccctactctaggccaggtcaagtatttaggtttaatttgaaaaaccaataaccggtgccgataactggacaaaagttaatttaaatccaaatttctgaattcacaaaccggttcccggcggttgcagctttagaaatctcgtggtgacctagtgcttcctaatttcgacttcaaaccacacttgaatacctgatacctttgttgtatcaggaattcaggatttgtgcagtgtgtcttacctactaactgtattgtaggatctttgcatagtagtatagaacctgatttgcagctttcagaactgaaattttgccaaaactgatgcatctgcaccactgtatactagatatgatgctggcacgcggcagcttgcagccggaagactactactgcagctgcgtcttcctgttgggatcaatgaatccgtcagaagggtaagctacagaaagcacaagaaggtgcaaattcgcacgtcaccgactgattggagtcactgtgcgagtgtgtttcagtgcattgaatgtgttctgttgcttctgttcatgagtaagctaagtcagcgtcatctacagttgcaaacggtatagggctagggctttcggatttcttaaccggtctcatctcatttaagctatatatcggatgtggattttcatcccttgagagacatctcctcgttatttgcatgtcatctaaataattattaaaaaaataaaaaaatgacagtatagattaatatgtaatatatcactccacgaatatgcaagactaaatttaacttttacaagttgcaacaaaaataacaaattaaactgaaaatagttattgcacattcgcaactatatttgttatttttgttacaacttgtagaagttgaatttaaactttactatttgtagagtgatatattttatattaatctatgttaccgatttttttttttttataattatttaggtgacacgcacaaaacgagaggatatatcccctcataaaataacttttccctatatatccgaattctgaattctgatacagtatgtttggtaacaattctcattttgccgtacaactttgcaaatacggatgcataatttgtatttgggacaaaatagtttgtacctgggcggtgtcggcggcggggccgaagaagacggtcttgccgtaggcgaggaggcagaggccatggaagaggccgaacacctcggtgctgggctggtgcacggcggcgacgacggtcatgccctcgcggcgcgccatgcgggcgatgcggctgacgacgtggtacgacgcggcgctgtcgaggccgctggtgggctcgtcgaggaacagcagcgccggccgcgtgaggatctccatgcagatgctcacccgccgccgctgcccgccgctgatccccttgtgcgcccacccgccgatccgcgtgtccgccgcgccctccagccccatctcccgcagcgtctcctccgcccgctcccgcttcgccgccgcgctcatcccgctcggcagctgcagctgcgccgagtaccgcaccgcctcccgcaccgtcagcgtgttcatcagcacgtcgtcctgcgtcacgtacgcctgtggcgcgatccattcatgcgttccacgacacgagatctcaccatgcttgcatcattgctcgaatctttatcaaagaaaaaacgagatcattcgtcgccgatcgactcaccgacgtgccgaacgccagcttctgtctccggccattgatcaggatgtctcccttctggctcacgctggagcctaaccttcctgtacccagaattcatgcaattcgatcggtgatattcggtgtctcggaacacacgcaagccgaggtgatcagaagagtggcatgcatcatatgtaagggaaactattttaatccctcgagggatattctcttgttatttacatgtcacttaaatagtcatgaaaaaaattgataagatgtattaacatgtgatatatcacgccacaaacatagaagttcaaattcaaattctacatctcgcaaagaaaaaataaattaaactacaactaacgtatattcacagttaaatttgctttttcgttgcgagatgtagaagttaaatttgacttgcatgtttgtggagtaagatatcacatgttaatatatctttttaattttttttcataactatttaagtgacatgcaaataaaggatcaaaatccactttctcaaatgttacctgctaaggagtcaagaagagtggacttgccgcagccggaggggcccataatggcgaggacctcgccggggcgcgcgtagccattgaggccacagaggatgggaacgcggcggcggctgccgccggcggtggacacccagaggtcctcccacgcgaggacggcgccttgttccggccggcgcaaggacgacgtctctcgagcgacgacgaaggcgacacggtcgttctcgtcgttcctctccacgctaatctccggcgagggctgctccgcctccgccgccggcaggaacggcggcggctggaacgatcgcccgctgccgaagggaaagccttcggtgccgcgcatggaggcgccgagatcggagaccatgccggctgcccccttgcgatcagcctcgtcgtcgtcctgacgccgccgcgggctcggcgtccacctcggcacggcggcgggctgctgctcggacgccatgcacgcgggaatacttgctggtagtggaagttggcgggagctgatcttgtgctgacgatcgatcaaaatggaatgcttgagcttgagctgatccgagctagtgagcgtgtatgaagaagaacaatgagcatgggttgcttaaatagaagcttgagggactacagatgaggttactttgtacacttgactattcctaactcaaaaatcatgaattagtaaataattttcacctacattgtaacattatcatttcttcggggtatatatatatatatatatatatatatatatatatatatatatatatatatatatatatatatatatatatactccatccattttaaaatacaaacatttctatgctttttagtaaaattaaggtagagagaaaatttctcttttagtcacttcagtggtcaaattttaaatgattatagctatatatatggcgctatatttttcaaaaaaaatatttaaatcattgttacactataaataacttatgcttattacattagaagtttcaatttttcacattgtaatttttctatatataatacacaatttattagagagttctgattaagaatagttcattatctacttgaaagaagagataggagagatagaagaatactagtatatgtatgggagagagagcaacctgaaattaagtaaaaaaaatgtggcgccattgcctagatttcctatttcccttcacaagcttcttattagctaaaaaatgtatagatttccgtgcattggaatcagtgccccaacaatgtttatacagagaggtacacattataaatcctcaaaatacttacattttagaataaaggaattatatgtcatgtaaatgattatttactcgcttgtcaagcactagatgaatatccaattacataaacttttttttgccaaagaaattatgaatgttctaacgaaagaaaattataactggatcttgattcctgcacaaaaaaaaaagatctaatatgtaatcatagaaatgtatataaattaatcttggaaatgaaacaacaaaataaactaaacgttgtaatttgtttgtatcaaagttatagctatttatactattcaagttcaaatgactggtagacaagaaaaaaagataatgccaaaatgacaaagtcgtctttaaaaaagtgttaagtaagcgtacttgatattatttgcactggtaacaattattataatatttttgcgtggtaccgaggactacaataaaacacgagatatgcctctcgatactgtgtagggaagactatgacctcaacatcttcacatgtgcatcgacatcggtcgtacccatgcaatcatatccattcgttccccctttcctcggcaataacggcgataacaacacaagttgtcaccgttagttgtctcatgttgagtttctcgacagtacttgatagttgatactagcaatgggatagggttctcactttggacttctcattatgtctagccaatcccatctttcgcattaatgttaccttttgctagcttagactattttgtccataatcactatcgtgcacacccattataatggtccattcgatttttgcagtaaaattaccgtacttcttcatttcttcaccactagaagtttgtagaatctccgcattgaaagtttctacattttttaaacgattggctcatcctagagtggaaattgagtcatttttaataattttgtggtctgatttgtctaaaatggtgacaacgtattccctctataattgcaatgagcatgcagaaataatgggtgtgacaaatcaataaatattctgaagcatgccatttcccactgcattgaattttactttttacagtaaatatatttagttatactaatataatctggttgatcagtctattgcccccaagattatgtgtgccacatgtacactagaaaaaattcgagtgtgaaacacattttgtgaaggatatatatcactaagtatgcatatctcatgatagttttacatcaagaaaaaggtttaaaacaaaagttgactatctcatgtgatatttttgtttcacaatagtgcgtcaaatctgttacaccaataatatggaaattacgtaataacccattgatgtgaaagtgagattgcacagtcatttatcacgacaacaactcaaatgccatcaataggttgcacgtacaagacatatgatgaatataacatgttcatctgccaacttcccaccatgctgcaatatattatgtgcatgcatgtaacatccacaataatagcaacttgcagcctttcctagccgtacgcaaaaaccaaaaacaactgcaatatttttgttctctttctttaaaaaggaaggtaattccactgcaccaccaatcaatattaattagtatttgtgatttttttaaaagtaagtgctccataatgtttttacatgaaacatattactccatccatttcaaaatatagcaacctaccaaattaaacatatcctagtaccataaatcataaatctgaacaaactaatgttgtactaggatgtgtcatttgtacatattcgttgtatcaggatatgtataatccgatactaaattgatatattttagaaagaaaggggtatgtactaagaatattgtatggtaaaagccgacacatggacattcctttactcactacctatctcaaaatatagcaacctagtactagatgagacacatcctaatacaacaaatctagatagacctctgtccagtttatattattgtactaggttgttatattttaggatggatatagtacatgtcagtctaaaaaaaagcctctaaggtttatacttattgttttttttaaaacacagtagaaatgtagatgcttatatacacgtgcatgcactcgcccctatagatacacacgcgcacaccctcttcgatg

SEQ ID NO: 39905 - DNA, 13413 bp, Oryza sativa
gtacatgagcacaatatttactactactagtatatttgttttctttaatttatatagggcgattatgaccttgtaggatactcctatattacatatttattatcttgagttgatttttttttaaaaaaatatgaccttaatgtgatatatacacaagggacatcttaaaagacttttccattcttgtttactgtttcatttgttgtttcgttgcgtgctagggcgtgtttaggagaaggtttgaaacttctctctacctctataacgtgtataacggagtgactcattaactcgtaattaattatgtattagctaaaaaattaaaaaaaagattaatataactttttaaagtattaatatcgaaatgagcgcagtcagggtcatccacattgagagatactgactgctcaatcgctttctaacatggtgagctagctagctgccatgtactccctccgtactcgtaaaggaagtcgtttagaacaatatttaagtcaaaccttggaaatataaatcataaataactctcaagttgttaagtttgaaaatgtaaaaattatatgaatagatttgtcttgaaaaatacttttataaaagtatacatatatcacttttcaataaatatttttatagaaataagaagttaaagttgtgttttaaagaccgtgtcgctatactaaacgacaacaacttcaacgagtacggatggagtacgcatatacccatgtggccatgcctacctgacatggttacggcgcagcgactagcgagccaagtcgtctagactcgagaggagcaattattgggccaagttccttctcactgtgacccagtttactgattaggccgagttctctgcctcattggccatttggcctgtgtgccaatgaaaacattgagttggatatcaaccaagtagaactacacgggagtggcactgatgcacgcctcttatgtaggagtagctacttaactgcaaacgatctatataatgtctacatcagagatatatttttctctttcaaataaacaggccaccactgaattttctggtatactctattatcaccaaaattgtcctccatccattttcacaccaatcttatcattttccatatgcatgaatgtgatggatgagaaaaaatgtttgtccagaatgtctgatttgaccaatttgaggtaacaggtcatgcattttcttggcaaggcattttcattttcatagtactcctataaattttgacaagattttgggaagcttgatatggtggtggagtcatatgtgcatgactctatctgtcatggtagaaatggtgatatccactaatattacacacataagtacgttttaataggaatttagtgggatcatggatataccacctatttccatctctttgagagtggggacgaactcatgtggtgatgagcgtgcatgtgtgtcatctatgtaaatgaaaaaaaaagattttaattggattatgaagttaaaagttgggctcaaccccaagctggctcatcgttatcttggccccacgagtgaattttcacctatgtatttttggtcaagaaaagaaaaacgtgcaaaattgtgataaaatgggctgaagtggtatacacagagatatgataagtcgttttgattttttcctaaatcagaaatctataagttaaacctaatttatggagaaatgtagcactcttgtaacaccaaattagtctaattaatcctaatatgtttgttgatattaaaaatgtttgctctgtttttctataaacttaattacacttaaacagtttgactaaaaaaaatatcagaacgtcttaagatatgaaacaaagggagtagaatgttagtgctaccaaagttaccaagatattttcagtaatatatatatatatatacataatctatattgggtagactctcgagtagtacaaaaacatttttccttttcttttctcaaacaaaaaaactgacatcatctcacccttgcatatacaatgttcacatatatcacaccactaatatatcagatgcctatgggtaaaaaccactgccccaatcgatgttggatcaaaggcttcctgccgagccattctcggcgatgtgcaccgacggcgcgtcgctcctgaacctgagcctctgcaccatgggcttcatcttctcgatgagcttgacgatgacgaagaagagcaccctgtacagcaccaccatcccaccgaggatggcgaggtcgacccacttgctgtaccccagctgcacctgccagtagtctcgcaggatctcgtggccggtgatggtggcggcgccgccggcctggttgttggggaaggtgagccccaagaactcgttcttgtagaacccctggttgcgtacttgtggaacgcgatgtagtacatggggtacttccacaccggcttgggcaggtcgtcggggaggcggaagaagccgccgttgagcatcatgacgccctggatgccggcgccggtgatgatgcccatgaggagtccggcacggcgctggccacgatcatcatcagcccctccaccaccatcatggtcgtgaagagcaccaccgcgaagtaggcgaagtggtcgatgctgctctggagcccggtgaggtagtagccgatcgcgcccggcgccaccgagatgagcgccaggtacggcgtcgccgacagcgtgttcgctatcacgaatgaccccacgccgtagtgcccgttcagcctctccctcccaaatatctgcataaagaaaacaatgaattaagtgaacattgatatccattttcagatataaaagtatgttactggggtagaagttaaattttgttataacttgtagaggttaaatttgatcttagtgtatctcatattaatttattttattgatttttttaaaaaaatagtaactatttaaatgacatacaaataataagaggtaacattgtatggtacattcaagaatataccttcatgtcctcgacgaaagatgggaagccaccgatggccatgaaggtgaggaaggcagcgacgaacatgagcatggagccacgagcctgcagagatgttttcggacgtacggtcacaaacacagtaacactaaagggtaatgaacagtagcagtgtaatgaacagtgatgggtgcggctaatagaaagcaacaaaaaaaagaaaagaagaaaagaaaatgggacactgtgagtgatggccatggctgacgaacctggatggatccgtagctgtggccgatgttgtagtaaatggtgccgacgcagaggcacagtgcgatgtaaatggcgaaacgcagccagtaatagcccaggtccctgtacatgttcacgaacgacctcttcgtgagcacccaggtctgcgtcagaaagctcggtctctcctccttcttcaccactgcccctccctgtaaaaaaaaaaagaaatcacagaaagaaattttggtgaattttacacgcagtaattaaaaagcagaagcaaggatggattggcaaagctagaagaattcagagatgatttgtgtgacgtacggtggcgcgtatgtcttggatgtgatgcgtcactttctccaagtggacggaggatttgtaggagttgacaagcgtgtcgattgcttgagcagtcgtcatcttcttcccgtccatgccttcctcgatatcctgattgatggatcgtttagaagatactaagttattcgggatcattttatttattcaataattcagcagctttcatatggtttaattgccatcgtcttgatctcgtcatttgctactcaccttgtcaaagtccttgtttatagtcctcaggaagtggtctgaagggttcatcaatgatggacaagggaacccgctcaaagcaaaaaactgcgaaaaatacaaagaaaaattaaatgaatttgtgcagttacctaataatcagtcaaaaaagttcagaaggattcttctgagttctgatttctgaactataaatgttttccgtagtgctagctagagagtcaaagaacagtggccaagtgcccaagtctgaaatttctgacgtttgtctatggacctacatacatggtacgcgaccgcagctgtagatcaccgaaaacgcgtgtttttcttgatgatttgttcgtacggtttcctaacttcgacccaagtgtggtcaaggtcaagtaatcagcatggtaggctattaaaatgtcaaatgggagacctttgccttcaaaaactagttaagtggtgtgtgacgatccaattgcttcttagtttcaccttcaatcacacctgatactttgttgtatcaggactcttttccaaagttgtttacctacttctagtactactaaaaaaaatgatccttgcagagtaatctgggactttcagctttcagaactgaaaattcgtcaaactgaacgaccgttgcagagtaatcgctgtatggatgcatgctgcagttggcatagctaaaatctgcaggctttaagtcaagctgaattattaagtgccaccgatgcagtgaaacttaatactcctactccataattaggtggatatgttctgctgctcgtgccacgctattggattcgatgagatatcagaaaaataagacacgcggctctcgccaaagaagaacaaggagacaagttcacacgtcaccgaactatcggagtcactgtgtcagactgtcagtgcattaaattcgttctgttcttctgtttgtgagtaagctagtgtcacaattagttggtatactaaaatgaatatgcatgtatatatgcagttcatatatagtagtggttagatctagtgtctcctttcagctatagttcagttcctggttcctcctacgtactacccaatgtttgagaacagttctcattttgtccttactaattttcaggcacaaggttccgatgtaataatctgtagatttgtttctttcaaaaatagtttttagatttgtagtaatggctgaaataatgtgtactttctgcatatgtgaattgttcatcagtatcttattagaactatattttctattcattgttcaatgacaactaaggatttcagttctacctttgatatagaaagatgcacagctcctgcttattgtcggaaaataaaaaatcttttgcaactatcagctttcatctgactttgcccaaatcttttatttccaactcatggttagctgatgtagcccgtcaagtgtgactaaacaaactcggcaaaaatgattctctttccgaaaacatctcgcaaaggattgactaatcgcagaagagtagtagtagtactggtctaagtgattcatcgacaatatgataatatcatagacagtatgaatacacagatcgaccaggctggctgccaattttttttcttaaaaaaaggtataattaagcaggtggccggtgaatgatagccgccagcaaaaatattattctttttttaaaaaaggcaaaaatgtacgtattaattaagcaagacatacgtatagatatacgagtacgtatttgtacagtatacggaagcgtagaagcgtgtagaatacctgggcggtgtcggcggcggggccgaagaagacggtcttgccgtaggcgaggaggcagaggccatggaagaggccgaacacctcggtgctgggctggtgcacggcggcgacgacggtcatgccctcgcggcgcgccatgcgggcgatgcggctgacgacgtggtacgacgcggcgctgtcgaggccgctggtgggctcgtcgaggaacagcagcgccggccgcgtgaggatctccatgcagatgctcacccgccgccgctgcccgccgctgatccccttgtgcgcccacccgccgatccgcgtgtccgccgcgccctccagccccatctcccgcagcgtctcctccgcccgctcccgcttcgccgccgcgctcatcccgctcggcagctgcagctgcgccgagtaccgcaccgcctcccgcaccgtcagcgtgttcatcagcacgtcgtcctgcgtcacgtacgcctgatccatgcgttccacgagatcatccattattcaattattcatcgtgcatgcagcaattaattctgtacattcgggaagaagacgagtccatctctcgctgacttaccgacgtgccgaacgccagcgcttgcctccggccattgatcaggatgtcccccttctggctcacactggaacctaaccttcctgtacgtacgtgcacccagaaaacatggagctcggtcagtcggtgtcagagttcgtctcagctagcatgcaactcgatcgatcactccttctctattcaatgaaattggcagcttgtcgattcgttcaaaaaaaaaaaaaactcgatcgatcgctatttgcagcgacagggatcgtgttcgtcgggatcgggagattaattgacgtgcgtgtacacgttacctgccaacgcatcaagaagtgtggacttgccgcagccggagggccccatgatggcgagcacctcgccggggcgcgcgtagccgttgaggccgcagaggatggggacacggccgctcttcccgccggcggcggacacccacaggtcctcccacgcgaggacgacgccctggtccggccggcgcaacgacggctcgcgggcgacgccgccgccgccgccgttctccgccgcgctgatctccagcgacggctgccgcgccggcaggaacggcggcggcgcgaacgaggagcggccgctgccgaaggggaacccgtcggtgctgcgcacggaggcgctcatgtcagagacggcgtcgaactgcggcggctggtccacgtcgtcggcctcgcggccctgcggccgcggcgggctcggcttccacctcggcacggtgggttggtgctgcccggacgccatgaacgcgagaacgcctagctcgagcttgaccggaagcgatcgagctagctagcgaggaggtaggtggtgtgcttgtgaagctagcgctgtgtgaagaagaatggcgagccatggctcttgcttaaatagagccaaagcttcgcattgcgccttacagataagatcgatcgcttcgtacaattgacttttgataaattttaactgacaattggattatacggtcaaaagtgcatttgaattgttattctatcgtagtttctcccatctaagctgataagatcgatgtccacgtaattttagacagtaagcaatcaattgaggcataagaatatgtacaagacgaaatgaatagcatcaagaaattttcaaaatcgttttttaagtactatagggtactgttattaaaatgttgagacattcaaaagtacgtacaagcctcttcggtcaaaaaaagaagaagaaggtacaagccttcaaatttgctagttttcatgataaaatagttcctaaatttggaataattcaaagataactcagtttggggagtcattaattgtatttcttatgatttaataactttaaaattctgaattaataaatataatgttgtattggtcttgggggctctcgctttagcattttattaatttaatactaaaattcgaaaattaataattagcaaattgaagttgatagacccttgcttaaatttaagccattatgattcgatcccacatcgatatatggctatatttattcatttcttagtgtggtcataatttcaattttccatgatgaaacaaagagtaaattttgctttgggcctcttattaaaaacaaggtgtacttgagtccaaagttgtagtttttatttttttatttagtaattcttacattgagaattgataataattataaagttgtaactgtctgggactcttgaaccgttatatagccagatttatttacttattctctaattttatacggttacaacatatactaattacaattactcctataaagaagcacatgcatgagaacgcttcttcaagaagttgagctaatagatttgaatttgataattgccgcatgctatttatagtcatttgctcaaactgtttatttgcttcatacaaatttccgcagcaatatgtggatgttaatatagctaagaacacctaattaatatagctcggaatgataattaatacagaaaactccatcttgaaacacattattaaatgatgacatcttgatcatgtgattgttttacatcaataaataaacatctatatcaaaaagtgactattttgtggtatttttcttccataacgatgatgaaagggagcgagtactggatttcgttactatcaatcacccatcaattagcatcccctcttaatttgtcttacgtgctgccatttgctgggtttcgctgtacacataaatatttatcaagttcttttgtcaaaagattataacagtgaaaattgcttaatataactgaatgatgtacatgtggaactgaaatagcacgattgatatcgtctctactaccaaaacaacccatcaattaatgtataagcctgtccaagacatgaagaaaaacaatagttcatctgccaacctctgaccatgctacaataactatatcatccacatcaatggcatgtaaatgtccaaaataataatcaaacatccagaacaatagcatctccaactgcacgtgaataaaatgcttgatgttgtagattttttgtttgtgctttatttggatgacatcatcaaatttttatagttgtcttctatctatgttgcttttttataatttaataaacaccgtaagattgttttatgcgctaaaaagattgcactatacttctataatgataacatatatctttgctttcaaattaatctatagaacaattatgacttatagtttcttttggattgctagattttttttccgtgatcaacaaaattctccgtagcaatgcacgggcaccctactagtatccaaaataataaaaacaatagtagcatatatagcatatccaacaatttccaacttttgaaagcatttccagcattacgaacgcggaggagaactcaactaggccggtcacccggcggcggcggcggcggcgggcggtcagctttccaacgataaaaatggatggcttctctgcaacttgcaatagcaaattggcagcgccagaggtggtcaattcggaggctctagatttttcacactttagccctttcagagaaaaaatttacaaatagatcctccagaaaagtttccttcaaatcctattgatttgtagtcaattaattttgaaatgaaaatgatagatcaatataccctaactcatttctgctactttatttttatttataaaatcttaatatgggatgagcatatataggtccctccctcctctacccaaaattacaaatcatataccataattcgattcccctacttccttttcaaaatttgataacaaatcaataaatctaggaatggggaggagctagtacgtacccacgtcctctatttagatggagttttttataaataaaaaaactagtaaaaataaattaggatacatttatttattagtttttcaaaatgtgacgctgagtcaataaaatttgaaggaaaacaaaagaaagagttattcgtagaattctaagtgggagagttcggcaaggactcctaacgcgcgtgtacgcgccaggaggagaagccggcgtgcgtttttctgacgctaagagcgcttagccctaactaatagcgcttagcgctaactaactttttttctttttttttttgataaaaattcatcacgtgtctttcttcctttttagttgactgaaacaaactttcaattccagatttgaacttagatttaaaaatttcaagttaagatttgaatactttcaacttagatttttaaatttgagttaaaagtttttaaacctgagttaagttttcaaatattgacttgaagttttttaaatttgaattgaaagttttaaatcttcatttgaaagttttcaagttcgaactgaaagttttcaaatccaagttgaacgttttcaagtttgaattgagagttttcaaatccgagttgaaagtttttaaatctaagttgaaagttttcaaatccgaattgaaagtttttaaatcttgaattgaaagttttcaaatttaagttgaaaatttcaaaaaatcttgagttgaaagtttcaactcatattcgaaaactttcaactctagattcgaaaactttcaagtccagatttgaaaactttcaacttgagatttaaaaattttcaactcaagattggaaaactttcaactcgagattcgaaacctttcaagtccagatttgaaaactttcaacttaagatttaaaaactttcaagtccaaaattgaaaatttttaagttaagatttaaaaattactagtaaactaatcactagtaaaaatagggaactaatcactagtaaactaattacgattttttctcctatccgtgcgatagcaaactgcgaaaaaaagaaaaaaaaagagaagaaaaagcggtagaaaaaaactgcgaaaaaaaaagaaaaagaatagaagaaacgtgtgcacgtaccgtggaccttgtgggccggaagtaagcgccggtaacgcgcacgcgaactagcaatctcggagttcggcgatgtctggtgccaaagcctaatgtcgacgccagcacatatatttggagcaagtgttcgatagggtgtctactcatgaaatacattttcaaaaaaggactaaaacgtcaaaaatccagatcagatcgtttgcttctctgctgtttcgttttctgctcggaaagagaggtagggaatggtcgcgatgatcaccatgcatgcacgtcgacagacgttgaccgcaccacattgatagtctccagcttccgtcgttgtgacttgtgtgagatgccacgagagcatacattacacatgcaatttgggattttggggacacatgcaatttggggttgtttccacgcagctagccaagtcatgggctctcccaattagtctgacccgaatttattcgctcgctgccctaagcaagaatgcatgaagacttgtcaaaggaatatattactgtacgtaattactgtaacgtaggattggtcgatatataggagtagccaattgtcaagtcctatgcaagctagtcaggtcacaaaattcttgaagagatactctgaataatatatgacgtgtcaagttgctatactagtattgttttatactgatctttctcacgttacgtagtagtagtatccaataataaagaaaagataagtacgtagctcgacattcaccggagcatgcatgcagcgacttactacctcccttttaaaataaaccaatttacgtattaatatgataaaatctagtacaataaatccggatagaagattgtccagactcactatactagattatattatatccttatcaaaattgatttactttacgacggagtgagtatctagctagatcagagcaagtaccataaagatttactcctaagagtagagatgtttgcccctagtgccacataaaattaggtggaggaaaaaagtgaggagatagagaataagccaactctcatgtaacgcgtaacctctatacaaaacttcaagaaaaatacaaagagagtgagatagtgctagagcgaaccaaccaaaaagttatcaaggtttatttattagagataaatatattatatatacatgatgcctcttattcctaattcatgagtagatgatataactaatattagaagcggtagccacgccactaatataaaactactctgagcagacatgggatatattctactctctctctctctccaaatatataacaacttctagacataaaggtctgtcccaaaatataacaactttttcaccaacattctcttcttaaccaatcgcaatcctccatcattcaattttctcacctatcttcacttctcaaccaattacaattttatcctatttaattttacctactttcttaatacccgcgtccaaccttaaaaatccttatattttaggacggggagagtagattaaaggttgggttctttattactttttttttctcaaacttctactctctcatttatcatgaacacacttcacgaacttttaaatggttttttcaaatattttctaagctagtacgtagttactttaaaaaaacatatatattaatctattttctaagttaacatttaattaattattggttaataagctacctcgattttcgtacaaggacctaaattaacgtggtaatataaagctagcttcagcaacgtagagtacttcctgtggcagggagatcgattgatcgaccgctgtgacgctgtgttttagctaaccaaccagggtttttacattccgaaatgtaaaagatcaatctcggggaacaaaaattcggaatagcaatggtatttcaaatttgaacagttttttctctgaatgtaaacaaattttcgctaaatataaagatactaaaagtttttggacatgtacgtaaattcaaattttctaaccgaaaattcaaaccctactatccgcaacttgtgagtagttaatgcagagtaatgatgatacatgacggctaagctagctagtgggagtagttagctcacagtaataatattaatggtggtatcaaataaatgattgctagctagctttccatgcccgtaattaacttatctcaagtttctaataaatacttcctcccatttttataattaaagttttagacaacgatactgccctccaaaacatattttcgatttgaatccaacaaaaaacaatgaatcaaatatccaaataaaaaactcccagaatcaacccatcacataatcaatcaacatatatataatacggccaatctttataacatcctcactttttaattggaagaacagaaatggaattacatggctctaggaccacccgccaccgctattcaccgcatggtgaagaagtccgcccacccgctgctctctacagacaaccattgatgtcgagatcagctgaagagagagggggtaggatgaggaggatgagagggaaaggcgcggatggaggaagatggtgaatggacgttaaccttggatgttggtgttggactcgagggtggcggatcagatcaatgacaaggacgaggcttcctgcctagtgctaatgcctccatcctccacttcattagtgttgctaattgtgatgaagagaatgaggcactctagattcagctcgtactaggccctaggcagaggcattgagggcaaggaagaagagatctgacatatcagtgccattgccctcgtcgccgcgcgttgctgccccatcccccttgctagccccaaataggctagatctaggttgccaatctgccagcgccataatccctatggagccaccgtcgca

SEQ ID NO: 39906 - DNA, 2511 bp, Oryza sativa
catatatatatatgtgagcactaggatttttaatctcagagtgtgaagtcatgtactacgactccactaatagatcaataggcgtgctttatcctatacacacaagcactgttaattgatatcaaccttggacaaaaatagatggcttaattcaactgctacaataataacatattagtgtgcagtagaaccgcatactattgacacagtagtgtgtattagaaccgcaccggcctcgaactcattttcttttgctatatatagtattcatctgcagatccagatctccttttcagtcggtgattgatccatgatgctcatcagtgcaccgaaaacgattgtgaccaacacgtgagaaatgtgcagtgtaatccaaaggaatgaaaatgcaacacgatacgtatagtatatatatatgcacgtaggtactcgtacgagtactactgtatataattaatggctaaactcttgacgtgttaacggtcttgtacgtttttcttttcctatatatctcatcaaacatggattaattaggcttaacaaattcatctcacggtttttagacgaattataaaattagttttttcattcgtgtccgaaaactccttccgacatccggtcaaacattcgacgtgacacccaaaaattttcttttcacgaactaaagaaagccaaaatcacaaaacacctcaacacaattgattgtttttttttaagccgcacgtggaaacaaaatcctaggcgtagattgttttttttaagtagtgacttgtagactccatggactgactaggaagactataaatcgtacgtacgcgcagaatgtcacacgttaatgtagcgaattaacgcacacgatcgacatgcaatatattcaacgtgcataaattatgtcatctattcgtgcatcttttcctagctagctaacttgcaaaaacctgcagcgggttgtggaatacaaccccagttaaatttgtaacggtgcgattgatttcagacttcaggccgtccgccaaagaaatctacacgaaatttaggcacggtgaaagaaaaatacaggttcttggaagtatttggaataagtgtccctagaaagcaaatatatcatattcaaaataatatcgattaagtactgtgcgaggaaaagtaagagtagacgacgttcacggcgtcgtagttgagttggggcgaaatttcataatgacatacggcttgaactaacctttcaatcaacgtgaaagaataattataacggtctatgttgtccttgcgagcatatattaatgctgatagagacattgatctcaccataacttcagtataatagtaggaaagaatgtgaagcataagcatcatatcatcttcaattgatttcttcagccgccgttaacatggaaacatggagtacataggcgtcacgtcaaagttcggcaactagctaggagtacaattttatttgttttaggaattatttctcttgaaatttatgtgaaccggtgagtaccgttgagttgtgattcaaattcatttgcacataataaaggccagcttctgctggagcgaaacggaggcccgtaaatgctcgttatcttttagggtttcaccttcatacatacctttgtaagccaccgttcggcgttgtaacctcaccctgatatagtgaagatattttgctggctagtgctcgtggttttttctctcctgctttgggagggttttccacgttaaatctcgtgtcttctgtgattgatctattattctttgtcgtttatttgcctatcgttttctaacaagtactccctccatccaaaaggaatacaattgtagcattgaaaagataatatacttagtatgaaaggtaaataacttagatgtccctcactaaatgagaagtgagaggtggttagagtaaggttgggagaaatttaaatgagatgtaattgcagagaaaatagtactctataattgtattattttgaataaaatctgaatgttatgtacaattccattttttttatggaggggataatcaatagtaactaaagcgtactgtgtatcccctagtttcctaataaaccaatcataaacttttcaattaattatatatatgaaaatggaaaggataacataagggtttacatcatgtagacatatgtcagacttgattaatacccctttagacttttggtacattatattcatgtaatatttcttcgccgcatagtaagaggtcttgagacagagatcgagagagacagagatatgatagaggaaatgtcttgttgagaatacaaacacaccacacactgctagttgggaactctcatgatctgtacctgcagttgctcaaccggcacttctctttggacacgtatgatgtgatgccattattgtagcacttatgtgtctctaggagccaaagaaatgggaggtcagctcgaagagtcgatgcttcgagcggccatccgatccacatcccagtccataccctaatcaatccccattcaagaa

SEQ ID NO: 39907 - DNA, 2061 bp, Oryza sativa
aaatgatgctgtcaaaatttagattcatattgaaagtagatatttatggttatgctattgtatcacgtaaagaatatattagtaagtagttgattgttagtcaaagtagttctaatgaaacaaaatatacatcatatttttcgacggatgtctggagtatttacacaatgtactcataagttatttatacaaaaccccccacttccattttcaaagtccagtttgtaggatcactagtcccatattcatcgacaatttcctaattggtcttgtcagaagacttcactatttcttcatgaaatggcattatcaattaggtgtaataatgtgctcatttgtcatcgatcaaaacctaactaatagatcattgtcaactccatatcatatatactcccttgccctgttcttccagtccaatcagatcactccagagtacaataccttccttagctggtgcctacactacacgcagtacgcatgcatctccatgcatgttatttttttcagaattcagaaatttgcatctccatgcatgcatgtgaacgagctggctaaagactttttgcaacattctatctaacctaatgtttcctaggcagagagggtagttagatgcgtgattaatttctaactacaaatgggagaatatatactttgttcaccgtcatacaactaattagcttcatcatttggcaaagtctatacgtttcccgtgaagactaacacaagcaagaaatcaacactaagaacaaaaaccagcaccgttcatggacgtcagtgcagcgatttttttgcagcacgcgcgggcgtctgatttttcgtggccttctctttccatgaacaaccggtctgcaggtcccagtgtttcaccgcttcacgcgacgatgacgacgatgtcgacgacgacgttgattagataacgtggatgcgacggtgaaaacgtggaagtgcgtactccctccgtcaaaaaagagaaacctggtttccgtgtccaacgtttcaccgtccgtcttatttaaaaaaattataaaaaaatttaaaaagataagtcaagcataaagtattaatcatgttttatcatctaacaacaatgaaaatactaattataaaaaaatttcatataagacggacagtcaaacgttggcacgggaacccacagtttgtcttttttggggacggagggagtagaatttcactgcactaaaggatactggtggtcatcgatcccaaaaattcagtgtgtaggtaaactcagtcactgtcaggatacaaattttctttgatggtcagattgcgttgctgttgttgttgggatcgactgtgtctgaggtcaggggaaaggaaggcagccttgacgagtatgcatgccgtaattactaacgttgtaaaaattgtgaccgcaattaccgagctgtgatcgtgatgacatgatcctgtcaacattgcttttgtttgaattaacctagcttctccagtcaaagtttcagccatcgtcgacgtaggggatatacgattttgtttttgtatgtgtcactggtttgtggaatgtatcatttttgtatccacaaatggcaaaagggagaagagatacaaggtagaccacagcgtggcacgtgtgaaaacagtaatactaatagcagcataagtaaaaaagaatcagatatgttcagtatttcaagtgaacacacgaaaataatgattttgtttggctatcatgcaccatataggcatatatatagtcgttttgtttttctatctgtcactagtgtgatgggtcattgttctcacaaacggtgaaagtgagaagtggtctaacgacagtgaaaacctagctggcacttgtggaaacagtagtactaatagcggcataaataaacaaaatgtcaaataagttcagtatttcaagtggacccatggaggttttggctgtcattgtgtgatgtgtcgtactgtcattgtttcacaaatggcaaaagtgagaacaggtctaacggcgcattagtggcaattgtggaaacagtcacaaattaaaagtgacatcagtaaacaataagtcatcaa

SEQ ID NO: 39908 - DNA, 1333 bp, Oryza sativa
gtactacaacacagcaaccaggcaacaaagctgaagcttcttcaccgaattttgcatccacaaaatcaggaaatttaatagttctgtattgtaaaaggtgctggaagtcaattgcagaagcgtagagaatctgtttggtgatgtatggaagcagcagtggtaaaccctctgaagacaacctaaatgtgcatggtgagccatcctttgatgactgtctttcctgaaagatattgcaagaatcacagcttagtgtcgtgccatttgccccactgataaaagctaaaattgataaagaaaacataaattaaggagacacttacaaatatctttaggccaagtgaggtaatcttaagccgctcaccaacttttacattgagctccaaaacttcttgcactgattttgacacgtagtatattcttttaacatggccagcatcaggattcctagtcacaaggtgaccctcaagcggaaatgtatccttgataccatagaaagatactatacttcttattgtagcttcatctttgaaaaatatcactggatcaacccctctccaccttccttggttctgtggcttcctcctcctatctcttggtcctgcttgatcattttctgcctcattaacaattactttagcttcctctgagcttttaccatttgatgtttcattatccacatctccattttgctgttcatccataacattaccatcatcaactccttgctgctgcacggtattttctttatgtggcaccttatctgatccgagacctttctcaagtttctcagccctatcctttgaaatattgtgctcgccttttataagttctgcctcttggttccctgcaaagaaccaaagatattaaggtatgcacacttgaacattaataagcagtggctaataagtttatgcaatttgatacaagtcatgaaatacatggaataaattcctaaagattaccattaataggggagattttctgaaggactgcaataaaaaatgccccactgttttgatcatgcggaacaattctcatgcagcgatgcagagggaaatttgaatgttctgtgcggatagacgtagaatttgactttttatcagagtcgtttggaacttcattagactcaagtttgctcgtctcttcagtattgggatcaccaccattattgacatcatcagatgctgttttcgtttcttgttctccctctaccatgtttgttgaatctttcatatcagcatcaattacatctgtgttgatctcaacactgccaatagccacatggctatccatggtgcccttccctgaaggaaacatgcttggtgatatcacg

SEQ ID NO: 39909 - DNA, 22584 bp, Oryza sativa
aaatttcactacttaccactttctccacatatcaggagctttacgcacagttccatcaccactacaaggcacatcacacaatacacgatcaaattccaacctctgcagtttggactcatccgtgcatgtttctgaactaaactttgcaagattacagccaggaaagttctgtgcttcatgattcgtcacaatcaagttggctgtgcacattctctttgtctgatgaataagaagattgcatctttgcacatcaacatcattagctaccacctgagtacaaagtatgaaacacaaaatcagaaaaaaggttttgattcaaagtttttttttctatcgttaccagaaactatagatatgtgtaatagaatgtgaaacatacaagggcatttggaagcattccaggctttgtagactgatggatcatctcaagtaactggaaggtctttgatcctggagcagcgcacactgcataggataataccacaaaaattcacaagaccaatattggagaagtcctcctctaaaaataaaattttcaaatagtccatgtgtaacctacttttaagctcaaatgcctcaaaagctaagtctgatataaagctaaagccaaacagaaaaggctaggtctaaatgataactacggggtattctggtgttctcatttttttcctttttactggtactaataaattaacatgttcctgagacttataaacttttattaggaactattgcgccagatgctttattgagcaattagttttaaacattacaagctggactacagaagagcaaagttaggtcaaacatgcaggtcaagagacagacagccagctgcataaatagcacaatatgaggaatgatggaaaagaacgtggatatacatactgtcaagaatatgatgatcaggttgcacattcagaaacaaaggaggaacctgtaaaaatattacatatcattttaacaagaagaatatccgcaatatacatagaccatcatcaataaacaatatactcatatagctcatcttaatatatataaggaacttaccatgctgacagcctcttgcctagttatattgccaacttcattctctcgcttcaagaattcatgaaaactggagagggaaacaaatattacaaaaaagtattatgtctcaatagaatattaaatgagcgcctccaatgtttcaatggcagcaattgttaagtgcaatttttttcagtttctttttcaaaagaaactagccctaaaaaatcttatgaaaaactgctaacagtgatataacactaaatctgcaacaaaaagccaaacacaaatatttgagaagttttggtgaacttttggtgatggtttagtagagaattcaaggcaatcactgatctataaagccataaattggttagtaattcatcatttaaggggcaaccatgttctcaataaattcatcaatttacacaaactagtaatgtgcccgtgctaacgctatggtgatatttagtaatgatggtatatacatgagatgacaaaaaccaggtgaagggagttttattgtaacaaaaacatcagtttaccacactcctaaaaaacaatcatcctatatactgcgcattgttgacacaattctcccaagataaacattatgcatacccctcaagtgcctggtttctcctcagctgcattcgagaaaaattcaaatgccatgcaagattgccagggtaccaaggcaaaggccgaatagcatcttcttcatgctcatcactaacctgtccatgcaaaaaaaaaaaaaaggattacaaaatagaattgtgaaggacataactaaaatttatgcacaaaatatagaagctacctcagtttccaatgacttcctgaagtcattttctaactgtgagcaaatatcttgataaaattgacagctggaaaggtaaggacaacattagcatactagaacagaataatcatcataaaacaagaattagttatgtgcaatgataccagacatgataaggtatcagtaaaatcaccagtgcatttcatgcaaatgcttttgttctaactatatgatcaattgcacatagaactggagatggttatatctgaagaatgaaccatggcagggaaaaaacaggagaatcaggatagagataatgtccttttcttttacaaaaggacagtgaaagttatatggagtcaagtaaaagattattcaaacagagcatggtttttatcaattcaaacaataggcagatatctagaacctatatatgattagagtttaaataacagcaatagagagttagcaagataagattaaaagttttgattgtatagaaaacagtataaaatctatatctatatctttttataagctaggataatcccccagattcatttttgttggaacaaagttttgagagcttatagatatttcacccagaacatatacaacaccaccaaggaatttttgccttcttggtgatttcgagcaatatcgcaagctgtttggtcatgaaaagctacattacacaatcatcagaactcaaggaatgattttctttaaaatgtgatgctgctatattgcaataatcaaggtagtgtcataaacaagctaactgcactgccattcaatacaatgtgaccaacaaacaataaatcattaggccaaacatgtggatggagtcatgttgcttcagatgaaaacaacattacctcgcattaatcctgaaagtggctggcagcggtttccggagcatgttcatgaagtcgtcccactctccctccggaataatttgctgtgcctataagccataaacatgtataaacattctaattcagaagttatgcatccaactgaaaaactaagctaataagcaacaacagtataagctaatgcagtgcgtccagttaggcttctcttatcgtaaggtaagtctagagatcagtactcgctactcagcatcacaatcaaaatagagcagttgcttcttgcttgaaagctataatatccgcaatcaacaagacaacaaatcatcacattctaaacgaagtacacatacctagagcgagaccatacgatcaaaaccgagatgccgctagctcagctcaatttttttactaacacaaccaaatcacacccaaaaaaagtaaaatattaagcaaccgcaccttgtagtagtcctcgaaggctgggttctcggtggcgaagggctgccacgaggggttcccttcgcgcccctcggcagcgcctccttcggctccttcgccgccagccgccggggggcgctgcgggttgtgcttccagacgttctcccgcccctgcttgaagtggcggcgctgcgtgcgcccgcgcttcctgccgcctcccatggcttcctccctctctcgcgcgagctgctcctgcttccgccgctgctgctctccctcccggtgacggcgcggatgcgggcggcggtggcgcgaggggaggagggggttctcttcgaggggtttaggagcggcggcgagtgatgcggggtggggaggaggaggaaaggcggctgggcgaggaggaggaggtcgtcgaggtgaattagttgggccgggctccgtgtgggctggagacgcgcggtagagtagttatgggcccactatttcacgccataaacctgatgtgctagttgtcttctacgcccaataagatgttgggccttgtttcccttcagttccataaataagttcatttatagatccttaacttgaaaacaagtttgatttcgttcctgcaccgaaataccggatacaatgggtccctgtccctcaactgttgaaaccggtgcaatatgtgtctcatggtagtatagcaggtggttttgtccaatgtgacaatttaacccgaatcaacagtgctaactcagcttgggacttggtgaagaagggcttttggtggggtgttggcaatgggagttcaattaatatcctcactgacaattggatcccggcgttgttgcgggacatctgaaaactctaatcccaattcctgaagataccaaggtgcagtcctgatgaatgatgaagcaaatgcctaggatagtgatactgtcaaggcactgtttgaggaaggggttaattgccaatgagatacttcaaatccctatcaatcgttttggtgacgaggacttcacgtcctggccacacgacaaacatggcacctacacagtgcgctcggcttataacttggcacggtctaacactttccttgcttcacagtgtaacaatgggagaggacttccttcttctctactggagagtcagaaaagctggaaagctctgtggaagatcaatgcacctgggaagatgaagataaacctctggcgtgcagtccaagattgtttgcccactggcttccagctgagaaggcgtcacattgattctaatgacggctacgttttctgtaatagggatgatacgttggaacatgtctttctttcatgcccctttgctagctctgtttggcaggaaattaaacagatatatgatatcaaattgaagagaagggggatcatgcacttgagaaattggatttttgacttcctggaacagaattcaagctttcaacacactgtccttatagtaactttttggcatatcagggaagcaaggaacaatgcaagaaatgggattagcgccctgcatcctcggcgcgtggctcagaaggtgtttggttatgtcgatatgataatgcaacattgctccaaatctcccctcctccattccaaggtggattccaccgccggaaggaacagtaatgatcaataccgatgctgcagttttccaatctactcgtcaagtgggaatcagatccgtgatcacacaggtatctgcttacttgtactgaatcatgcagcgaacgagtgaacaacatcgtcctccctgaaatggctgaggcactggctattcgtcgggcactagtactggcaacagaagagggtttccagcaggtgttggtagcctctgattgcatgtcagcaatacagcgaatttaggcaccatctcgagatcgatcaagggtggggtgtctgatccaagatatcaagaagattgcaattggtttccaagcctgttcttttatgcatgttaaccgtctctgtaatgcagtggcgtagataggatttagagtaaaagtggtccatctatatatataataggtcaattaaaagggtagtccactataaaatttttattatattaactagtactacatatactatagttttaatctcgatcaaatttttaagtggtccaggacccacagtgccacctagctagctacgcctctgctgtaatgtagcggctcacactttggctcattgttatgagcaattctcttgttctgtctatcgttctgtgattccggactgtatccgggaaacactctgttatgatgcaagttaatcaatagaattccaacattacctaaaaaacagagtaaatattgctagtgcaatacttctcaaacctctaagggtgtgtttttttagataatggattacattaaacccagcctctacaccttgtgaggacagcctaaaagtcacaaacatgagtacataagactctcccattacatgggtaaagcataaaaagtttttaaagacagacaacaagcaaaaggaactaaaagctaagcttcaatccttcttctagagttccacccaaagatagagaaaagctccatcatacgcttctctaaaagattgcatttcgcgattacttcaatgccttcgtcttccttaagaagcaaagaccaaagccttcccaactgagttgctttgaaaattacctgcaagaaagatacgtggttgtagccattaaagactaagtcattcctactgagccacaaagcccaacaaatcgttgctatgcccacccaagtttgtcttttaagtttagattcaaaacctcttaaccaatttccaaacaagtgtgagctattacggggttgcttgattccaaaagtaagatagatcgcactctaaatgtatctagctatgagcatatttcccatccttaaggaggtaccacgaggtaccatcaggtaccaatctaatctaactgttggtttaacaggggtaggattgtctaatgaaaatgaggtgcccgtgctaatgaccgcccactcggccaatagggagttcgtctgtgccgcccacttctcttccattctgccgcatcgtggttgcatcgaagcttccccggcgccgccgtatcgagcctgttctcccaccacggcgccatcgcatcgaccccggtgcggctgccgccgcaacgaggctgccgcatccagcccgccgtcccgcggccgccgtctcatcgagacagccgcggtcccgtctcatcgaggccgctgtgcaatttaaagaagagatgttgaattgattcattagttacaaaagctacaaagcaaactacgcttctatctatctttcttttagtaagattatctttgtgtatttagatggagtaacaggctcagatagaattggccgccgagggaccgggcgactcgcgcgcatgagggagagtgcgtgcactcgcatcctccccatccttttctctccctcttttcctctcaacctctaaattctcccggttgaatgggtatcatgtactactatttgacatgtctcaatcatacaagacttgacactcattgaccagtctccacaatgacagtactgcactgataagcttattgctactagacatcctggaagctagctctcatctcaacaaccggcaatccggcatggacttggagactagcgagtccctctgggacctcagaatcaattcctagcctgaatcggggaatttcttcttcttttttaaaatagaaaggcctgacagccttccccttttctcatatcagaaaagcagacagatttaaacttgcaaaatggaaaaggaagaaataaaaacatccagggaaacttcgcacacagctcatgatcaagtccatgccggtttagatccaaagtttggatccaaacttcagtacttttccatcacatcaacctgtcatacacacaacttttcagtcacatcatctctaatttcaactaaaatccaaactttgcgctgaactaaacacctaagcattatagggcacgctagctgaaatggtgaaaaatcctgcgtgtcaatggcgcacaccgacaaattaccccttcgtcgatgacgacgacgcgagtcacgcgatccgcctgttcctgttccgccgtgtgcgtgcgcgcgccgcgtttcgtcactcgtcgtcgtcgttgactcgttgtcgtatgcagcggactcgatcggctaagcgctctcgtctggttggctgcagggtggttctaataaatgtggtgtgtctcccgtcctgcgtgtaagtaatccatcatcatccatggtaatagactttggttttgctgggtcaatgcgcattatatattgatcggctgccagtatcttgggttcggcatgcaactacttatgctacagagcactcgcctctgatacagagagtaattgtgtgtgaccataggattgaggtgttcagcactacttcagcggttggcatggttttacagtttgtgtttgtgaatggtagacggtgaatcgggacagattcctggctgccggtgaactgtgactacaaacaaaattatgctcattcacacaattgatcacgtcgtcagttcgtcactgaaaattccctgtactgcagacgttgagttcacaagaagtgaccgatgtagtggacagactcaatgatagcattgatcttgaagatactactagtagtacatttttagtttctcgttctgttgttggcagttaagtaaactagaagtaacaattatgaagtggcttccccaaaaagagacaaatattatatttcttgtagtagtttgcgtttctcaaattatacaagtcatgatggatatgtcgttacttcaatctgtaaatttcgcctacaatttgtagtttgtacttcaatgatgtgatcaacaaggcaggggttgaggaaattattatcttggccctggctagcttgtcaatgcgaattattgatcggctgccgatattttgggttgagcaacaactcgtatacatggtacagatcgctcgccttgatacagagagaaattaagtgcaagtgtgtgacacgtctctcgtcatgcaagatttggacttattcatcagtctccacaatcgtggacagtagggcactgctagatgactgctacgggatctcttggaagctagtagtagctctcacctcaacaaccggcattgacttggcaagtctccctgggaccctaatcaagattagagagatgttgagcagcggtagaggaggagctgaccggttgaccggccggctgaggaagtgagaagagcttaattagctgacagttctgcatcattggcgcaccaacaaaatagtgttttgcccttttgctttctaagtcgcttccagcgtcgtcatcgtcgtccaattagacaataataaagtgattttcggttgtgatgatgcggtctatatataccgggattgatcaacgttgataactaattagttaactaatcgtcaatgtcactagcttctcaaatttgctgggccagggatacagtcagttagtgcattcctctcatctatttaacactcggcccagccccaggcccccagcagcatcacacgtactcagaattcagaaacacacaaccaccaagagagaattaaccaaatgaccaagcttctccactccgcctgccttctcatctgcatttcaggcgccatcgggttggccgcggctgctgccggacacccaggctgccagacgaggtgcggggacgtcgacatcccgttccccttcggcatcggcgatcactgcgcgattcacgagggttttcggctcgagtgcgacaacgccacgaaaggcaccagcaatcagaagcctttctggggggacttcgaggtgatcaagatctccatggaagacggcaaggtctgggtgaaggcgtacatgtccaggcagtgctacgaccaatccacgggcggtatgtcatacagcgacgcatcggcgaatttgagtggttcatctttctggttatcggacacggataacaaaattaccgtgatcggatgcaagactctcgcctacatgacgaccgattctgtaagtactatttcagtataatttagtaaatctgattttcacaaagttgtaaaaatgagtcacccttatttttattttacttttttagaaactagaaaaaaaatacccgtgtgttgcaacgggtgaaaactattttaatcatattattgttagatttttttaaacaatatatgggatttttattttgatagtattgatatctaatttggaacttttattagaatgatggctatatcctacgttgctattttttatgctttagcaagaattctaaagcaattagaagtccaactctcgtcccaagttaatatgcgagttttttaaaaagatttttatacgactctttatgtacttttaaaagtgaatgaacttagagcatcaccaacagtctatctatctgattttcaaaactgatttggagggattttaataaaaaaaatagctccaacagatcccctactcacctacccaagttttggagttctcttctcccgattcctcgctccgtttatatgcggatgcgtgttctcgcaaaagtcgctcccaatctcgcactcccgcatctctcctcccgttcccgcgtgtgggagatagcgatctttttgcgatggaagaaaaaatagaattttttgttagtagtttaacaaaagggtccattttaagttttagggatttaatttaggctatctgttagagggaggagttttttcacttcctattttcagtttaggaaacccaaaaacaatttttggagggaagattatagataatctgttggtgatgctcttaaaaactgactcaaatacgaacaatgcaccaaaatgtcaacaaaaatattttcaatttttataatagtagagatagagatttatagatgtccataaggggtggaccaaggtttctcataagacctggaccagcttatgggcatgtttgggggagtttctagctgttgcagcttctcctagaatcagaagctccccccaaacagtccagcttttggtccagattttgagaagctgtagttgtagaatctataaaatgaactagaagccagcttgctaccaaccagctgcttctcagaatcttaagctcccaaagcaggcccatgtcatcttggtctaagattagagttgaaatattacggtgttttgttggtccgtccctgcgtccatagattgattgggaatagatattattatcccatttgcttatgttcttttctccaataaaagttggataaacttttggatactcgtggcatgtttttcaaattgctaaacggtgcgttttgtgtgaaaattttctatatgaaagttgttctaaaaatataagattaatctatttttcaagtttgtaataattaaaactcaattaatcacacgttattaccacctgattttgcgttaaacacttaatcttaatctttatcttcatcttcaggagattcaaacacgctagttgtgtccctagttgcagtcgaatactacacctaagtgcgtgaagcatgatattaaataaatttataacatatgtaagtttatgatactccatatttaatattattagaacttttcaaggaaaatctacatatattatttctttttctcttctctactattataaaaattgaagatgtttttgtcggtacttttgtacgtcatccgtgtatgagtcggtttttaagtttattcgcttttggaaatatatatttgtatttgagtcagtttttaagttcgtttacttttggaaatacataaggagtcgtataagaaatctctttaaaaaaactcgtatgttattttgagatgattggactcttaattgcagttcatggtttcataaaaagctatatattcacgcgaattcccatagtgaattttatcttaactaaaccgtataacaataataagattaaaataaccttcacccgttgcaacacacgtgtattttttctagtaaaattaaacatttgagaaattattgataatcaaagtttcgaaggtctgatcagatctcatcttagctaaatgtcaaatatttataataagaggaaaagtaaaaattaagaacgatccggtttttcacatgcatttcaataatgtgcggttattgcatcaattgccattgttgttgtcttctacagtcaactattagctattaggttgggtgggataaaatttacaaactttgatataagtttatagaaaaatatatttataatatataccaaataaatacactattaagacatattttttatggatttaataaaaactaaattgatgttgtagatgtggtgcacttttcttatgtttaaagttagaaaattttgactttgaatataaaactaaaacaacttagaatatgtaacaggaacagagagagtaatttgttaatcatgaaaaaaaatatttgttgcttttttttaacgaactggtaaagatgtgccaattttattgaatatagaagtaaaagttacaattacaagaataaaaaagaactgtaaaaaagggcaaggtctaaggaattaaaagcgcaaggtgtaaagaattgtacaaatttcattgaatattcgttgcttttgatcttcaactaaatagctttctgcatccatatgtaacaaatgcagtatgtaatcgggtgttcgtcagcatgcgacaacaaagtgaacaaactaactcccaagaatggttcatgctctggcgctggctgctgccaggcaaatgttcctaagagcatacagtactaccagggttatttcaacgaaggctacaacaccactaaaatatggatgagcagcccttgcagctacatggcagtgatggaaaccgcagcattcaactttagcacaagttacctcacatccagcgtattttatgacacgtacaaggggggagttccggttgtctacgactgggccataacatcaaaaacatgtacagaatctagaagaaacaagacttcctacgcatgtattagtaacaacagtcagtgcattgacaacctgacgaatgcacaaggttaccgctgcaagtgctccaatggatatgaaggcaacccgtacataaaggatggttgcaaaggtactgtgttgcacctttaattttgtgtctgctgcttatgtacacttgtatgtaatgtgacaattctgacccatgtggtggttcgatttcagatattgatgagtgcctcaacaatgctacttacccttgcaaggggatatgccccaacacgttggggaatttcacctgctcatgctccccaggaagttatatgatgaatggagattgtatgccaaagaagaaactacgttttgactcagtgcctgtggtagtaggtgagctcctatattctgtaagaactactaccatgtctatggatcaccagtttaaatactgcgtagtgtgtagtcataccatacaatatgacaatccaacacttctccctctaaacaacaccagagcttttctgaaataagtaataattaaaaaaaaaacttgtttggccaaattttgtgtagtcgcgttggccaacaagacacaactctagcacctttcttcattgcgacattgcagggatagccttaaatctgctcagtattggtccatagaaaaaaaaatgtaattgctggctaggtgatggaatttcatccatatcattttccaacaacgtgcaggcgcaagtatcatatctgttgtcctggtgattaccataatgtgtgcttacttgatcaaagagagaagaaagcaacagctcatcaaacaacattacttccgacagcatggtggtctgctgttatttgaagagatgaaatcgcaataaggtgttgcattcaaaatcttctcacatgaagaattacaggaagcaacaaataggttcaatgaacaacagattcttgggcaaggaggccatggaactgtttacaaggggcttctgaagggcaacatggaagtagctgtcaaaagatgcatgacaatcaatgagcatcagaagaaagaatttggtaaagaaatgctaattttatctcaaatcaaccacaaaaatattgtcaaactattaggttgttgtcttgaagtagaggtccctatgctagtatacgagttcatcccgaacggcacgcttttcgatctcatccatggtaaccatggtcagcagatctccctggccactcgtcttcagattgcccatgagtcagctgaggcacttacttatctccattcatgtgcttcaccaccaatccttcatggtgacatcaaatcatccaacatcctccttgatagaaacctgatagcaaaggtttcagattttggtgcttccattctagcaccaacagatgagtcacagtttgtcacactggttcaaggaacttgtggatatcttgacccagagtacatgcagttgtgtcaattaacagataagagtgacgtatatagcttcggagttgttctcgtagagcttctcacatgccagaaagcgttcaacctcaatgcacctgaacatgagaaaagcctatcgatgaggtttctcaatgcaatgaagaataacaagcttgcagatatattagatgaccagatcaagaatagtgagaatatgccatttctcgaagagattgcagagttggcagcacaatgcttggagatgtctggtgtgaataggccatcaatgaagcacattgcagataatcttgacaggctgagaaaggttatgcaacatccatgggcagaacagaattcagaagagttggagagtttgcttggagaatcgtccatggtcagctcaaggtataccagtacaggaaatttcagcatagagagaaaaggtgtcatggagctagattcagggaggtagtagctatactttttttttcaaaatcttggtgggcaatgtcagtattatctacttaaaataatcatatcacagatcttattacagtaaatatgcaatatcatattgttggcaaaattacttgcattgtatgtaggacaacaaagtaatgttggcggctgctcaaggaataccctcaacaatcttggtgttagtgtcgagaagaattgtcattgattattggttatcactatatttcaaatcacatcttagtggtcatagaaacatgcatactgcatgtacagctagtccatgagtgcttttttcagcattccttacatacaagcatgcctggcttgctcacaattggtgacattgcactacactttgtgtgtttatcggtccagcacaacaaggacgcacgcatatcatacagctagtgcacatcgcgcacagtggcacactggcccatcggtatcaacctcccactctcccagcttctgaaatctgaattctacgaacaggaccgagaagtaggtataaatttcagactttcagtagctaccttccaattccagcttttccagggattttccccaggttctgcttctgccagcccgttcccgtagtcatctaaaccacttcaccacaccaaactctgccttgtccaagctgtctaagctaccctgctgtgccgctgccctgtttactctgtcaaccgccgaatgcccccacccgtaaatcgattcagtgcgtcccagctttaggcttctattaccataaggtaaatctagagatcaatgctcactactcagtataagaatcgaaatagagttgtgacttcaataataataaccgcagtcaacaaattatcacattctaaaacagaatataaaactaacacattgagaggacgtgagctagcacacctccattctacactataaaagctactggtataagccaataaggctataatcaaaccaaaacacgccaaaaatgttaaaatgcgtaagcaacgcatgatctgaagcaagcggccgcaccttgtaagtagtcctccaagccgggttctcggtggtgaagggctaccacgaggggttcccctgcacccatcaccgcttccttcggctccttcgccacaggagggcgctggggtttgtgcttcaagatgttctcgcgcccctgcttgaagtggcggcgctgcgttcaggacctttcatctggccggctcctgacagtgcgccctcgcttcctgccgcttcccataccttcctccctctcgctctctcgcgcggtctgctcctgctgcagctgtcgcctttctcactcccggtgatggcgcggataggggtggcggcggcgcgaagggagggggggaaaggttcatggggtttcggagcgacggcgaccggaaagcgatgagggcggctgggcgagaggcggaggtcgtcgatggtggcaccggttgggctcaatgtgggccagcccactcgttgtagaattataagctgcgatgggcatttaactatgcaaaagtacactttacgtcccttatcttgtcgtcgagttttcaaaaacaccctgaaccacaaaaaccggatgcaatgcatcccttaacttataaaactaaagcgcacgaggtcttaggacggtttggatgatggttttggctaacgtggtgcctacgtaacttgtttgactgggtctttatcccacgtggcgttgacgtgacaatttagtctagaaaaataataaaaactatagggcccacgtgtcagttacaccacaaaacaattttaaaaatggtggggcccatgtgagccccacgtgtcatcctcacacctcccctcttctttctttcctctctcttgcatactcttggtcttcttcctcctctttccccctctctaatctcttcctcaccgttccctctactgctcctccacactcctgacatgcccgaatggtggcggttagcttctccagttctcctcaccccaggcgacgacgtcgacttcaagctccacacctgctgccaccatcgctcgctcgttcacacaggaatgacactggtggtgtgtgaaaaatcgtggcatgggcgaggacgcgtgagaggatggggaaggaagcaatccttgccattccacctcttcctcactggacagaggtcgacagggccgtcaggtccaccgggctgggacggtggtgtgtgcgctcgacctcaacatcgttgtcagcgagatgacccaacagcagccactgagggcccaacacgtgtggtagctttcggtagagcgcatggaggatgtcccagaggggagacaggcggcctctgccacattcctcgctgacaaacaactacagtagcgggcctcctcgaaggaggcggtcgatatctgcctccttccttactgacaaatgatagcgtccgaccagctgcaagatttgggcgtcggccagccgacagcagggacgtggggaagaggaaagggccggccgccacccttcaccggaaccgctgctcaagctctgtgccccactaccacctcgtcaagctccggagctcgtccatcgctggcctgtcgacctccggagctccgagaggctgagacagaggtccgtcgaccagtctacgacctcccgtcctttagagggagataagatgggggatagagaagaggaatatagagaagagagttggtgacatgtgggtccacatattttttttaaccgacaacccgctgacatgtggggctatctttttttcccttatgactaatatatggatccccttgtttatttattaaaaaattctgcctataatgccatgcaagcgccacgtgggatgaagatctactctaactagccacgtaggtgtcatataagccaaaaccaccatccaaaccgccttaggacctcgtgcgcactagtttcgtaagttaggggatgcgttgtatccaaccgtactccgtactcatccccgcagcccatcgtgtgacccatcttaaattgcctcaaacttattttggatgagccggtaagaatgcaacatttttcaggtatgcatgtaaaaaattctaatacacaaacgtattataaaactgtttaattatttaattggttgatagtcatggaaaatcaaagatatatcaccatgtggcattcatatcaggtattttgtaaaaaaaaattgtaagaatctttttacatgtatcactttacttttcagcagtatctccgaaatgcaaaagtctactccttgtagtggaaaaactaattctgcacgacgcagccgagccaggacgccgagaatttcatgtaccggccgcgtttttcattttgaccatgtcgatcgagcagtactccgaagttgatacagattacgcagaggtgacaacatatggcgcatttaattaccgcaactagggtgaaaacggtcagaatcagtaaatgacactcgatcgactaataattgatcatatttatcatttaaactggtaagtatcaacattaatacgatacagaaagaaattagtaaaatcaaaattcataaatagccaaaaatggtacgatcgaaaacggtaccccttatacaaatacgaaaacgatatttagtcgaccagaaatttctgtgaccgttttcacccctaaccgcaaccactggatcagcttcatgcaatcttcattaaccgtacacctgccactagccctatgaatattggagaaggccgagaccgctgcgaacttgcgagcccctatcatttgttaaggtcttgtttgattcagtttaagattatgataatctgaattattaggagtaagctgaaataaacagatagctaattatgataaatcattataatctataagccagattactataataatccactctaaaggtgctttttctaggggcctgttcatttttataccattttcaaccttaccaaattttggtaaagttgccaaaaaagtggctacatttagtttgctgccgaattttggtaactatataagaaatcctgccaaaattttggcaagttaccaaaattttggtaaggttttttttttgcatcaaagtgaacaggccctagattattgggtgtctaacagctaataatacagagaattaaacagctaacagcttagcttattttatgttggcttattataatccaggttatagtaatctgatttaataatctagattataataattttaagctgaaataggaccttagaaactatataatcccaggagcgtgcaaccatgacccagtcacgccatcgcatttagggcctactggagtacacttttgactaacacaaaggctctttgtcaaacgaagttaattaaaaacgtgaggaggtacatgtgaaaataaagtactgcaaatcacataacatatgtaatatcaatatgtaaattaactatcatcggataaaaaatgaacttgtttatgaattatccacgttatcttgagtaaaactttactaatggtgatgtaaacaaatatcagacacatccatttttaaatttttaggtttacgatacatatttttcccatagggccatatacaagtacttagcattttattggtcaaagtcagcctatcccaacggtaacatctatttccttatattaattagcaaaggatctcgtacaaccctcacactaatcaagctagaagtagcaaaatcagtaagagacaagctaaaaatattattcttgtgttaattaaaaaagataaaattatacccgtcatccatcaaatctagagcggagatattccattacagaatacgtggatttatagaattagaaattaataaatatcactctcaaatataatattttcacgacttaataatttaaaattataaaataataaagttgaattttactggggcgtcagttatgtaagctttatatatgatttaataagggtacatagcgaaaacgatccttgatttctagcattccgtattagataatatatgctgtgtcatacagttcaacgtatgctcaacatatgctgtgtcatccttgcaagaaaagtcaacatttaaatgcctattatacccttacagataccatattaaaaaatagaaaaagaaagtaaaaaacaaacagaaggtgccgtcaaccttattactgtttgttttctctctctcttttttttttcctttcacttttttaagtatatcgtttaaacgttgaccttacacatgcaagtataacatggtatatatgcccatacgggtttaagtcaaaactctctaggtttgactaaatttgtataaaaaaataataatatctacgatatcaaattagtttcgttagatttaacattgaatatattttgataatatgtttgttatgtattaaaatgttaatatattttttataaacttgattaaacttaaaaaagtttaaataagaaaaaaaaattaacgacttataatatgaagcatagggagtacgtaataaaatttaaagtctcatttagacaggaacataccctatgcacacaaaaagtcttctccctatttcgggctcttcacctagatctggctgcacaactcatcaagggtgcagatgatgacaacgaagggatcaggctaatctaattgctcacatgaaacattcgtcggtgacggcgttcacctcctcctctagtgctagctcctcctatttctaagggtgtgtccgtgtgtgcctgtgttcgttagccaaggtaagggacggttatggagtactgcaatgctcttgcaacttgctttaaattaaaaagaagtcctgcatacaagtatgtgtgaatatgtactgtatttgattactactactatttctgctagttgcatttactgtataaaataataataatgcttcttcatcgtacacacatccccctccctaaaaaaaatagagaaaactttacggtattcagccgcccacgtcaacaaaattacgtactatacgcgatacctgcgctgtagaatatctctctcttttttttttttgagaactccactgtaggctatctctctatatattctctatatatataggctagctggagcgctgacctcgcaaacaacgggcacaaccaacaaagatgaagttgcagtatacacgggcagttcttgccagccttttttgtgtctgtctgtcggctgtctgggtggcggcagcaacggccgatataccggcagggcaacgccccggttgcccggagaggtgtggcgacgtcgagatcccgttcccgttcggcatcggcaagcactgcgcgatgcagacgaagtatccgtttgatctcgactgcttggacgtgaatggcaccaagaagcctttctacaacaataacgaggttaccaagatttcggtgcaggagggcaaggcatggatgaagttgggcatatccagtcagtgttatgaccacgtgacaggccatatcctgtacgacagcaacgcaacggcagaattcggtgattcacctttctggctatcgaccgaaaacaagatcatcgtcatcggatgtcaaactatggcttatatggagagcaacgctgtaagtatatatatctcttaagcttatcatttagaggcattttaataagcacaccatgttaagtatacaaacagggaatcggccggggactaggggggaaaagaattcccgaaaactgtcgcaaggccaataccgtcgtttatctagaatttcacttggcaagtgtattctttttttttctcccagccacatgcaaaatgtacatactctatccgttttatattataagccgtttaattttttttcttagtcaaactactttaaatttaaccaaatttatagaaaaatattttaacatttttaatacaaaacaaaaatattatcaaaatatattcaatgttaaatttaatgaaactaatttggtgttatatgttataaatgttgctaatttttttaaaaaacttgatcaaatctaaataactttaactttagaaaaagtcaaacgacttataatataaaatggagggagtacttatgagatagaagaagtatatataggagggaagtttttggatgggcagcagtgatccgatatgattttgccaaaaaccggtttctcccaagattcttgtcactatctacacgttttgatcatctctttactttttaagactcgtctattccgtatttccgctcacactatgctatccacgccacccacgccacccaaagtaatagggaatctcatcccctttgatttgtgtttgtcatgttgtgttgcgtttttgttccaccaacctagcaatcaagtggactgtaatatgctgccacccaattttaactagtccttaattcgcgtaatggcctcccatatggatttgaacatctgacaatcctcgaaaatgtgttgtctcaaggcttctaaaacacaattggtagaaatagttattcagctagccaccctctgatttgtagtctatcagaggtctaaattctgttcagaaggagtaaccaagagaataacttgcatttggagggttcccagatttgccttgccccagctgattgtatttggctagcaaattgcgcttgatatgctaactgctaattctcaaaaaaaaaaaaaagctaactgcgcactgtgctattgatccagtgcccgtcagcttccaaattaatgatggtatattggattccttccgttaatgctgtgttgtttctccataagcaaaatcccatactttgtagaagtcactgaccaaggccctccaaatatttccatgaagaaaagaaaaactggcaaatcaacaagaacatcttttgcgctcaagagggagatggattcaaaaggagcataaagcttcatctattcatccttcttctcaccacaaaaactcagcatataaatcaaaagaaaaaccatatcacaaagacaatagaacacataatttacaaataaagaagcaaattaactcaacacgtacaactcacacctttccatgcacaacatttcaaagaaaagttaacaagatctcatacttagtacaagcttgaacacttctcaagaaatgtagtctgaaagtaaaccagcctatacaaatgctccttttttctcatccaaggtgcgacccagccagggtagggggtaagggcgtgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtatagtcatgttgggctgcggacagatcccgagctcacaactgcattacaaaagggaagcggaagccaagacttggaccaaacatcacaggcgcgacttggaaactaggccgaaaccctaaaactcatcgtagccggcttgctcctggaagaactcctcgtcagcgggatccgcttcatcttcttcagcaactaggggggattatttatatagagcaagggtgagtacgggagtactca

SEQ ID NO: 39910 - DNA, 2027 bp, Oryza sativa
ccaacagctttcaaacggccacccgggcctggctgatcccatcagccgcagattttccaaacatcaaacccatcccacaacagcaaatttcataaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaagggtcccagaccaacaccagattaggtcccagaccatattgtgccaggaagcccaggggtcctccccgacaccaccccggcgaatccacatgtctcttagcatcatggctctcccgataagctagttactcagccaggggtgtcccattccacccatgtggtcgtacttgtcttatgttcggatgaaattccaaggaaacagtccttaggtgcaagagcgggaaaccgtacacccggtacgttccccggtccgcggttttggaaattcatttagttcgcaagcaccgacccaggtgtcggattttccaagtcttttgtaaaacgcaagttttacccaagatgtttctcagattttaagtttgaaggcgaccgtcgatacccgtgcagagtgcacgattaccgaggcgcaactaggtgggtacaagggaacatggtataacaattacaatggaatggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacagctcagcaaacggcaaaaataaagccctattattgacctctaagcgtgccattcgatagatctcgagatttgaggaattttggaagttgaacggagtcaaacggacttacggttgggaagatattgaatttctaagattattggatttttggtctaaaggaaaaggatttatttaaatcctttttgaaaaagaaaagaaggagggagggaaattagacttccctcgggcggctagggcgcggcccgagagaaaggggcggctcggccgagcttaatgggccggccggcccaagaaggcggcccaaggcgcgcgcgcgggcggggaggggagagagagagccggtgggccgggtccatcccgcgtggtcccgggtgggacccgcttgtcagcgactcggctcaccgtgagcgaggtgcacgcggggcgtgctagggtttggggagggaggcgcggcgcatgcgcgcgtttcgcggaggacgtggtgcgacgggcccacgcgcagcctcacggctcgcggtggaccgcgcgcgcgaggggcggagggaagcggcggaccggggtctgcttgacccggtcgcggccgaggtggcgccgacgtggcgcctacgtggctgccacgcgagccggcgggaggtagacgacgacgccggccggaacggacggcggacgacagcggcgagcggcggagcgaaccatggcgatacaggcgaaggcgagcacaccgggatgttgcacaggacgaggggagacgagccaatggctcggattcgccgggggatgctcgacggcggcggattgcggcggcggcaaccggcggcgggagaagggggaaacggcgatgaggtcacgaggggccgattcccggcggcgagagcatctacgcggctacgggaacccaccccttgcgccggattaggaggaatcgcatcgagggaggccggcgacgagtggcgcttctgagctcgggcggtgagcacacggcgagcgacggcagcagtcggggcggcgccggctagct

SEQ ID NO: 39911 - DNA, 38186 bp, Oryza sativa
cgggagggaaaagggaaaaagggggagagaacccttgcctccttgccactttgggaaaaaggaggagggagagggggcgacgcggcagagggggggagctctgcctccgtcccttggaggcacgcgcggggagaggcggggccgagtcgatgacgacggcgatgacggcggggcggtttggagtggagcggcgacacgggcggcagacgcggggcaggcgcggcaggcgctgacggcggcggcgactggccggtcggccaccaaggcgcgcgcgcgcgcgggcggcgcggcgatttgggcggcatcggcgggaacggcagcgagagcgggagggagggctcggcgcggctcacggcagagcgggcagagagagagagagagagagccggggagggagggggagatgggcctagagggattcggcccatcgaacccgagggaggcaaaatagacttttgcggaggaatttgatttgggaaggatttggattcgggattgaacttgacgatagatcggggatttgagatctgagatggcacggacactagacaacaagcaaagaaacggatttcgcaaataggatttttaagagatagttttcccgctaggcgccacgacggaacgggcgctacagggcgcaagcggagaggcagccttaagcctaaaaaaaataatttagggaccctgccccataatatacatcagtataaatattagttatggtccaataaaaattaggagctactgtacagtatacactacagtttttttaataaaagacttttaaatataatgtagtataatttgagattatattgtaattataatatgattatagtgtaacttatatgtagttgaataaaacgttcatgcaaccggttggctagcagcacgacatccacctcacatgttgcatgttcaacttgtacgtattgcacagattttttttcccctctccgcatgaatatcaaggtgatctgacaatcataaatctgaaggttttggttgaaaaattgtcgaacatttttaatttaattatcaattccggtaaaaatcatagtaaggtattcttgctcaaatcctagaaggtgtagccatctagtattttttttcttctgcgcatgttccccagctaattcaggggacgttgtgtttgtgtccgtggcggtgcataccacatgtgtctcgctgcccggggcaaatctaatgtggattaagcccccccccccccccgccccaatttcccaccctgttggatccctatggggaggagagaaggggaggaagaagatcaacccccctccaaaacctaactagacccaccataatgatttcattgccattttttaatattaaaaaaaagcatgctgcttttataataaataaaatatgcttctctagcttaatttagtcttgtccattgaccaaacgtcgcctcaagtcacctgcacgtcaagggaccaaacaaaccatttccgtgcatagatgaccgactctatagtagtgatatgagtcactatgtgcaactagtgaggttgccaatgcgcattcaaccatcaagattgtcaatattgctccctccaaaaaaagatcgtcaaagtagtatgttttcacaacaagaaaaaaaaacagatacacactaccatataagtgtttattctttttttaataaagaaaacagtggcagagttcactacttcttggtctaataatacatatgcaaattccacagtacgtaattggttgcttctcgacatgtaatggttcaacacctgtgaatggatcttgctccggcggtggctgttgccagatggatgttccaggacacatatatagttatgatggttattttgacgaagattacaatgatagcaaaatatggaggagcagcccttgcagctacatggcggtgatggaggataaggccttccaatttagcaccacttacctcaactccacggtattcaacgacacgtacaaagagggagttccagttgtgttggactgggtcataacattggatacatgtgagaaggctaaaagcaaaaccacttcctacgcttgtgttagtacaaacagcatctgcaatgatgatccgagtggaggttaccgttgtaattgttcacatggatatgaaggaaacccgtatattaaagatggttgtgaaggtaccatagttactttttcgttattcttcttccttgatatgacaatttcaatcaaacttgcaatggttgcttgatttcagatatcaatgagtgcctcgacaatgttacttatccttgtccggggatatgcaataatacaatggggagtttcacttgctcatgccaccaaggaaactatatggagaatggcacttgcataccaaatcggaagtccggttttcttgcacttcctatagtaggttggttcccctcttccgtaatcactagaactaatgataacgccaaccatttgtgcacaccaatatgagaattgttaatatataaattttgcatgccttactagtcattacacatggctagctcatggatcttccataattccatatcttaggccaatcccaacccaacacactagacatagtttccataaactccacatcataaaaaaaactagtacaagacactgctctttcaatgcaaacaccattgtttcatacttagatttaatgctacttatctcatatgatgtcttggatgttgtgtaaaaaccatgcatgtctcatgcaagacctggtttccttttctttcctcatttattcacttgccacatcatctttcatcctaggtggtagcttatttaatgctatagacaccattctagtcattgggttgggactggccttactagtcattcacacaagcttttatgattgtgtaggcacaagtgttggacttgtcatcctagtgatcaccataacttgtgcatgcttaattcatgatagaagaaagctacagcacatcaaaaatcaatactttcgacggcatggtggcctgctactatatgaagagatgaaatctaaacaaggtcttgcattcaaaatcttctcggaagaagaattgcaacaggcgacaaacaaatttgatgaacatcaagttctaggccaaggaggcaatggaattgtttacaagggacatcttaaggacaacttggaagtagcagtaaaaagatgcatgacaattgatgagcaaaagaaaaaagagtttggcaaagaaatgctaattttatcccaaatcaaccacaaaaacattgttaaactattaggttgttgccttgaagtggaggtccctatattggtctatgaattcatcccaaatgacacactttaccatctcatccatggaaactataatggttggcacatccctctggttactcgcctacggattgcccatgagtctgctgaggcacttgcctacctccactcttgtgcttccccaccaatcctccatggtgacgtcaagtcgtcgaacatcctccttgatagcaacctctcagcaaaagtttcagattttggtgcatctatcctagctccaacagatgagacgcaatttgtcacactagttcaaggaacttgtggataccttgacccagagtacatgcaaacgtgccaattaacagataagagtgatgtatatagctttggagttgttcttctagaacttcttacacgcaagaagccgttcaatcttgatgcgcttgaaaatgagaaatgcctgtctatgaggtttctctctgcaatgaaggagaataagctcagtgatctattggatgatcaaatcaagaataatgagaatatggggtttcttgaagagattgccgagttagcaagacaatgcttggagatgtccggtgtagataggccatcaatgaaggaagtaagagataagcttgataggctgaggaaagtcatcgagcatccatggacacacgataacccagaagaattggagagcttgcttggtgagtcatcatgtgtggtcatctcagaggttgagagtacaggaaattttagcattgaaaggaaagttgtcaagggtttggaatcagggcgttaagcagtactctctctggtatagcttatgtccaatcctattgtgatttatcatagattccttgtagagccaaggaactcttactcatctatgtcaattatttgtgtaaagttgagatcttgtgaaggcaaggtaattgtatctgttagaatatcctcctggtatcactactcttggtagattgggattcaaaacatgtattaactttaagacagatcattcatctctcttgtagatgaaaaggaaagttatacaatagagtgtcaaatttaagaaattcttgccaaaggtaatagaagggattgcatatttgtgttggaacaaatgagtaattctttacatgagtataagagtgaatagaatgtgtgcaaaattatttgttgtatgaaaaaaaattggtgaagtttctctaataaaagaacttttagtcttatcaataattaaccgctctctctagctacaaagatgaattatggcttttctatatttatttcttttagataatatgcttctcctattgatgaacaactaatttctcattgattctttgtgtattaacaaaacaattaaataatgcatcctatcatttttctaaagaactataggctatggttttttaaacgctttgataacaccttggggacatttatagatatcactatatctttaattggataggcaacatcgcaatttcagaaatcattggctcatgaggtagatagaaaactcaccacaaggaaggaaagaaacttaaataattctaagttatacctttgaacggaaaagaggatcaataataaaaggaaattaacaagataagaagcctaacaatgatttgtctatgtatgtatgcacatttttctctagtctattatagttattaatgcattgatcataaacgaatatcttgttcttggaagcaaaacagtttaacacgtggcgaacactggaggggtcaaaaaaaattgaaaaatccccaaaacgcaggaatctgaccgaagactactaggtaagtatttgcattggtagaatgaattgtagattgtatagtttatataattgtattggttgttttggtctagtatctgaagttctgaactgaaaacggccagaaaatgtgaagggtggaataacatagtctgtgcttagaatttcagagttaaattatttataaccatgcctacatatcttttacaagtttatccagtcggtaattgttgtgccaacttcttgctcttttttaactgcttacttgccacatactccgtccgtctcataaaaatcaacctaatactggatgtaatagattcgtagtactatgatatatcacatccagtcctagatctttttcgtgggacggagggataatagcattccaaagaaagagaaacggatgcttctatggttgtttttcctcctgagtgacaagacgggttgtttgggcagccatgcacgcgaatgaagcaaccttcaaattcctctttaatttctaccactacagaacaaaaaggatttcaagatcaaatctggtactctctccgtgtcacggactcgcgttgggctagacatccatggtggattgtggcctgttaggcccaatatgctacatcaagtaattactacaaaaaggaaccaggcacaatgggaaggggatcaaagaatataagaactgaagcctattgcctggctgttccctccctcttgcttcttcccaaatcctactctatttcctctgatttcctgatctcctttctaccaacccaatctcctgctattccttgtctaaactcttctttctctctgttttgtatatgaatatttcagtggtttgatgctggttttgcttgtgcttacttgaggtgcttacttgaggttggcttgatctgtcaaaattgatgttggaacgtaacacaccgtcccgatataaatacagttgtaagtttccgtatttaatatttgactgttattcttatttaaaaaaattgtgattagtatttttattgttattagatgataaaacatgaataatactttatgtgtgactatttttttataattttttttaaataagacgtatgtcaaatgttaaataagaaaactcacatccgcacttaactatatttagatgcagccatgcaggtagtacattttttttgccgtactgctcccctcaggcaagagcattgaaatgtacaatgtgtcaacaattcgttagtcccctcaggctgtgttcttctccctgttttttcaacccacatctctcgttttccgcatgtatatttttcaaactgctaaacggtgtgatttataaaaaattttctatatgaaagatgttttaaaaaatcatattaatctatttttttaaaaaaaatagttagttagcacttaattaatcatgcaataatacgaattttattttgcgtgctaggaaacccctactcctgaacacagcctaaaacagagtaggatatgctgagtattgaacgtgcccaggtgcgctacttctatacacgatgtcgtgaaggcaaatagctgaagcctaaatgcatgaatggccgccaccaccaccgccaaccatgatgacgcagctagtggcggagctagaaatttaaccctttaaaatcggttactactagtttgtatttaaatggagtcatttctataattttttgaatttgtacatgaaagttaaaatttgtaggcagcggcggcgccggcgcccggccatcacgcgcaattgcctgggcaccatgcgtacagcaacacactgctccaatgcatatgcagcgtattactcgttaaccatatacttaggccatgtttaattcagcttaggattattttaatctggattattaggagtaagctgaaacaaatagatagcttattatgatatacttcctccgtttcacagtgtaagtcattctagcatttcccacattcatattgatgttaatgaatctatatagatatatatgtctagattcattaatatcaatatgaatttggaaaatgatagaatgacttacattgtgaaacggagggagtattattataatctataagccagattactataatctggtgagccactctaaaggtgcttttcttagattattgggtggcaaacaactaacaaacagataataatttagagaaacaaacagctagcagcttattctatgtcggcttattataattcagcttatagtaatctagttctataatctagattataataatcttaagctgaaacaaacataatcactttgtctcgtaagttctaatgaagattaattagatgaataatcagattatcagaaaacgagatagcaaggaccaaaccatcaagctgtagttataaaggccaaagcaatacaacctactagcaccgatgttcaagatgacactagctttaaaatctaaattatcagcgataatattaatcttgtctaggcttcaaaaaaatttaaagatctgccaccgtttgtagggatgtttttcaaaaacgaccccacagattgtgcatggatccgacacgcagccaaacgtttagcgtgtgtcaagcagaataggggattcaaggagatacaattgcaggattaccgtgctttggtagggaaattggaagcaaaagcggctggagggcgctgggggattgtgcttccagaggacctcgcgcccctgcttgaagtggcggcgctgcgtgcgcccgcgctttactgcctcctcgcatggtcccttcctccctctcactctctcgcacgggctgctcctgccgccgcctcggtcactctctctcccggcggcggcgcggacgaggccggcattggcgtgaggggaggagttctcttgggtttaggaacggcgacgagtgatgtgggtggtggcccaggtgggagtggcgctagttgggctggaatcgagacgctaggtaaggaaaaagtatacttggactcccttaactatcgtccgagtatgattcacaacctccaaccacaaaactaggtatatcgactcttccaagtatcaaaaccggtgcaaacaatgtctcttggtggttttggagatggttttggctgacgtagcgcccacgtggcagtcttgactgagtctttatcctacgtggcgcttacgtggcatcaaaataaaaataaaaataaaaaaatatgtgggacccatatgtcattcacacacacacacaaaaagtgggacccacatgtcatcctccctctctctcccttatctctctctccctcccttatctctctctccctcaagagcgacggcggtggcgatggccgatgggaacgaggcggaggggagcggtggcggtgggaagcggcggcggcggcggtcgcggtggcggtgggcgtaggctcgccgcctcgagaactccatccgcctgctctccccgacgctcgtccacgcgcgtcatctctggggccgccgccgctggccgcgtcgacctcgtcttctagttcttccgcttcgcctaccgccgcgccggcttcaaccccgagccgtccaccttcgccctcctcatcccgatcgtcgcctcccaccgcatgctcaaccacgcccgctgcctcctcctcgacaccatgccctccttctccattgcccccgaggaggccaccgtcgccacccttatcgccgcctacggcaaggccaacatcccgcaagaatccgttaagctcttccgatgcccccaccgccaccgccgcttccaaccgccgccaccgccgctccagccaagagaaaggccgggggagagagagagagataagggagagagaggggaggaagaaggaaaggagagggaggatgacatgtgggtcccacaatacttttcttttgtgtgaatgatatatggctcccacatatttttttgattttgtttttattctaataccacgtaagcaccacgtaggacaaaaactcggtcaagactgccatgtgggcgtcacgtcagcaaaaaccacctctaaaaccaccgtgggacattgtttgcaccggttttgataattggcggagtcaatatacccggttttgtggttggaggtcatgaatcatactcgagcgatagttaagggagtcaaagtatactttttccgtagactaattttctatgggaataagttcatatgaggtcccttaacttgtcaacgaatctgattttcattcttcaaccggaaaaccagatacaacgggtctctcaactgtcaaaaccagcacaaaataagacccaagacgatttggatggcagtttcagctgacgtggcccttgcgtggctaatttgactcggttttcatctgacgtggcatataaagcaaaatttaacaatttaaaaaataaaaaaatgttggacctcatgtcggtcaaataataagattaaataatagtgggaccacatgacagtgggtcccatttccccacctaatcccctcctttctctatctcctccccatcttctcatttgtgagacggctcgccgccagtgccgagtcactactgcccaagaacccccgaccttgacctcaatccgtcgcgggcggatctggcagcccctcgccggctgttgatttcgccgcccgatctagaggacgagcacaccaccgccaacttcatcacgcagcccaggtcttcaccaattccatcgccacctgcagccatgtccacctccggctcccttagcgtggcccgctggcacgcccgcgacagggctcccccttctctacattgctccgacggcttctgcgacctccgcctcccctaacgatctcagccccggcctcgcctccctcatcgacacccttgcgtcggattggaccgacgcttccgccgatgccaccgctgctactcactgacgtctccgcgcgcacctgctcgcgctggcaacgggaagcgcaagaagctgtcaggctgcgtcagtcgcatccgtgcccttaataccaccgtcgccgccgtcgaactccatctccgtctcgagcgtggcggcgatggagggcggcgcgttcttggcgcgcgcggcggcgatggcactggagttgtcgtcctcgtcggcggagcctgcggtcggggcgctccgactcctgcagctcctgggccagcagcgtgagaagccacggtcaccaccacggaggccgcggaggacgacgacccgttggagaggaaggcggcggcgagggtgtcaccgctgtcggttcactccacctgccgctagcctcgctcgccgaggttgttgcccgcctctccccaaaagagatgaaacgtgaggataaggaagaaagagagggaagagggaagaaaggagtgaggatgacatgtggggcccacgtgggccccactatctttaattattttgtgtgtggagctgacgtgtgggcccgtagttttttatttttctgatcgaattgccacgtgggacaaagatctagtcaaactaaccacgtaggtgccacgtcagccaaaagcgctttccaaaccaccgagggatctcgtttgcacctgttttgacaattcagggccagttgtatctggtttttgggtttaaggttgaaaatcggattaagtgtaaagttaagggaccaggttgaacttattcctttcctataggagcacaagttggccaaaagggccgaggcacgacggtccgacccatgggacggggttttggcttggcccaacctttggattgtgcttggccctttgcctcggctcgatgggttggcccggcatggcccaattcaacgatcagagagttaaatagatgaggaagtcaaaacagacttattctcgcgatgtaagtcacagcccaaaaagatgagggatgcaaaaaatagacttattaaggccatataagaggcagaccaaagagatgggggaggaggcaaaatagactttttttctaaggagaagcacgatgcgctttcgtgcctttgggccggcccggcacggcccgagtcttattgggtcgtacctttgccgatggtgcaacaagtgggtaggtccggggcagcccaacgtgtaggttaggccgtgtaagcccgactaatctcggcccaggcccaggcctagcggcccatttggcatatgtagagcacacgcttgccatctgtaataactgtattgtcgaggagcttgttattgcgcgcctgggcgcatgccccaggtaccgcgcgacgtaccccctctagtccctctagtgtgtagtctaatataccatacgtatgtatttacatataaattttgtagtatacacttccggcacctataaaactatgtctttgtgtagtagtgtttctagcaatatttttctttttatgcacaaatctcgaggcaatccgatagctataactctgaaagttttggaagtatttgctgaagttttctagcaatttcgttgacattttagtcctatggttcgatttttttttagcacaccggagatggcctgagctagctgatggctacgggacctcttggaagctagctagctctcatctcaacaaccggcattgacttggtattataagtctccctagtccctaggaacgaagagttaatccaagccaaatcgagggagatttgttgagcggtagagctgatcggctaattactgagaagcgtagtgcccgagaggcaactaggcaagctagctgaaactccgtcctttcgatgatgcgcgatgcacctgttcctatgctgcaagtcttgctacccgcttgatcgatcggttcgcgttttcacggacgtgcgtagcgacggaaattagcggaaacgaccctgctttatgtgcgtaaatacaccacgtcgtcgtcaacgtccacgaatgggctcggctgggaccgagtctgggcgtctggccacgaatagttctgataatgcggtgtcccatgtgatgtgattgtgagcgacctcgcggtctatcggcattggtcaggtactctcaatcgtcaacgtcgatatagctagcaaggggcagcgtatgtctctatttaacacgcagcccagagaattcagaacatgtacagtacaaaccacacagacaacgaaatggctaagcttcttctctccgctcttttgatctgcatttcagccatctgggtggtagccgcggccgacgtcccggcaggacgccgaggctgccagacgaggtgcggcaacctcgacatcccgttcccgtttggcatcggcgatcagtgcgcgatccacggtggtttcggcctcgactgcaagaacgacagcggcacttataggacattcattgggccgttcgaggtgactaagatctctgtgccggacgccaaagcctggatgaagatgggaatctcttggcagtgctatgacccggtcacaaaacagatgaatgattcgatggttgggcagaacttcaccaacacgccctatcgattctcatacgaggataacaagattttcgtcatcgggtgcaatacaatggcctacatgagaggtgtttcggtaagtatttcctttatttatgtttatgctttcaacctttttgacgtcaaaattggaaattttaacaaatacttgtatctattttgcttatgttaagtgactatgcttccagatcgttacataatttcaatctcaattcgtagatcacaagataagctgattttttacactaagctaattaattaacatctgtgacttaattatgcagtatgtcataggttgcttatccacatgctcggatgaaccaacaaatggttcttgctctggcgctggctgttgttcggtggatgtcccaccagacctaggctatgtcgaggcttatttcaataaagattataacacctctcaaatctggaactacagcaggtgcggctacctggtagtaatggaaaaggctgctttcaggtatagcaccacttacattccctcaataaacttctggaatgactacaacgggactgttccggctgtgatggactgggtaatcagaagggagacatgcgaggaagcgaaaagggacatgagttcatatgcatgtgttagcgacaatagcgactgccataattcaacgaatgggcatggttatctctgcaagtgctccaaggggttcgacggcaatccttacatcaaggatggatgcaaaggtctagctacttctatcctccacctcctaaatgatcgatttgtgtatatatacacttaaaacttttactcaataacatatacatttttgttttgtttcagatatcaacgaatgtcttgataatactacttatccatgcgctggactttgtcaaaatacgatggggggttacgactgttcatgccatcaaggacaacataaggtggaggatgtctgtgttccagatcagaagaatcagaagtcctcttgggagatgcctgttgtaggtatgtacgtctagcaagattaatatttttgctaagatttacatattgattatcttattagtgcattagttgtaatattgagattcacttacttttaaatgttaagtggtcatctgttcgtcctagtattgttgttggctaacaaattatattcggcaactaggtgcaagtgttgggtttgtcatacttgttatcatagcaacttgttcgtacctgatccacgagagaagaaagctgcaacacatcaagcagaaatactttaagttacacggtggtctactgctgtttcaagagatgaattcaaatgaaaggaaatcatttacaattttctcagaagcagagttgcagcatgctacaaacaagtttgacaaaaaccaaattcttggccatggaggtcatggcactgtttacaagggacttctcaaggacaacactgaaatagctgtcaagaaatgcatgacaatggatgagcaacacaagaaagaattcggtaaagaaatgctaatcctatcccaaataaaccacataaacattgttaaactactgggatgttgccttgaagtacaagttcctatgctagtgtacgagttcatcccaaatggaacactatgtaatctcatccatggcaaccatggccagaacatttctccagttactcgtctgcggatcgcccatgagtccgctgaggcactagcctacctccactcctacgcttcaccacccatcatccatggtgatgtcaagtcctccaacatcctcctcgatgttaacttcatggcaaaagtctccgactttggtgcttccatcttagctccaataaacaagtcacaacttgtcacgctagtccaagggacttggggttatcttgatccagagtatatgcaaacatgtgagttaacagataagagtgacgtttacagctttggatcttatagaactgctcacaaggaagaacgttttcaaccttgatgctcctgaaaatgagaaaagtttgtcaatgaggtttctctctgctatgaaggagaacaaacttgagaatatattagacgatcaaattagcaataacgagaatatggagtttcttgaagaagttgcggatttagcaaagcaatgcttggcaatgtgtggtgaggatagaccatccatgaaggaagttgcggagaagctcgataggttgattaaggtaatgcaacacccatggacgcaacaaaatcctgaagaattggagagcttgcttggagaatcttcttacattataagctcaggagccttgagtacaagaaatttcagcatcgagaagaaagttgtcaaggacctagcatcagggcgttaagctggaatctctttgccacccagcatacatcatatcaccatgtcgtaccgcgtcgtattgtatcatagttttcacttaccctagaaattcagactcagttatgttcattattaattattttttgtgtaaaaataaaaaaatattgtttgtgtacacctttagtctttatgggactgtgtttcatcatatatgagaataagaagcaatcatacgaagtcaagttaatgttctatcactgtactattttccccaccgatttatgtgattctgtctaccgtgtggtaattgcctatggtacacttggtttcagcattttcttgaccaaaccttacaagatatgctgacccatgcatcttgcaacccatcctaaccaacttctaaacccaaaaaatgttgtctcatcgtactcggttgcgcattgacaaaagctgcgtttggtccggacattttcagcaattcgatatgtaaaaattaagttgtcaatgctgtgttttaattataaaagctgtgtttgaagcggatgaaaataaaaattaagttgacacgcacaaaacgagaaagtcattaactaagttttaattattacaaacttgataaatatatttgatattttaaagtaacttctaaatagaaaggcacataatacagtaaaatctgaatcttaaccgaaaataatagagctacagctcgcaatggaaaatgtacctttgtagttttgcacgcaacggagcatcacgcggaattcaccgttcgaagttacaagaccctgtgggctgtgaaacagtcaagtcttccatgatactgagcggagcgaagagaaccagaactgtcattagagaagaccgaccctgtgaagccccccaattgtacccaagacccataaacatcgctcgccaggtcgccgagaaattgtgtgatatggacgaggccaggttttctcaggtgaacgcagcctgtttttactcaatttcttggattaaagcagggccaatgtgatgtgaacggtggccgattggtacagttagactatcagccacacaaatttaacggatcaagtttattcacttatcaatgctgctatcacgcatgactgccaagttacgtcagtcgttcgaagtcttccgttgctatgtgtagttaatagagctggagatcgattacgatggaggaaaaacattttgaaaaaaaaaaaggtatatgcactctttcttttcgacgtaaagacccgggagtcagtcgtcgtccataattcttgggatatacttcatttatgatcaaatatacactttctgagatcttattccctctgccctattttatgtcctattttaagtacaacgataagttttttttgcctaactttgatcgttcgtattatttgaaatttttttataattagtatttttgttgttatgagatgataaaacatgaagaatactttactcattactgacttatgtttttaaatttttttaaaagtttttttaaataagacgaacgattaaaattgggcatatctggttttgcggttcgaggacgttttttatcccgataataagttgagggaccttcggtgtactttttcctttcccatgggagcacactctctagctataataactggattgtcgacgtggcactcatttggattaaaaacccacacaaactgtcacaaaccaagaaagttactgcaccagttagttcgaatttcaagttgttgttctaaatcatatccatccgtcgcaatttacttatagaaaaatgagtaaagtacacggccggtccttaaagttggagcgatgtgtcacttaggtccataatctaggaaaatcgtcatttgggtccgtgatcttgtttaagtgaatcatttaggtccaaagcgcctttgaccaggttgactggcttacgtggccgtccacggtgatagcatatttgcattttagccccccgcatcttggctctcccatatacgatccaaccattctcccccaaatcctcctcggctcctcctgtgtgatttctagggttagcgattgcaacggcgattgggtggcggtgtagatgtggcggcggccgcgaggacgacaactacgatgagggaggcgcgtacggcggcaacggtaagggagaacaagcgttcgtcgtcctcatggtgtcatcagcggccgcgtcggcctccacctccgcgacggtgtctagctcggtccccgtggggctggcggctaagaacctgaagtcgatgcacaagggcgcgtaggacctcaacctggcgttcccgcatcaccacggccgcgccctgcagtcgccggagttcacagcgttcccgagcttggagagtagcaacatgtgcaaccccggaggcaacatggcggtggcgaacggcgttggtggcaggggcagcgtgggtgcgtgttctcggcgatggagttgctgaggagcattggctgctacgttcctctgcctcagatggggccgctagggatgccggcggagtatgcagccgtggggttccatctcggcgagttccgcatgccgccaccgccacagcaggagcaacaacaagctcagaccgtgctcggtttctcccaggacacgcacaacgcgggtgcaggcgacggctccggggtgttcggcgggtgcagctagtggctcatgcatgcacgcgtggtggtcagcaactgacaacatgtggagatagagaaatgagatagagacaagggggagccaagatgggaggggggctaaaatgcaaacatgctgccaccgtggacggtcacgtaagccagtcaatccaatcaaaggcgctttggacctaaatgattcacttaaacaagaccgcggacccgaatgacgattttcctagatcatggacctaagtgacacctcgttccaactttaaggaccggccgtgtactttgctctagaaaaatagaaaaaaaagtttgggatccggagttaagggcttgtttaagggcttaagtttagaaaaatatatatatcaacgggatggctagacagaggattaagggcttgtttagttagaaaaaaaatttgccctacatgtcacatcagatatacggacagacatttaaagtattaaacgtaatctaataacaaaataaattatagattccaccaggaaactgcgagacgaatttgttaagcctaattattctgtcattagtaatatttaatatagtaccatattgtcaaattatagtgcaattaggcttgaaagattcgtctcgcaatctcctggcgaactgtgtaattattttttttttacatttaatactctataaatgtatccaaatattcgatataacagcgtgaaaatttttttttaaactaatcaggccctaatacgagcaagacaaaaaatagtctttttagctggtgcaacacttgtctactccaacctccaacttgttccgggggaatcacacgtctcactgtctcagtcacacaagacttggactcattcatcagtctccacaatcgtggaccgactgctactgtacctcttggaagctactccagctagctagttgctctgatatgctctgagctcaacaacagcggcattgacttggcaagtctccctgggaccctagagttaatccagccaattagagcgacatatactaagctgaccggctgactgagtaaagcgtgcatgggcgagggcgagtatttcgttgatggaccatcctgaatcctttagacgccacgtattataaaatatagcaatcgggataaaagacatattttagtagtatgaaattgaacaagaacctatctattatattattaaaggcatagaaaaatgagtctccacgttcgctctcatggtctagaaattctcacattaatcaaagaaaaagaaaaaacagtgtccatatataaatataatttagaaatagctgaaattcagaattaaaaaataatgaatattagaagaggatactagagtccatatagaaataaaatttagaaatagttgaaattcggaatttaaaaataaagaatattagaataggagactagagtccatatagaaatacaattaggaaataactgaaattcggaataaaaaataaggaatattagaagtagagtatagagttcatatagaaatacaattaggaaataatagaaattcggaattaaaaataaggaatattagaagtagagtatagaatccatatagaaatacaattaagaaaaaaaaagaaattcggaattaaaaaataaggaatattagaagtagagtatagagtccatataggaatttaaaactaactaaaatttgaaataaacataataaaattaaagtagagtttagagtccgtataaaaatataatttacaaataactaaaatttgaaattaagaaaaacatgggaagaagagtttaaagttaatataggaatacaatttagaagtaactgaaattcaaaattcaaaattaaagaatattaaaagatgagtatagagtccacatagaaatacaattagaaataataaaaaatcagaaataaaaataaataatattggaagaagagcctagagtctatatatagaaatacaatttacagaaaatttaaaattaaaaaaaagaaatattaatagacgagtctagagtcaatgtaggaatatatataatttacaaataattaaaatttgatattaaaaataattaagaactaacacatatataaaatactatatgaatattacacattaacattagtagtttcgtaaagttattgcaaaatttaaaattatgttattattttaatatatttgaataatataataagaaaatatatatgctattatatgagagaaaatataatgatactatcatgctagtttagatttatagaattaaattatatcaaatctaatactagtttaatatattttagaatgtttgcctttaggggttgtatttttctcctgctatatttaatgaaaaagcgtaatctcgtgtggtttctgttaaaaaaatatattttagaatggagagtacatgacaacagactttaattcctcgtgcgtgtgcctagctataaggaattatgtcatttaaattttttttaaagaagtagcaaaaggatatgccatagtataaaaggtgataggtggaaggataaaataagacaaaagttgataggtaaagaataaactattacacaagttgatagatgggaaaataaaatactatcttaagattacaaaatcccaaaaaaataaaagggtaaaattatttatatacatggacgaaagtatcatatcgggaatgatcaataatcaaccaccagcttttattaatcacatactgcagggcaagctgcccagggacagtaaagcggatatctctatttaacacacaccgcgtcacgccccagcaaagcacacactctcctgtctcctccagtctccacacacacacgcaatgactaagcctcttccctccaccattcttctgatctgcgtttcagccatcgggatggtagccgccgacgtccccgtggctggacacccaggctgccagacgaggtgcggggacgtcgacatcccgttccccttcggcatcggcgatcactgcgcaatccaccatggcttcaacatcatctgcaagcctgtcaacggcaccaagaggcctttcaaggggtcgtttgaggtgacgaaaatctctgtgcgcgatgccaaagcctggatgaagatgcggatctcttggtagtgctatgactcggcctcgagcaaaatgaaggaatgggtggatttccaaaacttcacctacatgcccttcaggttctcatacgaggataacaagattttcatcatcggttgcaatacaatggcctacatgagaggtgtttccgtaagtatctcctcatatttatgctttgacgacattttgcttatattaatatactaggcgctcagtactgatcgttacataatctcatttaatttaacgtcatagatacaaattaacatctgtgacttatgcagtatgtcataggttgcttgtccacatgctccgatcaaccaaaaaatggttcttgctctggcgctggctgttgttcggtggatgtcccgccagacctgggttatcttgaggcttacttcaataaagactataactcctcagaaatcagctacagcagttgtggctacgtggtagtgatggaaaaggctgtgtaagtgagtggctggacttctagttttgaactatagcaccacttacattccctcaacaaacttctgggatgactacaacgggactgttccggccgtgatggactggataattacatgggagacatgcgaggaagcgaaaacgaacatgagttcatatgcttgtgttagcaacaatagcgaatgcctcaattcaacgaatgggagaggttatcgctgcaagtgctccaaggggttcgatggcaatccttacgtcaaggacggtcttcttggatgcagaggtctctctgtctctctctctctctccctctctctattcagcaaagtatacaataagaacttatattcacgaaagtttgctttgtttcagatatcaatgaatgtcttgataacactacttatccatgcgctggaatttgtgaaaatacaatcgggagttacaaatgttcttgccctcaaggacaaaatgagctggctcggggtgtctgtgttccagatcagaagattcagaagtcccaagcttgggtgatgcctgttgtaggtacgtactacaactagcagtagatattctttgctaatatatatatatttacatattgattatcttattagtgcattggtacgtactacaacgcttgcttttctaagtcaagtcgtcgtttgtcctagtattgttattggctgacaaatttatattcggcaaccaggggcaagtgttggatttgtcatacttgtgatcatggcaacttgttcgtacttgatccgcgagagaagaaagctgcaacacatcaagcagaaatattttaagctacacggtggtctactgctgtttcaagagatgaattcaaatgaaaggaaatcatttacaattttctcagaagcagagttgcagcatgctacaaacaagtttgacaaaaaccaaattcttggccatggtggtcatggcactgtttacaagggacttctcaaggacaacactaaaatagctgtcaagaaatgcatgacaatggatgagcaacacaagaaagaatttggtaaagaaatgctaatcctatcctaaataaaccacataaacattgttaaactattaggatgttgccttgaagtacaagttcctatgctagtatatgaatttatcccaaatggaacgctatccaatctcatccatggcaaccatggccaacacatttctctagttactcgtctacggatcgcccatgaatcagctgaggcactagcctacctccactcctacgcttcaccacccatcatccatggtgatgtcaagtcctccaacatcctcctcgatgttaacttcatggcaaaagtctccgactttggtgcttccatcttagctccactagacaagtcacagcttgtcacgctagtccaagggacttggggttaccttgatccagagtatatgcaaacatgtgaattaacagataagagtgacgtttacagctttggagttgttcttctagaactgctcacaaggaagaacgttttcaaccttgatgctcctggaaatgagaaaagtttgtcaatgaggtttctctcagctatgaaggagaacaagcttgagaatatattggacgatcaaattagcaatgaagagaacatggagtttctcgaagaagttgtagatttagcaaagcaatgcttggcaatgtgtggtgaggatagaccatccatgaagaaagttgcggagaagctcgataggctggttaaggtaatgcaacacccatggacgcaacaaaatcctgaagagttggagagcttgcttggagaatcttcttacattataagctcaggagcctcgagtacaggaaatttcagcatcgagaagaaagttgtcaaggacctagcatcagggcgttaagctggaatctctttgctacccagcatacatcatatcaccatatcataccgcgtcatattgtatcatagttttcacttaccctagaaattcagactcagttatgttcattattaaaaaaattttgtgtaaaaataaaaaaatattgtttgtgtacacctttagtctttatgggactatgtttcatcatatatgagaataagaagcaaatcatacgaagtcaagttaattttctatcgctgtactattttccccactgatttatatgtgattctgtctaccgtgtggtaattgcctatggtacacttggtttcagcattttcttgaccaaaccttgcaagatatgctgacccatgcatcttgcaacctatcctaaccaacttctaaacccaaaaaatgttgtctcatcgtactcggttgcgcattgacaaaagctgcgtttggtccggacatttttcagcaattccatctctaaaaattaagttgtcaatgctgtgttttaattataaaagctgtgtttgaagcggatgaaaataaaaattaagttgacacgcacgaaacgagaaagtcattaactaagttttaattattacaaacttgataaatatatttgatattttaaagtaccttctaaacagaaaggcagagaatacaccgtttagtaactttagtatgcaatcgaagtaaaatctgaatcttaaccgaaaataatagagctaaagctcgcaatggaaaatgtacatttgtagtcttgcacgcaacagagcatcacgcggaattcaccgttcgaagtcacaggaccctgtgggctgtgaaacagtcgagtcttccatgatactgagcggagcgaagagaaccagaactgtcactagaaaagaccgaccttgtgacagttctggttgccgagaaattgtgtgatatggacgaggccaggttttctcaggtgaacgcggcctgtttttactcaaattttttcttggattaaagcagggccattgtgatgtgaacagtggccgattggtacagttagactatcggccacacaaattgaacggatcaagtttattcacttatcaggtcgctgtaaatttccttgtactgttgtacacactgctgagaccagtagctaggctagctcacagtagttcgcctgcggaggtttttccctatgtgccattaaaaaagatggagcatgtctatctaccaataaaaagttcgagcctccctctatgtcatcgtcgaactttattacgccctccacaccattccgtcgctattctgttttggtttaactgtttggcagctctgacatgtaggccgggcggaaaaaaatgtctctattgccctttcttcttttgagtgcgagagagagagagagagagaggggggggggggggcggttgagtgcggcggcgcggcggcagcctggaggaggacagggaggcatacatgcgtctctcagtggtgtcgtcgtcggagaggggtggtggtggtcgattcctccggtttcttcctctcactccttccccctttctcccacgcgcgagcgcacacaagcagcggcagccagcgcgcggtggcgcggcgacggccgggcacggcggcgcctggtgcttggcgcggcggcacggttgcagcagcgtgggtcaaggtgagggagggcgatgcgggtccgacggccgtggtggcccttcggcaaaatggaggaggagacggccggggagcaccgtcgacggagcgccaggcaggaggcggtctggcgccggatggggaggcagccggcggtgtcgctgcctcggctcggtggacggcggcgccggtggaagagaaggctgtcgtgcagggcgacgtggccgtggaggtggagctcgccgcggagtcggcctggccgtgcgcagcggcagcactcacgcgggccgatttggctgcgggcgcggtggaggacaggcgcggcgctggcgatcgagcgggcggtggcgatgttcgcgctcgccgcggagtcggcgcgggcggcagcggtggaggacaggcgtggcgcggacgggatccggcgcgcatcgctcagctcatcggccctggcgtcgagccgcttgagctggccctcaagctccagctctcctccagtagcgcggcgagctccccgtgggtggcgccgacctcgccgtcgatcttgcggtcgacggcctcgagcagcatccggaaggcgcgggcaagagacgcctcgacgtcggcgacgagggcgtcgtacccggccatcgcggcctggtcgatcggctgcgccacgcgccaggtgaggtcgccaagcaaccccatgggcaacaaactcatttggctgcgccgttacccactgttagaaaaaaaacagatggaatgatgtggagggcgcgataaagttcgacgatggcatagagggagacttgaactttttagtgacacagaggcaggcatcattttttttttaatagcacataggtaaagacctctcgctacagtggcaggatagaattaacatggatgacaacaggggagatgaagcggttgtcactcaatgctgctatcacgcatggcctacgcgcttaagtcacgtcagtcgttcgaagtcttccgttgttatgtgtagttagtagagctggaggatcgattacgatggaggaaaaacattttgaaaaataaaaatatatgcactctttcttttcgacgtgaagacccgggagtaagtcgtcgtccataattcttggaatatatttatgatcaaatatacatttttcgagatctttattactccttctgtctcattttaagttcatgtgtataataatgagtttttttttgcccaattttgatcatctgtcttatttaaaatttttttataattagtaattttgttattatgagatgataaaataggaataatactttactcgtaacttatgtttttaattttttttttcaaaagttttttttaaataagacgaacgattaaaattggacgcagaaaattatacttacacttaaaatgggacttagtctagaatctcacgagcgagacaagtttatccccctctgaattctttttccatcgccacaagcatatcctacccatcatatttaaggaggccgctgccgaaattcccaagcacaccaaccaaaacgcacaacaaaccggctacctaaggagtacggacaagcaagtgcagcatatggagcgtcatcagcttcttcttcttcccggatgccttcttctctaccttggcgccatcgctacgcttgccgcggccgacgtcgcaattccggccggtggccagcctccgggctgccggacaaggtgcggcgacgtcgacatcccctaccctttcggcatcatcgacccagacaggccagactgcgcctacagcaggggcttccagctgaactgcacgtccgtgaacggcgccgcgaggcctatgtttcacaatatcgaggtgaccaacatctccgtgcccaacggaaaagcatggatgaagacgaacatatcctcccagtgcttcgacccagaaacaaacagaaccttgtacgatgacatatggaacagtttcagatattcaccttactggctgtcaaacgaggacaacaaacttatcgttgttggttgcaactcactagcttacatgcgcagtacctcggtaagtaatttttgcatattttatacattatcagtttcttaaggaataggaaaggttgatattctttttaatcgcaaatcatgacctcacaaccccaattccgaaaacagagcatctttacctcattcaagctagcccactgtacttggtgtttctcagccactcaaaagttatagaatccataaaataaagtagagttaattacactttgggctaggaatttttaccaaagtttcactttggacgagggataaagttatcttatcactttggactagataaatttacaaaagttttaaattggaccacccttcttctccatcaatcttccctccttttctctattaagcagccgcgctatggaatctgagggatgatcaagcaaagtaccaggattccttctctctctgctctgttccgagcttgaggaaccagcaaaatcaagactggtggtagctggctgctgtagctgtcgcttgcaagctcaatacagtgacttgttctaagctcacatgataaattaagggaaaaatggtagaaatcaagcagctaaatcaatgagtaaagaaatcaaggtcaggtggaatattgattggtttattgtgttgcgggtaagctcgctaatgaaatcaaggagtggcaaacaaaaaagtggtccaatgtgcaatagaaggtaagaaaacctggaccaaagtgaaaacgttagatataacctagtccaaaataaaacacaggcaataataaccgggccaaagtgcaattcactcaactaggccaaagtgcaattcactcaataaactatttgtcagaagttgagaaagccaacttctatagattctagttcactagttgcatctcataatttctgacttctcatgtaaggtcttatactaattcttaatataatcattatgttatattgatgggtcatttctaattgtcgatgcatgttttttttttgactggaactaaattggatatttatgtgttttttgacgtttgattcaaaaaatgtgcaatcatttatccttgtttcaaagggtaagggtaatgtaggtaaaattaggattcaatttttttctgtaaaaaactttgcatatcttaatttttcaaatgagacatgtttgacatgtgaaaactagttcgacttgtcataacatacatataagtcgaaattccccctcccaaaaaaaataaaaagaacttgattgggtggattttgtgtgcggccaactatatcactacagggcatgttcggctgcaaggtgcagctgccgaacaggcccacaaccaaagagggcttagagcccatttccatatgaatcacaaatgaactctatgttgaagacactaatcctagttctactatgttaagaaagctatctgttttgcagcacttgttttaacaaatataattgcaaactctcatggggtcgtgctgttatttgcagtttataacccgccaatccatgcagtacgtaatcggttgctcatcaacatgcgacaacgtagaccttaagaatggctcatgctctggtgctggctgctgccaggcagatatcccgaaaggcatacggtattaccaaggttatttcaatgcaaactacaacaccactgcaatatggaggagcagcccttgcaactacatggtagtcatggaaacttcagcattcaactttagtaccacttatgtcgactccacagtattcagtgatacgtacaaggggatggttcccactgtcttggattggacagttgaatggaaaaaatgcgaggaagcaaaagagaacagaacttcctacgcttgtgttagtagcaacagttactgtgtcgatgccaccaatggtcgcggttatcgttgcaagtgctctgatggatacaagggcaacccatacatcacggatggatgcgaaggtccctttccggccattttgattcctctacccctgcaaattaagagatgtagaaaaagtattatatttttaagtctttttttggcagatatcgacgagtgccaagatgctcatccatgcacgggaatttgcataaatacgcaggggagctacacatgtacatgtcaacgaggaaaacatctgattgacggtgtttgcaagcagagttcctcttcttggattatacctgtcataggtccgttacactcttcagcgtctcaaaaaaaaaggagaaattgtacattgacaccaatcttgaacataatagcgcattacagtaaaaccaatctgaacatatagtaggaatcaatcatattattcatgttcattaaaatttaaggttgaaaaccccggaaatgctttcaaatcatcattttggagtaacatcactttggaaaccatgcaggtggaagtattggagttgtcacccttgtgactattgtgacgtgtgcatatctcatccaagaaagaaataagctacacagcataaaacagaagtactttcgacagcatggaggtcgactgctatttgaggagatgaagggtactgcatttaaaatctttacggaagaagaattgcagaaagccactaataatttcgatgaaaagaaaatcctaggtcatggaggacatggcaccgtttacaagggatttctaaacggcaacactgaagtagcaatcaaaagatgcaagacaatcgatgagcaacaaaagaaagaatttggtaaagaaatggtaatcttatcccaagtcaaccacaaaaatattgtcaaactattaggttgttgccttgaagtggaagtcccaatattggtgtatgagtttatcgcaaatggcacactgttccatctcattcatgatggccacggcaggcacatctctatatccacgcgtttacagattgctcaccagtctgctgaagcattggcctaccttcactcatgggcatcgcctccaatcctccacggggacgtcaagtcatccaacattctccttgatggtgacttcacagcgaaggtctctgactttggagcctccatcttatcgccaaccgatgatgcacagttcgtcacgtttgtgcagggaactcgtgggtaccttgacccagagtacatgcaaacatggaaattaacggataagagtgatgtatacagttttggggttgttgtcctagagctactcacgagaaagaaaccattaaattttgacgggctagaggatgagaaaagcctatctgtgaggttcctttctgctgtcaaggagaacaagcttgaggaaatcttggatgatcaaattaagagcgaggagaatatggagattcttgaagagattgctgagttggccagacgatgcttggaaatgtgtggtgagaataggccatcaatgaaggaagttgcagaaaagcttgatagcttgagaaaggttttgcaccatccttgggcactgcacaatcttgaagaggcggagagcttactaggagagtcatcaattgttagctcggaggttgtcagtacgggaaatttcagcattgacaagaaatctttaataggcctagaatcaggaagataatcgctaataaccttgttgtatatcatatcccaggaaattatataggtatactccaaaagtattacatgtataggtaatcgtcatcatatatggaatgattcatacatgttttatatgtgtagctcaaggttgcatcattgttaagatccaaaggtgaggttgttgtttcaattgctattgtagctttacctttcaaaaatctatgtacaatagtaattgatttgatatttgacacacattttctttttatagtttgatcaattctcatactgctaacaaatcacgacaacatgtacttttcaagaggttaggatccatatgctttgcaagtttatttattctcagaaatagcttatcagtaaccattcacctgcacatatattgaacaccaaggcctgccgacatactataattagatctcctcataagaaactaccgttcattataatcttgcatactccaataatcaagagagtggcataatatactttgcttgtaagccaaccgcttaaacattctattacccataggtcaatctccatcagaccaattgaaaaaaaaatagttttattacccataggtcaatctccatcagaccaattgaaccaaagaaaaaaaatagagcaactatgtgtatgtaaattgtttcatagcaaaacaacattacctcacaatggcatcagtcctacagtggctggtaatggcatccgtattgggagcatatactcctgaaatcaaactatttgtcccacccttccttgagaatcgttgtctgctcctgtaagaagtatacataaatataaatcagcatcttaaattatataaaaaaaaggattaatctgaaggcagtttctgaacaaaccgattgttatcctactccaattaacatagactttttagagaaatattaaaacgcttaatttaaaccagaactataaatctatactctaaccaacaactaaaaaaagggttggtactccaaccagtatgcagttatgcacacgagggttgggatgggagcattggacctcgggatgctgcatcaggcggtggcggcaggagattaccggaggacgggatctaggcgttcttccgcgcctgcttgatgcggtggtggcggcgccgcccttcctaccgccggtccgcccgtctctcggccgccgcatcgattgatgatgaggggaagaaacctgcggctgcttgggcttgcggtgcgaggctgcgaggtgaaaaagaggccagtgttgatgggctccaaaattcagattggtggcactggtagcccaataggacttttgtttcggtaattgggttttacatggttctgtagttcgaattgggcctcgtggtggataacggataactggcccgtacatcagcagagctgttgatgacgaggcaaaaagtccagtttgagtccctcagatataggtcgaatctaaagtgcatccctcaaccgtaagaccgggtacaaagactccttcaactattaaaactgggacaaaatgactcctaagatagtattgaaggtggttttcgctgacgtggcatccacgtggcagcttagtcactaaataaactaaaaaataaatgtggggcccacatgtcggtgtcctttctttttctcccctctcttttttttcgaccacgtcagcaatacaaccctccacaacaacggtgccctgcactcgctcgatccgccttctcccccttcttcagcatcggtagaggcggtggtgccgtgcactactacaagaaggatttctccgtgcagagcttttgtccatctgtagccaagtgtctgcacccaaccgcacccgtgcggttgggttaagtggaccgcacgggataattgattatcccatgcggtcaaattataccgcccgcacgcaaccaaaaaaaaaagccaaacaaaaaatagaaaaaaatcaaaaaaaaaacctaaccttaaccctagaaacacccgtcgctgcacccggccgccgcccgagctcgcggatccgggcggggggcggtctcccgccgccgagcctgccactcctgtcgcaccgaaggagaaggagaaggagaaggagaaggcgcgagagagaggagagaagggggccgggggagagagagagaggggatagtgaggagaagataattaaagggggacagagaggagagaggggcggaggggagagagagagagaaggaaatttgaaattttttgaataggttgagagggaatggatattttcctgtgcgggtggattaggaggcccacatgtgaaaattgtgtatttttccgtgcgggcatgttaagagggccgcctgccaaaatcgattttcgcgtgcggcctcttaaggatccgcaggtaaaaataggaggcccgcacgtgaaaataggagtgatttttacagacgcacatgaaaaagctccgcacgagaaaatgggaggtccctgtctagaaaaatcttatgtgtagtagtggtggtaggctgcggctagcagaccttcgcgatgctgccctctgcgacgttgccgtcacggaaggcagggtgattgttatccacctagccttgcccacatcctgatggccctggacttggatgtggtgtaaggcggtgcagatggccttgcacttgtagcggcactcgtggcagcatatgtgcgaggccgttgtagcgccggcagcgcagtacctaacagctattctccggcatctccagggccatttgaggtgatgggcatcgtcgacaccctacgtgcacttgtgcttgctttaggtaatacaagctttcaatcatatgatgccataaaattttgtttggtttggttggttggtcaaggtgtttatgactttagttgcttcagttcatccacaccacctgtactactgatgaagaaaagtacacacattactttccaatagtagagagctaccgcaaggcccacgagatgaaatgagatgaaagcccaccaccggcaccgccctctcccctaccgccgctgccgtcgatcaccgttggttgctcccgctctccatcggctccaccctctcctacaccctcctcctcaccaccttccctctccccttcccctcctttgccggccggttgtgtgcaaagtctgggaccacgacgtcaatccaacgccccaagggatgcgagtgtgggactgcagcgtcgcgaactgtggctagctgtagccagcgccatcaccgtccttgtcgatgccagagaagggggagaaggcggattgagtgagcgtagggcgccgtcgtcgcggagggccgtattgccgatatggctgggaaaagaagagagtgaagaaaaagaaaggacgccaagtcgccgacatgtggatcacatgaatattttttttactttattgactataggcggccacctaagtaaaaaccactttcaacgttgtctttggagtcattttgttctgattttaatagttgaaggagctgttatatctaattttacggttgagggatgcactcttgttttgacctatattcgagggagccaaagtgaactttttcctcatgacgagggagaatatccggtgaaaaccatcgtgccagtgaaaattcataaaaacaatgcctaaaagatttctaaatttataaaaacaatactatcaggtatagtcataaaatgtattcataccagatcttaactccaaactcaacttccttccttttagagagaaaaagaaaagacaaatttcaggtaagtagtactccctctattccataatataaggcgcgcacgtattttaagatttaacatttaaaatatttgaccaacatttagtataatatgaaatgaattttatttgttaaaagttatatcattagattgacatttaaatttactttcatatgattatacttttgttgctacaaatcttatagtatatgagaaattataatctaaagattaattttggagaccgtgtcaacttttaccatgccttatattatggatgaagggaatattacgttagtattcacctagaaatttatctttttattactccataataaggtgaattgaacttgatatttgataataatgtatttcatgcatgcactctagaaaatttttttatgaatttataaaacttttaagtttggtttttatggattttcacttatttgattatttttaccggataaatcccctcgtaacacttttaccatgattgctttgtgatacttaattaattatggtttgtttcctggagaaaggacctgcatgccttatcgtcctcaagatgtacgccgtgccattttcattgctgtgttgtgtgtaagctggctttggagggcaagcagatcgatgattgcgacaatatagaaattcaaattagcatcagcgacgacttgttcccaggctcatatttttttattttccacgtgcatacttttcaaacggctaaataatacgcttttttttaaaaaaaatctataaaaaattactttaaaaaccatgttaatccgtttttaaaagtatttttaagctaatgcttaattaattatgtgctatgcgtgttttgctttacacgccagagataaggagttctaatcagtagggatgcaaatagatcgatccatgaatccactcataaacaaaattagtgggtaactcacaaattgaccggtggattacccaataatttagtctacaagtgagttcacgtgataactcatttgtattcctaggtacggtaaccagacctatacttatttgatctataagtgatttgcagctcagtccacttacatcactaccaaccagccagcgctagtagcaatttgaagatttcatatgtgtgtgcctattgtggtaacatgcaatggtcgatgaatatgcgaccgacaccggctagctagttcatgtacatacccaagttgaagccaagatcttctagaccgtggtattaacaaaacaaaggacccattaccatcaggtagtaaggtcgttttcgtgagttaagtgcacatgcatattgacatagtcttcctttgagggctcactagtcattaaatatcggcttaattaccggaaaatctacaagtttcccccatttcgtacgcgacaactaataatttcatggaatgtgaaacattatattgcagtttctcgttactgagaaatattagttttttttattaattttctcctaccccaatctatgcactcccgtcaaatccaaatttaggtctgaagcgtgtggctttagaaaccattgcatcaacttgccaaactaaagcatcaagcatggatcgaccagaagcacaaataactaggtgcctatttggtaaagttataactcctaaatttaacttcaggagttgggtctgtagtgaagttgtgaagctacctaaacccagctccaactctctattacagttgcctaaacccagctccacctcttttattttgtgagaaagctccacgtagctccactcctattctaggtagccgaaattgtttggctaagctctagctccagaaaaggtaaaactggcgttggagctggaactttgccaaacagactcaaggattctcacactaacctttccaaagagtaaattggacatatgaatttcacacagcataattcactccgacggtttttcaagctagtgtgcacagggaccctatctaatcatagcactttgaactatggcagtgtttagttcccttcaaactttcaaaaattttgtcacatcaaatgtttggacatatgtatggagcattaaatgtggacgaaaaaaaccaattgcacaatttgcatgtaaaattgcgagacaaatattttgagcctaattacgccgtgatttgacaatgtgatgctgacggattaattaggcttaataaattcgtctcgtactcccttcgggctgataatacttgttattttagacaagggtgaagtcaaactttagaatctttaattatcaattatttttaaaatatttgtcttttaaatatggtgactacatgtatagattagtcttaaaaagtactttaataaaatcatatatttgttaacatttttatacatattataatagaaaataatggtcaaagttattttttggagaccgtgctcttgtccaaaacaataagtattatcaacccggagaaagtagtttacaagcagaatctgtaatttgttttgttattagcctatatttaatatttcaaatgtgcgtccgtatatttagaaaaaattaacacacgaactaaacacgacctgtaatggactaggtatccacttgcatcaaaatgacacgtatatttgatcagacattaatgcgtttctcttcaaaaatgtgaaaaaataaaggtacatcaattctgcacgtagccgatcagtagcaccaccggctagcagtatagcgcgcggaattttgtgcagcgtgtcgatgtcatacgcaatgtctttttttttcctaaagaaagtcagtacaaacgcaggtcctcatacatatactcacccttgtaaacataaatacacacatcctatccctataaacattttctaaagactagatcagtatatcttgagaataatgaagtcatcactacggacatctcgttgtcgataggtacatcgtctataactaaaataataattagtcgtaactacgagcacctgtatcaagtcatgcactgtctttgatagtgttaagcatacaaagctcttccaactaagtaactttacctttttaaaaatttaccgaaaagttacatattttttttaaaaaaaattagcattatagattaagatttaaaatttggaactgaaatttctaacatttcgggtccatcgagccccccccccctcccccaaaacacacccaaaaaaacgagatgattgcgggtgattttttcgcgtatttagaaaaaaaatgttcctatttaatcaaattttgttcaacattacaaataattttgaaccgaaatttcagctatatcagtacttatagaaatagagaaaacaaaccgttataccctgctccagatatttaagtacatcacttcgagataccaaaattcatacgtcgatactttttcaagtatcgtaaaatttgcccttccaattaccatagacctgtcactatacatcaaagtatcaaacgaccggttctgcgaagcctccctggtgtcatttcaataacaacatgcatgcatccaacataagcagagagagtcttatttaggccagtgcatgcacccaaccaagcaacccattttaatataaagctacggcatcatatgccttggactgacacacaagttcttaatttgtcattagaatatcacataagtcctttcacttgcttgctctttgtgtacatctttcgccggagcagccagagccatcgccatcgccatcaggccgctaatggccagccgcccgccgcttcttctgcagtactcgtcgctgctgctgctctgccttgccgtctcggcgccgccggccgcagccggcaacgtgccggcgccggtggcggccgtctcgaagccgggctgcccgaccaagtgcggcgccgtggacatcccgttcccgttcggcatcggcgagcactgcgggctcgaggcgccttacacaaactacccgttcaagttcgactgcaagcccgttgacggcaccagcaagcctttcttcaggggtatggaggtgaccaagatctccatggaagacggcaaggcctggatgaagatgaacatatccaagaactgctacaaccagtcgacgggcaccagggaggacaacaccaacacaacatctgtgagcttcagccgctcgcctttctggatatcggacagggataacaagatcatcgtcatcgggtgcgaaacgttttcgtatatgcagatcaataatgtaagtatatgcccataattcgtcaatctggttgcattagatcacaaatactcaaatgtgttcataatatatggcctttaaaatacatgatagtctaaattattattcctttatatatcaaggacgacttaggatttgtcatgtgagaatattattagtttctccctttcacatgcatgtggaatgcgtgtggaaaatttgaccgctgctatttgggctgcaggaat

SEQ ID NO: 39912 - DNA, 5393 bp, Oryza sativa
ttggccaatttttttttaagtatacagcacacatttaaagtattaaacataaactaatagcaaaacaaattatacattccgtctgtaaactgcgagacaaatttattaggactaattaatccgtcattagcaaatgtttattgtagcatcatattgtcaaataatggtgtaattaggctcaaatgattcatctcgcaatttacatgcaaactataaaattggttttttttcgtccacatttaatgctctaacatgtgtccaaacattcgatgcgacgtttttggcaaaaaaaaaatgaatctaaacacggcctttctcaaaattaaagggtgtgcttgaaaatcgtgtcaattcccaaataggatgtgtgtgtgggggggaattatttggatcattgtcaaatcttgtattaaggtgtatatataatacgtaacatgtgcaggttttaacaggttgtgtgccctcatgcagaaacgaccccaaggacggtatatgttccggtgaagcgggttgctgcaaacttgatttccccaatggcacatggtactatagtacttatttcagtaaaagaaataataacagcagtccttgcagcttcataacagtgatggaaaccacaaccttcaacttcaacaaaaattatttcaactccactacattctatgacacatacaatgggttagctaaggtttccctagattggatcataacaatggattcatgtgatcgagtcaaaagaaacactacttcatatgcatgcattagtggaaaaagtcgttgtgttgatgatccaaagggaggttaccgctgcaagtgctctgatggatatgaaggcaatccatacgtcaaggatggatgcaaaggtatagtcatacacaccttcttatgcctgctgcctatctttgttacaaatgtataagataatgcaacaattttaaccaaatgtgttgatggtttggcttcagatattaatgagtgcctcgacaatgctacttacccttgtccgggaatatgtaagaatacgttggggaatttcacctgctcatgctaccctggaaactatatgatgaatggaatttgcattccaaatcagaagtctggttttcctaaaaatcttgtaataggtgagttcgtctcttcctataagaattaaaatggcatgtgagatcgatatacatttatgtttttgcttatacatttgtgctatatttagttatttactatatagtagctctatcgttttcctcatgcagatatagaaaaatataatcctaatttacaatgcctctactatatatatagttatatgtttaaaaatggtattcgttctggctttcaagtttaaacaataaggtgtgtatgcataattaatgtatttttcattctgaagctagccctcatttatctacccttttactttagcatttagtatacattcattcttgcaactatatctcttttctagatattcctaatattaatttgtacaccatagcaagaccagcaaccactgatgaatcatgcatgcatggtgtgtatttttctatagtaagaagaatggacacattttttgatcatgaacatttcatgttccaactaatgatgaaatcctcacgaactcctcaagttgctaaagaaaaaaataatttagtgaatcttcctctgccaatgccgatgtggcatatgtgggacttccttggggctagcataaagggatcaactacacattccaataatcttttcatagcaattctaaagttttctattatatatgcaggagcaagtgttggggccgtattactagtgattatagtaacttatgcatgcttcatcagagagaagagaaagctacagtatgtcaaaaggcggtacttccgccaacatggtggtatgttgctattcgaagagataaaatctcaacaaggcatttcattcaaaatcttctcagaagaagaattgcaacaagcaacaaacaagtttgacaaacaacaagtccttggccaaggaggcaatgcaactgtttacaagggacttctcaagggaaacacggaaatagccgtcaaaagatgcatcacaattgatatgaaacaaaagaaagaattcggcaaggaaatgctaatcttgtcccaaaccaaccataggaacgttgtcaaattattgggttgctgcctcgaagtagaagttccgatgcttgtctatgagttcattccaaatggcacattgttctctctcatccacgggaaccacaatcaacacatctccttggatactcgcttacgtattgcacatgaatctgcagaggctcttgcctatttacactcatgggcatcaccaccgatcctccatggcgatgtcaagtcctcaaatatcctcttagacaaagattatgtagcaaaagtttctgacttcggtgcttccatcctagcaccaactgatgagtcgcagttcgtcactctcgttcaaggaacttgtggatacctcgatccagagtacatgcaaacatgccagttaacagataaaagtgatgtatatagctttggagttgttattctagaattgctcacaagaaagaaagcattcaaccttgaaagccctgaagatgagaggagcctagccatgaggtttctatcagccatgaaggaaaaaagactttctgatattttagatgatcaaatcatgacgggagataatttggagtttcttgaagagattgcagagttagcaaagcaatgcttggaaatgtctggtgagaatagaccgttgatgaaggaagttgcagacaagctcgataggttgaggaaggtaatgcaacatccatgggcacaacaaaatcctgaagagatggagagcttacttggggactcttcttacgagatcaacaactcaacggttgagaatacaggaaatttcagcatcaatagtgaacttcagtgtctagaatcaggccgttaaatagaagtttgttatattgtgtcataaatgttatagtgtatcataggttgaagcacgtatggtatcatatatgccttgctgtatcttgggaattgaaagaaattatatttaattatttaagtacaggatgtatggcttgtcagtctttcagggtcggggctgtgaatcaccataattatacatatgcagatgcaaattttgatgtaaaggcaaaggcaattggctgcatcgtcttgtttgctctcctagtttctctttgttgtgataattgcctatctttatattcgtattcttggctctggggtttttctttactagcaaaggacatgtgtgttgcaacagaaaaatcaataaatcaatggaaaatattagtgaacagaaacaaaggatgtcaagcgtggggaataattcaccgcttataaacttttctaccacatacacaccatatcatagacttttaatatttctcatgaattgggaaaaagaaagtcaaattttgtcacatgacactcaaagtttgtgtaattttctactagacatcgcaaaagcgtgtcacggttggaggacaccaaaaaactcataatttgctatagggcacttttaacccaatcaaagagaatttttaaaaacgagaatacccctatagccaaaaacttctaacctagaattggagtgttgatggaatatgatatatgctagcaatatacttcggctgatggaagatttagagttgcataatttttattttttaaaatccaacactaacttagaagcttgtggccccaaaagcattctagtctatttaaagaatttttccaatcgagccgaaagtgttcttcaggaaattatcaaaatttgagggtatcatgcagccatagcacacttttctatgtctgatagaaaattacacaaactttgggtgtcatgtaataaaattttccaaaaagaaaaaggaagggaaaatagtgatgcagtgacaacctacacggtaggagtccatgcaatgatgcaaacggagtcaagtgctccactgaagagcaaagagactaagtagagtagaaagtgtcgggctctctgaggtactaaggtatgtcgcaaacgtgtgcagtcagacgtgtggggtgtaactgatatcgtgcgaggaactatgaagtcatatgagacgacggaaatatgttagattttttactagtcgagataaaaagatttaccaaatcctagctttacattggatggatgaaagtgaatattgatggatcctttggatgaaagtgatcaatgttgatggatcctttgaggctagccacaaaaaagggggtgttcagggaaacctatttccgctgcttgcacttatctgaacaggtgttgcaacgcactggaagctgaattgttggcgatcagaaaagggattgttctagcgcttcaatggaccctagctatgcccgatcgctttggaaacagattgctttctagcgctgcaattgatccaaacaaaagagaagaatttgtcagaattggctttcttagttagagaggtgtgtgaccacatgaatggaagtagggagatcttgctcgggaaaatcactgaagtcaaaactttgttagccactctttagctaataaggctagatatgaagctttttcgaattcttggttagattctaattgtgatgagttagcacagattgtaaaagtcgattttatttttgagtaattgattcctttcccccacaaaaaaagaaaaaagaagatgggaaccacatgcgtgcctactaatcatgtgtggaattgaccgcgccaaacccgctatgccaatcccggtccgcttttcgcctcttccgaagcctagccggcccaaccgcccaaatacatgcacgtcagcacatggtccatcatctcaccgaccggcaaaacctgcaccccgaagcccatcaaccgtgtaacttaaagtataagcccaaagacgagcgccccatgccgtgcaaaagcaaaccgttggtcctcgcccgtgaaaaccacttccgccacagcgaagccgaattcgtcaaaaacccgcgcgccggcctttgccccaaagttggcatcaatcgcttttgctcatctccttgtcccgtgcaggggaaccacgcatgcgtcgaccgaaagcacaaacctgtacatgtacgcctgtgtactgtgtacgtatgcatccatgggggccgcgtacgctgagccgtgcgcgtacgcgttgcacacttgcacccacacgtctacgtactagtggccggtagcagcgtagagctagaccgtttccacgagattttatcccgtctccgtcaggccgtcgtcctcgcagccctggcccatcccggtgaggagcgtaaggctcctcaccgggagaccgcgcaggcccacctttgccggttcggccgggggccctgggtgagattctaagctctcgg

SEQ ID NO: 39913 - DNA, 7170 bp, Oryza sativa
agtgtcagaccggtcacaaatcggtcattcttgtccaccacgcgtcagtttatcaatctgcatgttcgcccttcttcatacaatatcttgcttgtaatggttaggatgaagcctggcatatatctgaccgggaccaacgtgccatctccaggaggtaacacgccggctccggctagggacgagtgcttggaggctctcatcttgacgggatggagcgaggcatgtgtcagaccgcctgtcgccacctaatccacgatctgatcggtctgtgactggtcacagaccggataaacgagcgcgctgcactgcgttacatgcggcgtgacgcgcttgaccaaaccgcaataaatgcggttaggtgagccccgctgcgctcgcctaacccagacacgcggcgcaaaacccccaaggggtcggggcgcctcaaccctcggggccgaaacgggagcggtccgacccctcagggagacaaagaggggggcggccacatcaccctcgggcccgacccccccgagggggtcaggcctcgtgggtgattgctcctgcccaagcctctagtcatgatactcccggtcccatgtcaccgacagtagcccccggtgttatgccagggcgatcgccctcctcgagggaagcggtcgggcgtgacgccacttcttaaggcctggtgacaggtgggaccggtctccacagttgggcagaaacccaacgatcgcaaatcacgcacatcggcaatggttactcggctgccaataatgagcggtctcttcaagactgccacattactcgagtagcacgcgaatcgggacgagccggttcgttttgcctggagatatggtgatggcgcttttctcggagccatcagaatagcgtatagcatcttctgggcctgagggtatcgggttttggcgtcccggagggcctcgctaacaaagtagacgggccgctgcacctttcggcggggccgatcctcttcgctaggggccgcatctccagggcgctcttcatccgagaggcagcgcggggcgccctcggcttctgtgccgataacctcggggtcagagggcgacaggcgcggccttcccgtagtggccccgaggctatcctgagggtcgggggcgcctaacaccgtcggacaagcaggcggagggccaactccggccgtcgggggccttgggccgccgttcggcttgggggcctctcggaccctgacttctccccgtgggcagcgctggaagagttcccttccggaaccgaggacggcgcacgcgcgcaggtccgggacgccgccgaccacatcgtccacagcttcgagggtacggcccctcggctcgcgttcgccctcgactccgacgaggagggcggtgacggtggtgcggacgacagcgacgacaaggctggtgacccgggcgcgtcggagtgagcccccaggcccccgccaatcttgaatagctttttctttcttcttccgaggccttcgggcccccttcttgtatagactaatttaatctgcaaccaaataaagaggaaatttctatgtcaattctatttgttgtgtgtatgagacgaggatggtctgtgccgcggtccttctgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccaattcccccccggagttcaccacgccccggggcacggctcggttctgggccccgtttggcgattttagccgacccgagcccccgaggacagggtcgagcacgagtgtgctaattcaagccaagattcttcaaaaggaaacaatggcacagacacagtccttaggaaatcgaaaatgcttttattgaaatacggaagagaaaaaagataagcccccggccaaccctgcacgcccgggggggtgcggggttggcccgagcccaagacctgacacccgacccccactaggggtagaagcgacgaaggtgttcgatgttccacgggttaggcagctctgtgccgtcgcccgtggccagccgaacggagcccggccgggggacgccaatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcaaggagcgccggccttctttctgtcgctcgcaggcctcccctttcgggtggccagcgaaacgccctcgacggcgaggacatgaccctcgtcgtcggaatgggccgacctcttcttcctcctcctgtcccgccgccctgtctgagcagcggatccgggggcggccgaagctgccactccggaaccggaggggttccaggtccatgcctcctccttacgagccactcggtccgcaagctaaaaaagctccgcggtagtctggggctctttagaggcaatcttttcgagcatgcggttgtgccgcacaccccccctgaacacgtagatcaccgcgtgtgcagggatgcatggtatggtgttgcggacttgacagaaccgctgaatgtatgagcgaagtgactcatcatcccttcgctggactgcatgtaagtccgcttctttacctgggcgcggatatgtgccttgaaagttcatggtgaactgttggcacagatcctcccaagagtggacggacgcgggtggcaagttcattagccaaccccgtgcctgtcccttcagggccatgggaaagaaattcgccatgaccctgtcgtcacccccggcggcctcgatcccgatcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaaccgccgccgctcgccgcgccctccgccttgatgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagtttggagcgcgccctgggcgtgctgccatcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggctgtgcgcctttgcttgttcggccattgggctgaacaggaaaagcttggcgcacacgaaagagtgcgagagcttagaagaacacacgcagaaccccctacctggcacgccagatgacggagcgtggggctcctcaccgggagaccgcgcaggcccccctttgccggttcggccgggggccctgggtgagattctaagctctcggtgtgtggaaggctcacgagaatggaaaaagcacaagacacgggcgatgtatacaggttcgggccgctaagaagcgtaataccctactcctgtgttctggtggatctgtgtatgaagaagctacaaagagctggagagccagagagctcttactctagaaaccctcttctccccttttttcctctcgtgggatctactctccagatcctccctccctttctaagtgggcaaggtcctccttttatatctcaaggggataccacatgcaccatctctctcttttgtgtggggacttatcctatcttttcataaatggacggagatttgtatggttgccgtctgaatgaccttctgatgggacggcccatacctacctccacttccgccggaagcaggcgcgacgtgggaacatggctgtctgctgacgatatgaccagtgtcagaccggtcacaaatcggtcattcttgtccaccacgcgtcagtttatcaatctgcatgttcgcccttcttcatacaatatcttgcttgtaatggttaggatgaagcctggcatatatctgaccgggactaacgtgccatctccaggaggtaacacgccggctccggctagggacgagtgcttggaggctctcatcttgacgggatggagcgaggcgtgtgtcagaccgcctgtcgccacctaatccacgatctgatcggtctgtgactggtcacagaccggataaacgagcgcgctgcactgcgttacatgcggcgtgacgcgcttgaccaaaccgcaataaatgcggttaggtgagccccgctgcgctcgcctaacccagacacgcggcgcaaaacccccaaggggtcggggcgcctcaaccctcggggccgaaacgggagcggtccgacccctcggggagacaaagaggggggcggccacatcaccctcgggcccgacccccccgagggggtcaggtctcgtgggtgattgctgttgcccaagcctctagtcatgatacttccggtcccatgtcaccgacaatctcgatcgtcgatcgacgtcgtctcgctcgtctacttgcacgatccctgcaccggatgcaccgcaccgatgagatgtgtgctgtcgttggctaagctcgtttgcaccctcaaaagtaacatggatgtctgcatgcatatgggccgtgtgtcgtcagaaattcagaagctgtacgtacgtacctgtccagtgctgttcctggctcccgaatagaccgtacccgtgcttgctttggcattttgtttctttcctggagaaagttcctggatgctatttctaagctgtgtgacagtgcgagctggctcttccagtattgcgacactcctgcaggcaagttgtccaagttgatggttgcaaaagaaaaaagttctccaagttgatgtttcagagatattccttcaagttgagaatgggatcggctagtatggccggtttgcctgggccaatctttatatagctttgtagccttttatatttatataatcaagttactaataatcgaaataaatagttgaagtagtgatatggtttgatacagggcatatcacgaggaatcagatggactacttgtcgtgatctttcgaggccaagataagtttcatttatcaagatagtgcgaaacgcactattgctacgatcgaattgtttcctttgttcccggtcatgggttgggggaccagaaaagtgcagtcatattctcatatgggcggggacagtagtcacagcctcacaggagtcctacccaagattttattggtggttaacttgttgttcggcaaaaacattaggaaagcatgactaaaacgccgactccattgtgattaattattaatttatattgtgatatgaaatgatctagtactacatttgtgaacaacgaccataaaaaagtttgaaatgaaatttgtgtttgatatacacgtacgtgtagctaactttttattaatttaatactccccattttaaattataagtttttttgactttggtcaaagttaaattgtttgaaattcaaccaaatttgttgaaaaaactagtagcatttttaacccaagaaaaatatattataaaatatattcaattagcgatttaatgaaactaatttggtgttataaacattattatatttgtctataaatttgattatacttaaagtagtttgatttttaactaaagtcaaaacgacttataatctaaaatggagtaagtagccgacttgattgtttaggagttttcttacaaaagaaaaggatagttgatgaattcattagtcccattatcataccttgtaagtattctgatccgtttcaaaaccatactaaggctgtgttcggatgcgccttttcccaacccctctctctcgttttctacgcgcacgtttttcaaagtgttaaacggtgtgtttttttgcaaaaaagtttttatacgaaagttgcttaaaaatcaaattaatccatttttgaaaaaaatagcaaatacttaattaatcacgcgctaatggattgctccgttttccgtgatcactgttccggatgggaacttgttatagcgaacacagcctaattgtcttgttgaaaaatactaagacttgaatatatgttaattgagttttttcccatgctgttgttaaacctatataaattggaaacctttttataagaaaattcccatgttaaaatatatctagcagttgactattagttaggtggatatatgattctagatctattgaaaattattgttaaaaatatacagtcgaaaataacatgaactctttaacttttactttgtctctgaactgaataaaacatgatcaatatcgtggatccttccgttgatttttttttcaaaaaattagaatcaataaatcaagctgcacctagagttttccagcacaaaaagctttatatcgcatcatctttcagagcaaagatcgaagaggccagaacttgtgttgcaacaggcgcaaagcacctcttacttatgctgccatagtattttactacatccgtcccaaattagatgtcattttgatattatactttcgtcttatttaaaagattagtgcaaatataaaaaaaataagtcataccgaaagtacttttgataataaagtaagttacaataaaaaataaataataatttcatagtcttgtaaataagacgaatggtcaaacgttaaaaaagaaaacttaaagcagcaagtattgtatttacttcttgtacagttttttcttaattgtacaagta

SEQ ID NO: 39914 - DNA, 717 bp, Oryza sativa
attaccgatcatgtgtaatcaagtattaaatcagcacaaatttgatactttgtaatgtgtaacatgatacgttagttgctaattgccatcaatgctatgctacctcaagagattaagattctttgttttattgttcaggtattggtttgcttaaagtgggtggaaggattgtttactcaacatgttcaatgaatcctgttgaaaatgaagcagttgtcgcggaggtattttttgttgcttgatttaactttacttcctttgcccctctctaatattaatgtagtaatgtttgattgatcaaattatttttgttgcctttttctttgtcatacacttatacttgatgagaccctaaaatgttttcagtgtgtcaaatctaccatgggagtaacttttgttgagattagaccatctaggaatgttcatttttcaagtgtagcacttgttttcatgtcctgtgtaccttgttgtgacattgaccatatttttcataactaaatagattctacggagatgtggggattctgttgaacttcttgatgtttctaatgagctacctgaattagtcaggcgtcctggacttagcacctggaaggtcagtgtacatttctctgaatcatgcatatttccttgtatattttgtacactttgcaattttgcataattagctgcgactgtgatcttctgtggccttagagccaaaaaagaaaaaaaaaa

SEQ ID NO: 39915 - DNA, 7920 bp, Oryza sativa
  unsure (1)..(7920): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaggcttgtaggctccttccaccggtcctgttcggctcagggcttttgttgtttctacaacctcccattccatgtcctccttttcctttgttacttctttgctgcaaaatgcaaatgaagcagcacttaaaattgtgaaacacgatggctaaataaaatcacatatatttattaagacaattggtttagccaagtctagaaaggtaaaaatggtttacctgccctgtataagatgagcgagtcctactgcaccaaacactgtcaaagagataagtggcagcccatatcgaacaaatggatgtttccgtccccaccgtttgaactgtgaggtttgtcgaacaatcttagctgctggttccactggatcagctttctgagttgtttccatggcagaaatttactgaaaaatgttaaaagaaagttaaaagaaatggagcatcttcaaactgaacactgtcagttataggcaatgtaagagagaagcataaaagttcttgcatggtaatattctattttaaaagtgcaaaactatttgactgtatgtatacaaataaacatcaaatattcaaaacattcaaatagcccctcatggcctaggaggaacacaataacatatcaaatgaaaagataaatgcatgtccaaacgtatatgaactatcctgatttatgcagcagcattataatcaacagaaaaaccgaaatgctgccacacagcaagattttgcaacagaatatgatggacaaaagccattattgtagcttcaagttgagccattattgtactgaatagcagaagttgtgccaaagagtatgttggctaagcatcaggagccagcagatgaacctgccccactcattcttgcggctagacggctagtgtgcccagcaacagcaacaaaacaaaacaatattatggtcttctaatttaagtactaaccaataaccatgctaactctgctaaatatgtgcactgataaagtaccaactctgatacaagcctaccaagcttcacaaatccttaaaaaaaatgttcaatcatgaagtaagaaccattcctggattgaaataaaccaaatcctaaatcaactatgaattaaatcctagtttcctaattcattcctaaatcctaaacataaaccatctacgggcagggcagggaatgaggggaagagttaccttcgtccctcgggcttcgtctggagctccggaacggcgccgctggcgctggcgctggcgcatggactggaggcgccgagacacctagagcgggccgccggcgctggcgcgtggaggggccgaagcagcgaagcggcgaccgcgcgactgggacaggggacggtggcaaagcgcgacgcggcgacgggcgacgggcgacggggcgacgggcgggcgtgcgcgggcgcagggcgaagtcgccggcgcggcgcggcgcgtcggtctcctccctggtggcctcggcctggcggctggaacgctggatagggaacgagatgagggtttaggaagtttttgagctttttttttttgttattgggccaatgggcctcaaatagtgaggagaggaggatggtaagccttatagtttgggcttcttttgaatggtagacatttttttatttttctatttttttctatataagtatatactttatatatgtatttttttcttcaaaaatcttggatattcatttgaatacctatgaatcatggtgggcccgcctgagtcgaaccaccaagaaaagtagcaatagaagcagctgtatcggtgtatcgctccctctaccattactgttgtactccctccattccaaattaatcatcataaaatctttttgagaatattccaaaatgatcatcatatttgtgttcattcattatgtttatttgttatttgtgcattgaagtaaatgaatattgatgcatgcacccatgcacaaagtgttttgatttgctattggctaaaaaatagtggggaatgtgtatgcatcgagtttgttgctagaataaatgtagtatgagagagttattatattttcttggtcttaatacacccatgtaatatgattatcaatttggaatggaggtaatacacattgtgctaaactgaactacatctatgctgttcaagagcatgatatagaatctaacataaaattgaatgcctctaatcgttttctccatattctaatccgaaaaggcatgtacttccccttcctgccatattatctattgaaaaattacttaaaaatgagtttgacaaaatagggacagtaaaagaattcctcagacaatgtttgacaaaaatgcttcgaaatggattatttttcgagccaccgaacttgaccaataaagaactcctcagtaacaaactgaggggtcgtagagagcggtcaacagccggagaggtgaggagtgcaggatcaaattaaccatgataactaatgtacagcagacaacgtaattaacaatttttcatccgtaaatatggccaaattagccagaaagagtgaacgacatgtcagacgaacaggaacagccaaactgatagcttgccatattgctataggaacagaaacgcatgatgcaatgtaatctaacaaactgtaacacaaatcaataatgattaaccgcaccatattcttatgttagttagcgaccaagaacactggctgtccctgcacagatgagtgctgtgacccatcatcatagcagcgtgaagaacataggagtatctaaaaacaacatgcaacgtagtaagaagtttaatcaaatgttatatagctatcactgagctctaccagagtagcagcagcgcacccagcaggtgacgtgcagaacttttaaatagcccttttgtacattgaaatgagccggcacatcaaccgcaccgtagcatccttcttcaagaatttgcctatacaaatactagcgcaaaagaagccagctcggtccacccgctgtcaacaatgtccgccggtgagagccgacgaaagctatctttctgtggtgtctgtgttaagtagtatcgtctcgtgtctatactgcttctgatactgatttcctgaatctgaatgctatcaggccaagtccgatatgtcctgctcctcttctttagctttgtcaggtactgttgtttcttctgtgagttcggaggcaacttcaatgggttctggtacagggttgatagggccctgaggaatcccaaacagggtggagaagatctgcctgtggcactcgtcgcagaaacagaagtacgagaagtggccttcatcgagaagtttgtgcactgtggctcctggaaccacccgcctgacgtattcagtaactgacggtggcaccacccggtcatccatcccctgttaagacaaattggtgcgttattgcttcaagaagatattggtaacatgaatgcaagatatcggtagtatgatcttgggaaaggatggtgaagcaagaaatatactggacaattgtagtccacatagtggtaacttgtgtaattaatagtgcctgttcaggattgacttttagcatgtataaaactcaaaatctagattctcagtgatatgcctcagtattcctaaatgatgcaacccaaaccattacaagtggcctctctcctgagctactgtaattcgttttctaacaggtactccgtattactaaagcaagtaggaagcccagattaaagttgtttaaatgggggaatcatcacatgaattgagcaccagtgtatgtacctcgactaatgatgataatggacaaaatgctcatgttttatggaatcacatggtccatagaccaaccctaaacacactaaactcaattctgtatgataccaaactatgacttgagtaattataatctgtttgttttgtcttctatgaacaactgccatcaaaatgccaaatcaattacaaatcaataaatcattttagaacatattacaaacctgccatatgtgtattgggcccagaaatcccacccactcccgttcagcctgacggaatagagatttgatcaattcaaaaaagctcagatcctctctcttctgcatttgaatgtctgacaagctgaatccccaatctgatacttgcagtacagcttcctctacaaaaggctgtgcatctccttggcgcacagactctgcaacatccttttcccaaaatgcattgaacataggactttccagtgaagttttgtcgtgagtaatgcacataagattattatttggcatgatgaagggtcaatgcttttgtaaatcatcatatgtttcaaagcttcatcaacgggataagtgccagggaaaaaggttctaaaattagcatcaagcagccatgcatagatgaattaatagcaccatgcatcacaaaattgttgaaggtgctgctgtcctttgtggaattgatgatgcaattacagtagtactagaaccaaataacagatgttcggggtgaatctgagagcacttggctgtacaggcgtaaaataggaatagttgttaacagtagataaatgataattcacacaatagctgaagcctatgaagttgtgtttatatgataacaataacaaaataagtttattagctgatattgagtaagcaaaatcattggaaagtgtgaggcacaaaatcattagaaacaggtggtcataagttctccatcttcctaaccaccaccctataccaactctactgtaccatcttctgaggtacaaatgatgcatatgctacatgccctctctccaatggataacgacagagatatatagtacagcaaatatttatagggcaggcccatgtcatttcaaagtagtaccgtaagttagcattggcaccttaagagtgcaattagcattgatatcagcgtaccttcttccccagtgaaagtgacagccaactctcaggctgcccttgctttccagaaaggaagcttcggtgataaaagagaggtaatagggccggaaacctccgagctaaaatgtgcattagtttccgcttggttgaccacctctcccatgttttgcgtctttcttccttggtcatcttagagtcgtatggatttgccataggcgcgaacattgctgcacctggattcataacagttcattatgagcattcaatcaaaagagcagactatcatttgtgttgttctaatacacacccaaaaagggttttaacttttaactgagaaaataaagattgagagtataagatgaaattgagatgaaaatagaacttgtcctgatcaaataaaaggtggtgctatgttgttgtttgactgtacccaaatgtactcatgcttgacaaacaaaaaaaaaatccctggacaactatagatgttgctaatctgattcaatagaacatttctgttcttatcaagccagcaagatgattgcacttgaagtactgaaatatacctaaccatcataagtgctgcaggtaacaagcctactagcatgtatactttgtctggaattagggtaaaagtcacaagtatttctaagggcgctcccaattctagccatcacatataaactacaatagaaactatttgcccaatccatagtttctacataattatatgggaccaaataataaatttctctatctttctatccctattatttgttttgtctctagtcttgtgccataaacactacttcaacccccaatgccatttgtatagtgtctcatgcaaaacatagtttcacttcattaactatcttgccacatcatattcggtcctatatggcaagctatctaatgcaatggacactagttgacatggaccattgggagtgctctaagtgtttaaagtcataagcacatgtaatgtaaagatggcctgcctagtgtgatagtgtgaagtcagcgccgtcatcaatttataaaatcaagtagcgtctaatatgtacaggacaagtctacagatagagaaaatcaaataaagacggcgaaagtatctgaggcaggttacctgccactcggtcaggaatgtggcgaagagcactccaagcatgaatgctacctgcagaatatcccacaacccagaacttgtccacaatcctaagggcaccagccaagtgaagcatgtcatgtgcagatgaattcagatcccggcctgggtgaggatcactttcaccaaaaccaggaagatcataggtcacaagtcgtgccccaaattcctccaggagggatggtttgattcctgggattcctgcacacgaacaaaccatgtagatcaaatatgtgatgttgtcatgctgtgatgatacgttaaaccaaacaatgcaacatttggtcttacctgctaacctcgatgaaagaaaagaatgaggagcaatcagtgaaaatcttgccctgtcagctgtgactccttgttctttataagccagatgccttccatcaggaagttgaattgttttggcacttgggggacctatgtagagtttctttggcagttctactggggtatcatcaacactccctacacctaatactgcatacaaaatattcctgttaatcaagcgataaaaaaatgatcccttgcattaagaaattgtttacttggattttgcatttttcgcgaatcaattaaagtccatagcgcattgacaaaatgattgtacaatgtgtagcaggtatataggagggtaaggcagcacttctgggtagaattccacatgctagcatgcatcgagttcgcgtataagcaaccaaatgccataaattcaaaagtaagagggcaaaaagaatccacttggcgagcaatctgttggcaccaaaatagtaacatctataaagccaaaaaaaaaagcagcttgactcaatagtaaacgattgactgaccaatgaccacaatattagacattaggttgacccgccatgaatttcaaactgcccgtaggccactgtgcgttgtaccccatgaaggcatgaacacaagcgcactaggcatggatcccacaataaaaaaaaatctccttgaaataattacacgctttaaccaatatatatatatggagtaacgttcacaacagaaacgccgcataaagagacagattgattctaaatccaaacaaaatcttaggggaaaaaaaggagcaccaaacggttagttagatccatcccctctaatgaccgaacactaagcgtgcacgctcatatcatacatcgtgatgcgcgacggcataaaccaaaactgcacgctgagccgtagtcagagcctctcgcacgcaaggccgagaagatcgtgggtgggggggagagatcagcgggggattataccgatgagcgtgacgaacgcgacggcggcgacgacgacccagcaccagacggggtcgcggtcctcggggaggtactcgttcatgaagctgaggcgcttccccgcggccgcggcggggcccctgagccgccgcgcgagctcgctgtcctcggcgccggcgaggctctgcgcggcgatgtcccacagcccgcggcccagcacccgcagcatctccgccgtcgactccaagaaccccctcgcctgctgcgcccacccttcctcctcc

SEQ ID NO: 39916 - DNA, 11083 bp, Oryza sativa
  unsure (1)..(11083): unsure at all n locations
cggtcagatagcggtccatggtgatgggtactcctccatttgtgtaccagcaaagttgtaaaaacgccgcctatcaaacaatcaatgttgtaccgtagtaacgttaactgtatagaaataataggggtgttattttaggaaattttaagatacgatagatatatatactactggcctatattttacatttttttcgttttgtattttgtagaaattgaaccattaatatcgatgagagataccatatacataagataagtactcttactactcatacatatattatttgctattatgtcatatatgtcttttttttcttataaagttttctcttaaattacttatccgatatatagtccaattacactattattttcattgcaattaaatctttataacttacatgattatattttgatgaaaaatatttatgtttgcaaaatacttttattgtatatgtatgttactttgatcatatatataaatttacttttagatttgattaaattacttcttatacattcataatgctcttagttgattgattttattattgtttttagtcaatttcatagtttatgatatttaaattaaatttctagatatactcatatttttatattttggatggaatacagagagtaagaagttttgatctaagaatggtggaaattttgtaacgacaaaaaaataataagtaatgtaattatatcaggaagcccaatcggtagaggtaaaggtgaaaagaaaatcggttttttaagcgtgttagcggggggctaaacgaacactccgaagtccgaactactagcacatgaatcatcaagaattttgaattgcggcactgtatttggtgagtggtgtcaggcaagcagagtgacggtgccgtttgtttccgcccttccaattgcctgtgtaaaaggcagcgtgttggtgtagcagaatcagagacggcggcgcaagccgacgcgcgggagcagacagtcgcaacggggtggaccgggctggcggagaccgaccccgaccaggccagccacaccgccgccttctctcagcctcaggtggtccccacccccgagcatcaacagcacgggccacaggtgctaccgccgtatacagaggatcccgactcccgagccacccacgcgcgcgtaccggttacgcttcgggcaggtggtgtgtgggccggaagtgggcgcccaccggccccggtgtggctgttccgcggcgcgggatcccgtgcgccgtggcgccccgccacgcggcgccgtccggctacggtctcgtggatctccgacgctggacggcgtgggcggcggccggtttgcccttttctgcgcgaggattattccgtttccgtacctcgcaccagctgctgcctgctgctgctgctgattcccttcggcgccgctgcaccggcgggggcttagagcaaggttaatggtgcagccggctaatgacggtaaaaatgaccacgtcagcttcttatagctagtgccaaaagttaacgtatacaataagcagggttacaccgactgctatccttttttttaatcttaagtttccccatccaatttatcttcttgcttgttgcggtactgtacctattttcccacctcctgcttgaatgggttgctgccagcaacctagcgaggatgtgttttcacaagctacgagcatgacacagatagataccagttgctagcgaattgacaccggcggagccggagaagccggcggatgagtggagcaagggtgaagtaggatgacaggcagctgcacgggaaacgctgtaccgccgtcactccagtcatcgttcgagctcgcaacttctctctccgtcgccacaaccctcgagctagctgctttcgtcgccgccaatggcaccgttgtgtgacctcggagctttcgtcaccaccaacacagccaacgacgtcctcgagctcagcttatatctcgccatcaacgagctctctctgctatagttcttgttgcctcgtcggcgagctttccgctccatcgtcgtcgagcacttcgcactcaagctcaccacggtggtcgccgttgcgctgcctctgcattctcggccggttgccgttgcttcatcttgccatttccgcttcgcctcaactcgcgtggacccacaactgtgtggcccaatcatagctaacctagtgttgctgcactgcgttggagcgcgtgtatagtcggcgataatttactcgccggctcacgctctctctcctgcccagctcatcaacaaatctgacgtggccgttttatcgccggctaaaacagcctattatacttgctcttatcgtgccacgtcacggcgtgtagcggttagtcctgcgtggacgaacgtggcactgcacgacagcacgagacagtcgtgggaacgtgaggtagtacttgttctcagctcatgttgggaacccttcctccccgacacagaaaacgaagtttgtttattgcatgattaattaagtataaactaattttttttaaaaaaatggattaatatgatttttctaaaaaactttcatatagaaagttttttataaatcacatcatttagcagtttgaaaaacgtgtgcgcggaaaacgagagaggtgggttgagaaaatgggggtaagggcatgtacaatggttgtcaatagtggtctcttagcgttgctaattaggaatacttgttgacatggaggaaagagaaagaggagagacaaaacatcgttgttatgcatgacaacggcttaacaacgactcttagtcactataatatggaaaaatggttgcatgaggataaacatatggaaagaatattaacaaaaggaatttttttgagttaatgattagagactttgttgtctcaactattgtaaagacatggtctctaaataatcttgtattatttaagagaccatatccgtctctaccattgaacatgccctaagaacacaatcctttttcttttctttcctaataaaagtgttgatgagatcgtgtaataccaaggtctcattatttttaaattaagataaagatcttatcttgattttcatgttttttctaaacagttaaaggatgtatttagtgtaaaaactttttatatctcttgaaaaaaaacttttatataagttactttaaaggcaaaattggttatatagcagnnaaagtttacntttttggttttatggcaccaaaagttaccagttcactttaatagcacctaaagttcaccatgttcccatttttaacacttccatcaattctcgatcgttttccgtccgtcttgatccagccacacacgatatgacgtttgtacccctcacaagtacaaatataatgcatgtcaatgaggggtagaaatgtcatatcatgtgtgtggctggatcaataacgatcaagacggacggaaaaaatgacggaagtgctaaaaatgggaacagggtgaacttttgatgctattaaagtgaaccggtaactttcggtactataaaactaaaaacgtgaactttcgatgctatataaccaattttgcctattttaaaatatcaaataaacatattcttcaaatctataataattaatgacatggcataaggatatatatttgttgcatgtgatgtgctaataagatactccctttatctcaaaataaaccaacatcataggatgcgacacatcgaggattattcagattcgttgtggtcatatttttatttagattgagttttttcttgcaatggatggggtatttctgattcccaatttttttttaacgaacaacactagacggtgcgatgattcgttgaatagagcagaaaaaaatacaagactagtaccctggaaggcaatatcctgtgtcagagggtgaactcctcaagcaggggatagtgaggcccccctttgttagttcggtcgggggcagcaggtgagaatcgaggactctatggaatggcgtgaagtggagggggtctggcccctcaggaacgaggagacaaaaggggtttatacaggttcggcccgctgagaagcgtaataccctagtcctgtgattggttgatgagtgtgagttacaaagtacttaagtcgcgagacccaagcatgagttcgccaaagaatcgccccctctccctcaccaagcctggacctccttttatatctcaaggggctggcacgtgggcctagaagtctacctagggatgagggaggacattctctacattaaatgcatgtcttgttgcttgacttggaagccacacgcacgggcgccatggcatggggcccatcaaatccaaccggcacaaggggacacccgtgtcattcaccatttaatgggtgaagacttttgggtcctcacttgcgccggaaaacggaaaccctgctttgactgggttagatgaaccgactccggctaggatcatcatcatgacgtgacggattaggtcagactgcatgccgcctgacaagggagtagtacataggcgcaatactccggtcccatcaatcattcggctggtcacaaaccggtcaggcgcacaacacgccgcatgcggcatggcacgcccgctcatgccgccttaaatgtggttaggtgggtgttaggggcgcccacctaaccccgcacatgcggcgtcatgcagagggggtcggggcagcctgaccccaggcatggagggggccgccgccgccctatcctaggcccgaccctccctcgggggagtgccacgtgggtaccggggacggcctcctccctctggtcctaatacctctgggctcatatcatcgacagcctagaaagaaaaaaacaccaccaccatacaccgacaacgtctttatagaacccaagaaaaagttagcactggaccggccatcgctaagcgttaccgactgctgctagatcaacaaaagagctaccgccgaaccgtccaaaaccaaaacctaacagcgagcaacgcactcgactctatccatgcccaaattaatgacaaggatccccaaattaacatgtacaattttgttgcctacggaaaggaagaataataaagacgccaaaacgtaaaagtaaaaacaacaaagaggaaagctagaatcatccactgtcatgtcatctgtgtgaccctatagagcctggagtcctggatgcgatcgagatagctgcatattcggtaaaatgatagcaagctggcatttttgagaccttcgctttcataattgggcgcagccgattcttgtgctaaagctaggaattccaacgataaggcttggaatttgggcgagtgaacaaatgaaaaatctagtcgaactcttctgatagcacgttttctctacgtatgtacagtactcgatcaacagtagtgccgatcgatttctgaactaaaaaaagcgctctctttagattcttgatctggcgacccctcacggccattccttttatcctgcaaccaccttctagaagcaaaagctgagctgtactgggcaaactaaagaggaaaaaacctctaaagcactactcctgctaatctaaaaaccctttgagattaactgcaattaagacctagcagctgggccagaattccagatcgtcatgcatggggtcgccgatgaggtggtgatgagtcataatccgggcaggagaggaggccaccaccatctatcttatcttaatccggagaaaatggacgggttagatagatgtacatgtcatcctaatgaagccatcgatccatttgggataagatgacatgtaacgacagatagatcgatctagtaaagaatactaacctcctcggcagcccaaccgacggcgcagaacgtggccgtgcgtcggatggttgacaaaagaagccagtacaaccagtagcctataacgcggggcatatgatatgatgggttgggaacatgcgcatgcatacggcaaggccatgtgttgggtagctaagagtctgtttggtttccagcgacttattctaagtctctgtcacatcgaatgtttggacactaatttagagtattaaacatacactaattacaaaacccattccataagcttggactaattcgcgagacgaatcttttgagtctaattacgtcatgattttgataatgtgatgctacagtaaacttttgataattatggattaattaggcttaaaaaatccgtctcgcggattagctctcatttatgaaattagttttttttattagtccatatttaatactctaaattagcgtccaaacatccgatgtgatatgggctaaaaagttttagccccatctaaacaccccctaaagcctcggacgatatcgatgattctgatcccattatccttctggagctatgcatgctagctttggagttggaaggggacaacgcactttatgcgtgaccagtgcctggatggtcatgtggatccgattctctctcgaagtagtagtatatatgcgaattgaatcggccgtgtaagcacatggtagatgatagaatagaccatcagtccatcacccaacatttgctatcatggatggtactatttgtgtggtattgattctaggtgtacattctcagtactttattagttggtgtgggagtcattggtagtttggtacccttgcggaattcgctggcgcgcaatacaacagtaatgagtaagtacctctgtttgcaccgtatgttttctttattagctttgcaatcttatgatgggatcattgtattagtctcttaggcatgcatgtgagcaagcaatgagaaggatatcactgttcggggttaagaatcaagtgagtaaaaataattgggaaaccgacgtgtttactttgtggtcgaccaggggaatatcagaatatctgaatatgcgaatgctgaataaccgacgaggaagaagcattctcgcattcagtgcaacgccgccgaccactaccactagctgctgcagctgcacgacgccgcgggccatttctcgtgaagcaacagcaccggattttaaaacctggcctggtccatctggggagtggagacatcacgagggagtaacgtgctggcattctcggttctcctacccagagcatttgtggttgtgcatccgcgcgtgtacgcgcctaatttaggcctgtttagaaggccgcgttcttttcatctagccggtttggatgattagctatacgataaaacgaaatataattaacgtacgattaattgagtattatgaatttatttaatgttttaaagcatctggcagtgtagttttgccccaaatccttagctccccagttcctgacgatgtatgctactacttatcttcctaaacacgattttagattgggaaaagaacaaattacccttgaattaataggtaagttcgagttatagaccataaatcaaacatctttcactctcaaatattaatacggttttggtcctatatgacagtctagtcagcaattcttcttttttaaatcagcgagtcccacctgtcaatctcaccctctctttcccttcatctttctatctctttatatctccctctttccaaaatcatcactctctctcttccccctccctcacctccgtctctctccatcaaggacggtgacggggagagcttggggcagcatgcggaacttgggatagccgaggatggcgagcggtggccaaggagaagtcacgtggcatggaggaggcgcgtgccggaggaggccaaggaggagccgcctacgccactcgctgcttaccacccctagctgcctccactgctcaccgcctccatctcgttgcttgccgctcgagctcctccgccccgctgatttgggagagaatcagagggataagagggaggggtgagggagagaatatgacagatgagtcccaccgttctttttaacaaaaatattgagtggactgccacgtaagaacaaaaccactatggtatcagtggttgagggtgaaagatatatggtttttgggtctaaaaggtataatctgtactcacccaatcgtttaaggggttaattaagacttccccttctgaattagatttgtttttttctccttgatatatgggctggatttggcattgtcattctgtgtatacttatatcaggactagtaataatgcacgtgcaaggcacgtttttccaaatgtatatttaaattaaaaaaagtaaaagtatgggaagaaacagtgcttgcaagggcatatttatacattgacttcaaaaaaatggcaacggtatgtccacacactaaattcagatacatttcatgtaattctaaaaaaaagatacattccatgttcaaccttaaatgataataggagtatattgtttacacacattgcaatggctaaggtcagacactaaacccacacaaaccttacattgactggagaatttctaaacttccggtacttgagctatgagaaattcataacattcattagctcacagcaaattaaaacattgaacaatatttagatgcttgtcgaagttcagattctaaattcagatgctcctacatcataaggacaagtcagaaactaatatgccaaatgctcagaaaataatatatgaaatgttcaaacactaatctggcaaatgttagacatctaaggttcacacatattgcaaggacaaagactccaaatacagaaaatgaatagcttgtttgaggtatatatagagaatttgtcatcagcacgacagaaaattacaacatttttttttggaggacacaacatgagatgtgattggcaatttttttgctcctaggaaatttgtaacaaaaaaaaggaaagtgttccacatttctaaaggctgtcaggaattattaactcagtgcataaccaatagttcacagggaaaatatatatgcctgtttatgtttaatagaaacaatacattaattacactacacaggatgccatataatgcaaggccaatttcagaatgttgtcaaccaagttcttgagcaatgcaagcccaagttcagaccatgtaaaactaaattcaaattcatatataaagttgtatgacacacaaagaccataaagcctcctaattttggttggagcaacagcaaacatggttgggtagagttcagcgaatataaattcaataggaacttaacagtagattataaggaaaatgacatgtaactctttgaattgagattgagcagagagaaccatcagcatacataagtaaaatgcaaatttcagataattcacaaatagtcaatagtgttgtggtatgcatgtggcaaacaagaacattcaggtagataattttgggatttcatatgtgtgcaagcatatgaatgtcaaatattattctgacagggaattatgtgtaagtaatggcgtccttcaaacctgcaatcgtgattaacttgctccatttaagtcatgtgcatcaccttctctaatgccatcctccagacctacaaccctgattaacgcgcttcattgaagtcatgtgcatcacattgcctaattccatcctccaaacatgtggtcagagatgccaccaggcttatatgaaggttgcctcctctcacaaagaaggaaaaaaggaacgcctcttagcagcatgtgacaatggctaggataatcccggatcaaagccaatataaagatgaaattatgcatgttgtagtagtgctagacttctggagcatcatggaatgtgttttggtcgtgtgcccctgggtagaggttgggtctatagcacatacttgtgcatcaaaataaaatatcttatttttctttaacaaaagttcatgtgtttggagaatatatttgtccttggatctacccaaaacaaaatttgaagcgttaggacaaaatcaccaaaattttatcaattcaccagcagctgctagctaggagcatataaggcttgttaatgaaaaagtaaacactcaaattcctagcccagaaaaaggaagaagttattcctattcagaatcagagttgttccatgcccccttgcatacactaagctgagtttctttaatatgtttatactacgcaaatatatgtatgtacccttatctgaccagtgaccaataaccatagtaaaaattagtaaaaacttaaagcaaagaaataatcctgcatatatgaatattacctttttgttgtgcctatggagtatattaattcatatatatcaaccaaaggccaatcaatggtaaataacagaacaaaatctccttgacccttctcatagagcatcttaaagccaaaagccatcatctgacaagggcctataaaaaatgccttccatcctgttcacccatccccagcatatctgtataagctaaagaaatcaaatggtggaatgcagtataacattagatcagaaattaagatttgctttttattaggctacaaaaataaaatctaaacataaaacatttcatgttcccagtaataaccaatgaaaccaacttttcaacttcaaccgcatccttgagtagcaaaaatgttgtatccttcattttttacgcaaattagctttctttgccagaaatacaaaaataatggtttgttataacatgggaaattgaaccaaaagggacaaagaattagaatcggcaaatacccattatactgatcagctgcacgcatgctcttgcttagcacctgtccggccagccaccgcctgatgcatcaccgtctaaccagtcatgcactgctctacattagacaacatgaacacacatgaactgctatattactgagtactcgatttagataattactttgtgaatgactgaacaaatatatatataatttattcatggatgaaggctcacaataatctgtgctcaagaactaaagtactaaacaaatgaatcagaaagggaacatatgaattctcaaaagtgagccgatccctttaatctgatcgaacttgaacaattctcaaacctgcacaatataatttctctataaagtaatctggaagaggcatggcaactacaagtctacaatgttagtctgtatggagcaacaccagtcaccttgataggatatagcctgcaatgatgcacatatggatcgataagaaccgaat

SEQ ID NO: 39917 - DNA, 7955 bp, Oryza sativa
cagctcggcgtgaacgacccgcgcgcggagctgacggtggagtgcccggatggcagcgcagcctgcccgacgcggcagcggtgaccccgcttgtcatgggcggggcagccgagataccgtcgtggtggctaggtgaggcgcgtggccggataacgggggcgctggcgggtggcgctggtctggagcggcagcaccaccggcggtcagatggtagtgctaagggagctggcggcggtgggtcatcttcctcgttgccggtcggcaccctcacccttcctggagctcctccccttctttgcggagagtttctaggttggattgaggcggcagctcgtcagcgggggaagctcaggctgccgatgcaatgccacctagtcccgggttctcctttggccaaaactggcaaggcggccagcgggtggtggaacagaggggtcttgggccagctctcaggggtggtggttcgatgaagtcgaccgacgaaggggcgtcggtgcggtgtggtggatgctacgtgttgccatttgtctgtgtggtggttctgagttggtggacggcgacctgcggtcaaggttgtagagtcccaggcgaaagcctagtccggtggttcaccgggccggcagcggctacgtcttcgggcgtcgtaacctatttggggcattgtcgagggttcccctctccctttctcgacgagcttctctgggtgaaaaccacatctttttcagataggcgatggcggcatcctggatgtcgtgaccaccttggtggcatcgttttcggagcctcgtctctgtgatgttgccgttggcctagcggcgttcggccacgcttagcgggggtcgtttgctgctaggcttcaccctcagcggtttgtgcttgggtggtagtgtgtggtgtgtggcattgcaccttggtgcatttgatgtttttccttgtaacttttactccttcttaatatactcggttggcttccttcggccttcccggcgaaaaaaatatatctaattttgaaagttgtttggtgaaaaattatgggttttgtaatttcgggcgaaaaaaaatgaacttcgaccaatatttaagagttaacttgcatgcggcggcgcaaggctaattacgatgcagaaatccccttttctttcaactgcatattcctcacagtctgttcaagtcacagagacagacaaacaaaatagcagctcgtgaaccagcaagctataggtactagatagatacatgcatggtttgatatgatacagatacgatcacacccacccacacaaacacaccagtaaattaatataccagacagtttcaggagctacgtgtgcgtatcagcacagggacagaaacagcagattgatcacacaaactgcatatgcactatgcatatgccagagcagatatggctcctttattattcattcatcacacgcacggacacacgatcacacagatgataatagccaaataaatggcttcttagcagttgcaagggttgcacttgcagctggagccgcagccgcagccgtgggcggtctcgccggactcggcggccgcctcgaagtgcgccttctccggcgcgacgccgagcacgacggtggcctgggcgctgctgctcttctcttccaggtcagggtacatctttctgcaaccggccacaaaatcaaatcaattaattagcatctagtgggatgatcccgacatcaaaaggttgtaagtagacgggcgattaccgggttattgttgcataaggtcatcgaaaaagatttaaatttttttgtaattgttagctgtgtatatccacttggatatagaagccggatttctattcattttctttatcttataacaaaagttaacgcaagaaaccatgcgtgtaaactgactcatacaattacataaataaacaggtttcatgtgtaaaaagaagacagagaagtgaaaagaaaggagaagatagttgccgatcatgcgcatgctatttgcaagaaaccattaaagctaagcatacccgcacgtgcagttcgagccgcagccacagcttgatccacagctgcaagacatcttgtcgaaatctataagctcaagcaactcaagatgacaaggagatgaagggctttgagatgatgagcacaatgcatagccttccaccctgactccaccatttataggactggacggaggcaaagaagagtgtatccccaagcttctgcgtgccacgatgctatacgctgcctcgaattagtcgctgcagattattgctcctcctatggccatttctggtgatggaatcatctattgacagagaaaatttctttagagcttttggttctgataatgttatttatcattggccacataaatgattatacttaatcccaaccgatcgtgagagttggggttaaaatggcacaagatttttcttagtttagctcaaatgttagaacaactgaaagtaacaataactgaatgacacaatggccaaaactaaaattttcagtgaataaattatctattgtgaatttgaggcctaagagtaatagattacactcctaaaactccttttctggcgaacttattctgaagagagttctgcacgtctgtgtataaaaatgcggttgctttatgctaatgtaccaatgcgtaattgacttctcttcccttgttctcagtacaccagcaacgttaattaagatatatagaagatctagtaagggaatatatttgacgtcattttatatctatgacttctgcaactgcctacctgcaaagaaataggccttcttcttgccttaaagcaacaagctttcagataacatggccggcaaagaaaatagctttcagataatatctaaaatactcttgtatagtagataaataatcactttatcaatatcttttggcatactttttttttcttttgtcatactttagacaacgtgcaatctgtacatatggaataattcaatgacatctagttgttactattttatttctgaaagagagtatttatgaatggaagtactacttataagaaaatgaatagaagtactttcattgtgtcatcttagtttcccctccaacgtgcaggctgtataaaatgttttgtatgtgtgaggtgtcttttttgaaaccgagtatgtgcgaggtgtagtttggaaaggtatgggaagttgacaatttgcatgaatgatgtttgtagatgcagccttgaactcttgattactcataaatatacagaaatgctcattgttcatgtcatttctgaacaatcgtttctatcaagtatatattatttcagtttggaggcatatgcctgtctcaagcagggcgcatagatcacagttaagaactcccaacaaataataattacagagactgcttacaagaaacatttcttgtaacattcaacactaggcctgatgcaacaatgctgatttgtcagttttagttgaccttgctgtggcaacaatagaacttcgcagccagtacaagtgtacaacaacaatgtcgaaagagatatcctttttatatacatagtgatcatagagaatgttattacagtacgttaacaaagattaaactgaatctacaatcccaacaaactttttaaacagttaatggaggtatggaaatttgtgacacgtctccaaatgtactactacatccgtcctaaaataagtacagccataaatatccatgtttagcgctttgaccatccatcttatttgaaaaatttatgaaaaatattaaaaaaaatagtcacacataaaatactattcatattttatcatctaataataataaaaatattaatcataatttttttaaataagacgaacggttaaacgttgaacataaatagtgctaaaactgcacttattttgggacgaagggagtactctatactctttaaaagtccccagtggtggtggcactgaatctggcatccactattgttttttacttttttagaaattagctcctgatatcttctgatattatgaaatagttcaaatattcggttcaaacaactaaacaagtgatactaatatattcaataatattttaatatccattacatattataatatattttattttattcatagcaaaggaaggtattttgctagtccttcaaaaactttctaattgttgcgaaagttcaagggtgaattttacctatatgggcctcacgtcagcctgcaatcgctttctgggcccaatagtacgggccgcacgcaccccgtaatcccgttccgggccagcccaaccaacgcgggccccacgtcattccgaatggcccggcccaagtagaagactacatcgacagacgggacccacacccccacgcatcccccctctctcgtcgtcgtcgtcgccgccgcctcgccgtcccccgccattggagccatggatctggctcccggccgccgcgcgcgactgctggtggcgctggccctcgtcgtcctcgtggccctagccgcgcgatccggcgccgaggtcatcaccctcaccgaggagaccttctccgacaaggtgtgctcctctctcctctctctctctctcgtctcccgccttccccaccggcgacgatgctgttttgttctgtagatcactgaggttgatcgagctaggagagtccaggtcagtacgggcttgctttgttgtagaattatgtaatagattccggagcacttcgtactatagcggcgatgcttggtttcagacctgtagctgttgtattgcagatctattgacaattcaagtttgatgggcgcctgcgcgtcagtgttacttcgcctctgggatggaatcattggaatgatggattatatgagcgtcggggttttaattatccggtttcaatcacggattgggaatttagaatcgggtcacagtgtaaacttttgtcttgttagtttgtggagaatagataccattgctttccaggttgcatgtttgatactagtaaaaaaaaagggtcatagagagccactgctcgtgttcctatgtttttgcaagtcgttcaccgttgtggcgtgatgcttgtatttgttccaactaagccagtttgatcatgagcaatcctctcatttttagataaaggagaaagacacggtatggtttgtgaagttctgcgttccatggtgcaaacactggtaaatctcactcttagctccatgatgaatattgaattaccgtataaatcttgtcattaatggcttaagctaatttgttagatgcttgtcatttgcagtaagaaccttggaacactttgggaggacttgggaaaggttatggaaggtgcggatgaaatagagatagggcaagtggactgtggtgttagcaaaccagtatgctcaaaggtggatatccattcgtaccccacattcaaggtgttttatgaaggtgaagaggttgcaaaatataaaggtaatcttcgtttatgatgcaaattattctatcttgctattgtgtggaaaggtcagcttaatctagtttcaactttctagtctacaatgaaaattgaaaaagagaaaggtatgtttggatctgttagattttctccaattctcttgaggtttaggccatgtgttggaagccatatccccctgcagtctgaattaaagactacaaaccatttcaactaatagaattgtgataatgccaagccccacaaaaaaaaaaatcgaagaccctagtgtttgtttctcaagtgccatttttggagtagcaagtagcatcttctgtgaagattctgccaaatctgctgatgaaaacatttgattatttctagtatctgccagcacttgattctcctctttatatttttccgttgcttgaactcgttatattgttttgtttatgattttctgctcatgacatgacttgttatagttgaagcatgccaggatactgattgtatcctacaattgtacggcatgaagagcatacattacctctagctctaggaaactatgcatgtgctctagtatctctgtcttttcctgccattccctatcttgtgaacattggaatgttactcattctgatacctatcactgcaattcacaacttagagcttgatcttctgctaactgtttgtacttcagaaaatatgcaagtttttttctgacagttatgtgcgtactaaaatgcagattgaatatattgtcatctttttcatcgctgtttcaccctatcttttgtagctttatgctttgttactgcagctttgaggggcaacttctgtctgtccttcatctgaccacccacctgctcgctgatttctgttgttaacgttagatgcctcctaaaggaaatccttgtgatcttttgtgctactgcaggcccaagaaatgtggagtcactgaagaattttgtttcggatgaagccgagaaagctggggaagccaagcttcaggacagttgaactggagctcaagtgttccatcctaccacagttaagcaacaatgtagtactgtttgacatgcttaaactttttgatatagtgagcttgtacttcctcctggcgtttagtagaatgttaaccactgcatgagtcgcatgaaactatgtaattttctgcttcatactgcattcaattacagcatgctatactataaagaagagttcatggaaaaagcgcctttttttttaaaaaaaaagaagaaggcatcatagaagttgcattccatgccattcctgattgcctacaattggttgggacttgggagtccagaaagaaatacgtgctgcgtatattgcttatacgttcatcttaacgctaaattgtttctctctacttggcagtaaacgcgtaaacctttaaccccacgacgaaccattgcaacacataacacaagcttaggcacgaccattctcgatccgtcgacgtcggccatcgtttatggacggactgtagtgcgtgagtttgtgattttttcaatgtctaagtttgcacgagtactgtgtaatgatatattgctatcgctacttcgttggcatgctttctttgtttcccctgtcctccgttctgcaccataatcccatgttcttgtttaacaaaaatcaccagagagaaatcgtccaccataaatgtagtgagatgcgtggtcatggatgaggcagatcaaagtttcaggttcagtctggggaaaatcacttcgatataagctgagatttgatttccttttttgttcagcaaaaataacaagtgaaagcagaaaaaaaggatgctgtgttctaacaatagcatgacattgtagcgccgacaatgtgagccgtttagtaaatcactagcattaagtactaagaatagaatcaatagcaaactagagtaaaactgctacagtgcttcggaatcacattccattgccgataaaacacaacccagtctgaactctaaagcatcgaaattttgccggagctcaaaagtgaagacagtatttaaagatgtacttcctccgttttacaatgtaagtcattctagtatttttcacattcatattgatgttaatgaatctagacagcgttgtgaaacggagggaatagtaggcagcaaccgctgcgatagactatgctgtaactgtaatatacaggcagaagtccggtgtagattagtggacaggtgtagagattcagaattttatttctgaaacttagattcagacttcagaacagaatcgatcatgttcaggaaacaaattccccggggaacgagatgagaagtaaatcttgccaggtgatgcatattcccgggaagcaagcagttttttgttttctctgaatatttgctgataaatactcctacgtatctatcgtcgttcagttacctgtcgagcttgctcctgacatgaccatgcaccgatgcacatgcccgtagcagctcgttactgcagatcgaaagcatagcagcagcaaagctcgtactccctccgtcccaaaa

SEQ ID NO: 39918 - DNA, 1381 bp, Oryza sativa
tactccactgcattttcattgcctgaagaaaaaaaatcaggcctatttaattccgcgcacgattgcgacatgccaactacgatgaacgtactcaagacccttgctcttaatgaatatgttcagggaccaccaagaacacggcctcatgtgtttgtgtgtttctgaagcatgtctgtacaattgtcccaagcatgaaggttttttttcccttggcaaactggatagctgtggacctgtggtaacttctgaagaggaaagaacagtaataagaagaaagcacggtcctttttcattgtaagtggatttttgaactattcattttagtctcaagagagacactccgaggggttgttgtgtgtaatcacctaaaccctcttgaagcaaaaaaaaaaaacagagaagagattatacatatatcacaattttcaaagaatagtaaaaaaaatgtacattatgatgatatcgcccatgggagattaatcaatcccttggaaagaaaaccagaattttttccttctttgcagctagtaggaaatcagcagcttcaagttgtaaccatgcatgtacaatgtacaccctcctctcctccggctcgtccagtctcttctacagctcatcgttctatcacctcttgttctgaggagacggttgcgaagaaggtagcggcgtcgtgttgacatgccataccataacctctgaacagtctgaaggaattcctctcactttgctataatcttcaaggaccacttgctgtacgaacttcaccgagtcctgataaaacaatggcaccaaaaacatgttagggcaacggttcatcatgcagcacaatcaagaaaaatgggtagacattttggcatcagaggaagcaatgagcaatgcagagaaagaagctctaacaaccttgcatgattgatctcataacgaaagaggtgcttgctttagtggttaggttcaagtaataagatgaacaatcgattgtacacctaaaagaaggtgtgttttctcattaaaaacaagggccactgtactgctctactactgctaaccacccgctggggcttgccttgcactggacttcatcaaagccgtacactatcctactcagccacgggacccccccccccctcttccttaccctctcccaccaaattagcaccagatcagactaaacccacgattacgcatttgcaaaaatgccgctcaagattcgatccgtttttttgtcgattgctgcagaataaacaatctctctctctctctctctctctctctctctgtgggagaaatgatcacctagcgccattgccattcagccatttagctagagtgggatctttttaatgcagaaaaatcaggttgagactggacaggtgacaaggat

SEQ ID NO: 39919 - DNA, 16315 bp, Oryza sativa
agaataacattagagcaagtataatagtgagctataagcctagtataaacttatatggaggagagatgtgacaaaaagttaagggtgttggctctcatgcaagagctagcttaacataagctcctagacaaatacaattaatgtataagtgagagatagagagaggagaagaaaattgtagccaaccttataactaatctattatatgtgttggctttaagattggctaatagcatgaagtcggctctattattatccttgctcttatggatgcgggccatgcagcatgcagctaaaatgtcgtaaactcgagcgtcctcaactgtcgatgtcacgttgccgttacgataacgcaggcccctgcggactagaatgtcgcgaaatcgattactcgattgttcaactgtcatgagttagttttcgatcgagctgcattttgaagaaacggcgaagggcactaactggttagcatgatagcacctaattaagtagtactatgtggcacggataggaaaaggaaaaaacataaacggaggggccaaagctaagttaaatacgctcaattcagaatttctgtagcgttaggaatgctgaaatttaagggtttgttcttttctgattaagattcagattttttttacctaattacctaaacctcatcttgaaaagggtaccactaactgaacaatcttcaagaacaccgaagtggttgatgagactaccctgtcacgagccaaatgaacctaacacaatccagagcgccgcattggttgatgaaactgccctatcacgtaccaaaacgaacctaacacgatccgctgaaaatcactggcgatgtattatgcgccagccagccacacatccctgcaggatgcagcagcaagagccccgtgcacgtactgagaccgccttcccttttccctcccagcaaaccgaacaaagaaaaccatacgcagattcgccctgcggctcatgcaacggcccgcaacttgcagagatcgacgcacgcacgctcgctgctgctgctgctgaactcgtgattcaagttgacagtagtacgaacacgcgagcccaatctgcagggacggcttatgcagcatcagccagcgaccgaccacgcattgtgctatcgcctcggggtcctggagaaaggacagccgcgacggcctcccctcttccgttagttgaggggtgccaatcatttctgccgacacatttggacatctgctacgctaaacaccgccacggcggcgccacaccaacttaatgctattggctgagtacacatgatagtagcagcagcagcagtcagttctaaacttgtactagtactagtatcagtaaaaacatggccccaaaaggaaaaaatgagcggctgcaagaaaccaaagcagagaactgctgctgcttcagcggtccaggctgcctgctttgcctttcgtccctaagatctggcaggcgcggcagggaggataaaagaaggaaaaaaaaaaggaccatggaatggcggatgcggggggagcgcgacctcctcgcgtcacatggcttggattctcctcgccggttaaactagcgcggcgcagcgaccaccaggtggtgcatgagctgtagctgccaaggcaacctgacaaagttgcttgcaagtagcctcgcttgtgtgctttgggcgctaacgttgtttactggctagcgtttagtgtgtgcgcgctacttgcttgcatcaggagagatggttaaagaagagaactttgcattgtttaactcggcgaaagattgcgagagagagaattgtttttttactttgggggtggtttggatggttacctgatctgccggagctggtcgaagaagcggaggtcgaacgtgtcaccgaggccggcgaagaggacgacgccggcgaggcggtggtgctcgatgtgtccgagcgcgacgttgcgctggtggtggcgctccttgcccgcggcggcgtcggcgacggtgaagttgtccttgtacgtcaggtggcggtacatgagccccgtggtgcggagcagccgcgcggtggccgccacgtccgggttggcctccaccaccacccacagcaacggcggcggcaccagccgcagcgtgtgcgccatcctcgtcagcgccgccgcgcgctgcccggccgccgagggcgtcgactccgtcgtcgtgaccaccaccagcagcggctgcggcccggcgtccaccgcgccggcggcggcctgcgccagaaggctccggttgacggccgcccggcccgtggcgtgcagcgacctcaccacgtggctgctccccaccccgcccgccgacacggctgcggacgtccagtccgacacggacgacggcgcgaaccccgtgaagaagcccatgacgaagcacaggctggaatgcagcagcgccttcttccacagctgcgaccccgaccccttcttgcccctcccgccggcgccgccgtgctccgtggaccaacccatcgcccaagagacgacccccccccccccccaccgcctcccttcctccggcgccgccgccctgcttgcagtagtactcctccctgaaacaacgcgtggcgcggcgtctcgcgtcgcaccgtgccgtagcgaggtaagctagctccgctgctcacctgagcgcgcgtggccgtgttaggcgggggagcggcggcggtggtgttggcgttggtggtggtggggaggcgaaattgcgagtggtggtgggtttaaaaagggcgggaggtggcgagcgagcgagcggcgcgcggcgcgaccgcgcgcgagagagcggaaggcgatctggctcgttggttgtcacgtacgcttttgcccctcttttcccgggacgcagcaatcattaggtggcgctcgagctagtgacgcactaatgactcgcgcacgcacacacgatcggctgcgtgcttgtactttgtacccgtaacccgtatagtaaacagcaatagtggtggtaggaggagtagaatatcgtatctactatattggtatcagtacgtgtgtgtcgtcgcggtggactcgccgcgtggtgttcccagttggctcgggttgaatgaatggctagtggggtgccattcatgtcccctcgctccccggagtgctccaccgagcacaaaaaaaacgtcgggactcgggatcgatcgatcggtcgaccactgtgcggtgcacacatttaggagtagtccgttttctcgacctgtgtgtgtttaccctgcacactagcgttgcgtgggtccagcgtttggtactttggtgcgtttattactacagactgcagtggcggccacaccagtgtgtttggttgggtggatgaatctggatgggagatggccgcttgatttttctgtgttgtttggttggagggcaggatgaatggggcggcccagaatagggaatattctctctatatgctggatgagtgcatccggccgatttggctggatgaagccatccagttttggtctgggtgatgtgtcctgttctgattggctgtggttggtttgattttctgttaagtaagctccaaatgactttttctcctaaaccgtttatctaatttatgattgattacaccattatatttgttacaattaaatctttaaaacaagatctcagatgattatattttgataaaaaaatatatatgacaaatgggtcgcactaacttttggctttttccatccatgctatatccctccaatcaaataaaaaattggattgtcatatctatacaaaccaaacaaaaaactggatcgtcatatccaacaaaatataaaatatagatggtcatatcccgtttatgcatgaccgtgaaccaaacacaccctaagctgccgcgctgacgggcgccgggcggttcgcttgggccatcgcgggtagtggaatcgagaagcctctctctctggcgctcggtggttgcgcgttgagttgcatgcggcgctcggtctttttccggcgcgggccggggtgatgggttccagttggtggtggctggcgcgcgtacgtacgcgcgcgtcaccgagctactcctattcaattccggtgagagcaacacgacaccgggcagagatcgcggtgggcagctgttctcgctcatctgacctcacaaaacagccgccgccgaagccccgaagctgcacctgcatgcctgccacggcgtcagaaagtcagagcgttcgaactcgatctgttctgtcgtggcgttcgttcgaagaaggtgattggcagccaccgactcctcctgggtgctggtgaattggagatgttctgagcaagtgggcccggactggcagtcggtcttggtttaagcggcacgtgcggttatatttaggtgaaagctattaatctcgtgcttaatttagcgcgacaggatgggtctctagcttgttttgtttatttattgttcgtagtatgcctcactattgagttgtaagaatcttttgtgattacatgtcggacgctcacacattcacgcatatgtccctaccacacgtttaaagagataaaaaccactgcgaatcaaatttctggactcactattgaaaactcacccgtgtgaatcttctccgttagaaacttgtgcatatatcgggaccggattgactttggtattgtaggatttattcactttgttgctattttcaaacttatcaattttgggtaaactataaaaaaatacacatgcattgcaacgggtaaatgctattgtaattttattattgttatacagtttagttagggtaaaattcactataggaattcgcttggatttttttttcagaaatcatgagctgcaataagaagtctgtattttatctcaagttagcatgcgagttttttcaaaagatttcttatacgactccttttatacttccaaaaggaaacaagcttaaaatccaactcaaacacatatatgtattttcaaaagcgaatgcttaaaaaccgactcaaatacggatgacgtacaaaaatactggaaaaacatcttcaatttttatttttggtaaatttagaagttcccactctaaaactcaactaacatttgatttgaattaaacccaaccaacctcccttttacctttttttttaaccttcaaagactagattgatatactatgagcatctctgaaaactgtttctgcatagcttgagttctataagttcacactcaaaactcaactaaaatttggtttgaaattgaacaccacctaaacttgctttaacttgcccatttttgacctctaacgattagaatgatacattttaaaattaacggagtcaccaccgttagattatatggtagttagatatatattgagatatgattaatttgtgtggactcaatccttatctactctacatgtattcctatatattctctccatcctaatatgagtacaccctaatacaaatgtgacatggcggatggagtatatacttttttttaacgaatcggcaccagactgtgcccatttcattgaatatagtgggaaaaaactgtacaaagctaaaactttggaaatttacataggaaaaggagaaaaaaattaagggtttatctcggatagcctttttgtgatggctagggtccaggtcttggtctcctcctttatctttgcgcagagcgatagtgttgagagttcactgggttggaaaattctttgatttctctcttttcaaatctcccatgtcactagcaacaaaagggtgcaaattccttttctcggtgtccctgggtgtgttgctattacagtccaccagtcttggggcgacataggctgagcccaattgcccgatttgacgtgctcttgcgacgtccaggatgccagattctcctaaatcctcctagagtatctgaggtttactaggaggtggaacaccgtttcccgagtatgtctacaaagcgcgcagaaagtgttgttcggacatccacatgtagtcagtcagtctgccgtccattgaaagaataatgagctataaatatgagcagccatgtaagtctagaacttaaatccggatggatatgttccaccacaataaaccttatcagtactacgatcacttgtttgttagtttgacgtacccattttagcaataccaaagtttcaacaaagtgaaaatgccataaatacaacaaatttattttttgcgggtatgcgtgccattttaatcaggctcaaacgagcaccggttctttccctcaataactcaatccataggtcaatactcaatatagtcatatcacacacccgatgctccattgctgtgtcttggaaacgaagcaagtaattggttaggatggaacccatcacctaaacagccacttttcacccaaaaagagccacaagaaaagaaccgagccaacaaacaaataaccaaagaacaaacgcaacaacatataatttccacggatcgaattcattcacccatacggccctacgcttagccgtgttttaggattcaggcactgtaggccggccccactgggtagtgacctgtgtgaggtcaattccgataaagcacatggatgcaccaaccagttcgtcctttttccatctgcccaaaattaaagaagaaaatagaaagtgaaacagtccggctggccatgcaacacgttaagagaaacgttcctttcgcagcttctctcgctgcagaatttttccccccttctctcttcagtttctgtcggtcgcgaccaccagcagcaggcagagagagagagagagagagagagagagagagagagagagagagagagagagagagatagatcgatagacgatgccatcgtagtagtattatactgctacacaagttatataatttgacttgtgtggtttgtttttttctcaaagacctcaacgacttcgaaaaccttttctcttggatcgcaacgcgtgtgtgtatgcatatatatgtacgcacatgtgcccgagagcttagctgttgtttatgaggtttcgtgctggtttggcctcgcgggcggactcaccgacgccgccgcaagttaattagctggtttaagcacacgcaaatgatgcccggtttttgggattaaattaccggtttcgtctaagcttaatctgctcctgcagccagccagacagccggtgagccggccatgccagtacgccgtacgcgcacacatgagcggattactgcataattctcgcagatcacacggcgggtacagcgttttcctgtacgcgtatgagtacgtgtcacgtgtgacaacttgtcccccttgcgagaattctctctcgagattattggcattttgcgaaggaaaattggatgctcataattatatatttgtttggtgatcagcgagatattagtggtggtcgttcacacgaagcggtcgatctattctaagcatcttgacttctgcattggcgagacgatgtgatgtgaacagcggcgaggggtttggagcaaattaagctaagctctccgtcgttgggccatcaattttgtgatttgtttgtccgcactatgccgtggcaagggtcgtaaattagcgtaagcgtcgttaggtgctgcaccttcacgcacgctacgttttacctactggtttctccgtaggttattactgaactgttgtgttgtgggcgatggtattgataaaaatttgttgcagattaggtccaaagtttttatgccttgtttattcatgtgtgtatgatgctctaacgaatacagggacacttgaagaggtctttaggaaaagaaaagactactacttttgcagaacttttcttttttagaaaaaaaaagatcggtcgttgaacaaattgatgcggcactgtctcatgtaacaattgaatgatgtaatactgtaccattagtaaagttatatctccgtttgtcaattgccaaagagagttctactaagggactacaataatcacttgacacctctatttgttatataaacgttttatctatttataagttggctaggagaaaatattattgttaggatcaaacagaggaaagtcgtgatgctgcaggtgaaagagtgatcactgaaattaaatctgtagatcgaaacaaaaatgtcctcggcatcatatgccaacatcacaaccagtattgattccacatcaaaaccagcaggcattcggcatattactctcaacaaattgacagtgacaacttccttaatatttgataaaataaaatgaagcaatcaaataatgactaaatagtacttaatacgataatacaactaaaaaaatactcctggttactccagagcgaaatattagagaagatacacagcgcaaactaggacaaatatatgtgaagttacaaggcatgaaaatacgttagtagtacatcctaaggtaaaagaaaaattcccatcatgtagcaaatcaatgcaacctagctaatgacgcaggattaaaaattgctttttactggcaatttggtgcacttatgcattgtgccgtagcttttacatctattcgccatacttacatcaaacatgacagcaaagcaccctgaaaaactcatttgggtaaaaatgaggggaaaaaacacgtcagttcttcacctattctcctgtttaaatattttgcgattgcagattacatactgaacaaattacaagacttcagatgttagtttactctaaaatgtgctacacatttgccttaagatttttgaacagtttgaaaccccgataacaagcaaagatatcctaaaagatcacatttctacacacgtcaaggtatgtgcatacatcttttgtcccttcagaccctgtatattaaggccccaaggtgtaatgaaatgtcaaacagagcctctatcatatggaccagaaaagggcaacatatgtgcactttgaaacgctgttactggcaccgaacaatgtggttcaagtttcttcaggcaaaactctggctttgcagtaatgccattgaactcgagtactgttagtattgatgtagcacgaagtagaaactaattttcctcatgaagcaacacatcctgagaggaactccaatataatttcatccaagagatcaccatgtaacatcttggctatctgctttcccaccgtattgatgtcctcaccaacttccagccattctggatcaagaactttgtcatcaggatgtcctactgcaagctcttcctgccgcctgaccattgtttgccaaaccacctcaacaggcccttcagggccccaaacaggacaacaccgtctactggatttccatggtgcaaggatctcagaaagaacagtatttgcaagatcaaacagaagcctcctttctggtcttggccatgcagatatcttattgtacttcctctcaagcctgtcgaagacctgaggtccaacagggcaaccaggcgagtgccatgacttgcacaagagctgtgagtcagcgactatcataccagagtttataagcatgtcaaggagatacgagaagcccctttcctcctcaacctgaaaagcttccagagaccggtaagaagaaccactgtcatcatcacttgacaaggatacttgttcatatcggagctcacagtcatcaattagtttctcgacatctgaggtcaacacagaagattcagttattttaagcagactcaatctgaatatttccaaatattaaatggttaatccagcattgaacattccaagtgaaactctcaacttaaaattttgaaacacaaacaagaactttaaaagttttgattcaaacttttaactaaactttactatcagtttagtgctctgaaagttcattgattagagggcaataaacatttcatagcatgttgagccttcagctggatgattgaaaagttagactaaaaggatgaattttcaaatttgtagcttttagcttagtgacttgcaaaagaaaccggccattagttagttaactagtcatgattgctagacagcaaatgcctttttagtgtatgctaattacgcatgatgctccagtcaggtgctatagtgatggtttagcttgagttcataaatatttgcatatttgggacaattgcttatttaaccctattttaaagtctaactaccaatttgaccctactttttctagtttgcttattttgaccttgcttttcaaaaatgaatatcccgtctgaccctgtttccactgcaccgttaaggtttcattttaaataagaaaataaatatatttacttttcataatgaccaaaataccctcaaagaaaccctatccattcagatccggtctcctctcatatcccgtctctcttctggtgagtggcggcggcgacggtggggcccagaggaagggatccgcgccagcgccggctcgtggagggagggcgcggcaacagcgccggggcacggagcgatttgcggcggcgccatggatgccggcctctcttgactcgcaaccatcgtcgtcgagacgcggcgcacgcggttcgagatggttcggctagtcgccgtcccggcggccttgcgtgtcctcgccacggagtagcacgccgtgggcggcgctcacgcccaggagctccgcgagctggaggctgcggtgggctccactggggtgctgcggtgtgcgaggaggcggaggcggcaatattttagcaactctataggagattactgggtatgcaggatctagtatgcaaatcaacaatgattcaaatacatcagtgaactctaggcttcgtgatgaatctccagttacccttgagcagcatttggaaaatgtcaaaaccttttgccaacattgtaaaagatatgggatcttcaacacgtaatacatcaagctctaaagtacttggtaggagcaggggctgtaggtcttttactggatctagtttgtttgaagatttggagaaggacgattgcaccccaccagccaccaaacagaagtttcatagatttcgctgtgagacctcaaaattgtcaaaggggatctgcactgaactagtatgatgcagagagtgagaccctatcaagggcagggttctgttgcaggcgacacagaatttactgtcataggtgaatttgttgctgaactgaaagaaatgtcacaggttcagtatcggaaggtcatgtgagtcattggaaatgttatcttattcctgttgaggccgcccattctacttgtttgaaaacagcacacggttatggtgcttcacatttttaatagctcaggagggcttattataaactaaatatactcattgcactactttaagatatcattgacatttaattatgattttgttctttgttttgattgccagagtggaaatggagacttagtgtcaattaaataagcaagatataagggtcaaataagcaagggcaaaagggactatttgccccttacttaacaccgttaactccctttaatggaatagggtcagataatagattcatttttgaaaagcagggtcaaataagcaaactacaaaaagtagggtcatattggtagttattcttcgaaatagggtcagataagcaattgtccctaaatatttgtatcaacttctacattgttagggtagctggtaatgcagttcagacctctttgaaacaagtaaattcctctatgaataacagaatactccagtgttccaaatggggccagtttgtctcacttactaggcatgtcttgtaagttacacttgaagtatccggaacaacaactgtcttcatcagttggaggctcaagaatggacactgggcttggttgcccaacctctttcaagcttttatgagactttgccacataactatgatcagaaacagttattgattcataatcacggcaattgaaaggtgatgctgaaacctaaaaaagggaacacttgagtgagtggtacaccagaaactaatgcatgaaaattgattctctcccagtgcgtcattatattgataaatgaaggcaaagtaaagcatcctagtactacataaaccaggtactctaacatactggaacagtacacttctggactcaagaaaaggctaaagaaagagaacctactattttcaaagaaaaaaaaatcaggaaaagagcaattagaggctggatttatttccatataattatcaaaaaaagaaggaaaagagcaatttcgatttctgggttctcattagaataccttcttaaatgcttaacactttgagatatataagaaataaatgctcaaacattaaacaaaaaaccataaaataagaatacgattcaggaacagtaattgaaacatttaagtttcttaactttgtagtagagaactgcatcatttagaaattcatgttcacagtatgcaacatttgagcaaatttcctcaattaactctgtttctgttttgaattacagaagttgttaatataagggcctactgaccttttcttccccacatgattcaaatgaagaatgtacagtttcagcaggttttttcaccaagtcctcatctgttgtgaacaatattttctcatttatgcagtcaaacgttgaaaagttgtcagttgaacaccgcgaatggtttcgattatcatgagaaggggaagcagatctatgttgccgcaaggtctgatgtttcgcacaagcattcctcaagttatcttggctgggacttccaatttgctgcagtcttgatatatcgcagaaagagttgaagtgagactgaccactgtggtaagtatttgatgtatttgggataaaattactgtgaggggaattcttgtccaatgaactgtgaggatgcaatcgaggtgcatgctttggcaaaactatgaagcatccttccttgccattgctgttgccccggttaagtttattgtgtcgaatctgcgcatgtgagtcggaatctctctttagcctctctgaatcagataaggcaaacatctctgcaagagttttcgaaccaacactgccttcctcatacttctgacggtttttcctgggtgagctatttgatgatggcctgttgctttgtctggagttaacttcaccactaacacagttctgagatgatccagaactactcgtatccggtacgttatgatgatcaaatgatgactcctttccttctaacagtgaatctacggcattcctactcaagtatctttctcgttttattctagacacatcaacatcttcagtgtctaaaagatttggtgaaaccctccctctattctgcaaagaaaaatcagcctgctgcatctctctcctgaaattcttattgatgtgagaggggtctggcgtacaaaaggctttccccgactcttggactttccctaagcctggctccaaaacaacaatgctattgaaatcttcaagctttcctcttgatgaatttctaatatctttaagtgaagtattacctaagccagcagggtacttcctgaaagtacttgaagtctctttctcatattgatgctttgcggaataattcatgtcatgggggcgcttctcaaacaaaggattgtttatctctagcgagtttaggcgatcaaagccatctcggcacactacattgttatcgaatggtccatcgccatagggagacatcgatggcataagcttctttaactttaatgcacttcgtttcaagcttggcaatcctttagggaaatgatgggacctctctttcacgatagcctcctgtggttcctctgacacttcaaagacgtccttgaaatcttggtgccgattgtgggttacataagcaggtggcaatacatcaattcccatcagttttgcaatcacactaggtgacgatctcctgtgctccaattccttcaatagatccttcccaacaagaattttggttgggctgttatttcttcgtggcctgcactccttgtaccgatgcccaagctatagaagttgtccaaaacaaaaaaggaagcatatttctcaatcttaacttttgacttttggtcataaggtaactgatttgaagaacaatacaatgaacagaaggaattaactcactgaaatctgttccatcttgaagattactgtatagagaatcagttgagatgagaggttgctacatcatctcaggtgaagtgctttatgcctacatatatccacagaacatttgtaaagttatgttagttctatgtagagcagatagaaaatcagcacaacgccactcaaagtagatggtttagtacaatgtcactcagttctccaatatattagttgacttaggctgcactggtattgtaggggtggtgctcggcctatcaactatgtggaacaagttgagagaaaaaaaaaagacccaacagctgctggtcaggatgaagtgatgaacatgagagcaggctgattaacacaacactaaaaatgcagcaagcctgcatatggtgtattttccattatgaactatatgtgatggctcaaacaaggacagcttgcgattcccgctactaatagactcaaggagccgagcagtctgtcctgtagaatctcaatagtaagtggaggcgcatcaagaaaagcccaataaatttaacaaaaaaaaatgatccttcctgtggcatttcctcaaatttatacttgtttacaaacctatcatttttctcccttaacaagtactccagtatgctaaatgaaaggatgtctccaccccaaggtttgatcttggtgtccacaaatacagttgtgtgcaagtgcgcaagcctggttggtgcagaagaaaatgaaaggggtgactcgcagagtaagccaggggcggatccaacttgggacatggggggttcagttgaacccccaaacttttgggggaacaaacaaaactgttacaatctgtattaagggttaagagcttcttccagatctagaagagaagctagggttaacgcaagcaaattcccagacaaaactactcccggtgggagagagatgaatcagaaagagaatgtgaatgctcaccaagatcccctcccctccccagctctcctccccggatggagatcggcgcctctcgtcttggcgcaaggagcggacacgacgacgggaacgggacgggagattttctttttcttttatacgcatgtacctttagctaatctagttctaaacaaataaaatcaccatgtagaacaagaataaactacgcaaacctatacacacgaacaaaccaactaacctcctgtcaccttcaccgtcctgaactcctgatctgaactctgaaactcctttgaaccaacagcagggagagagggagagcgagagctgcagcatcagggattcgctcgcagctgaaaaggaaaaccacccagaaaaccaaaccgtcgccgccgccagaaacgcccagcgcgtggaggccaggagcagcacaggtacaacggaaaaatgcaatgcggtgcgaagcgcgcgcggtggagttgctcctctcctcctcccacgaaatcgcagtctttttctccctacttttctatgccctttcctctcttctcactgcccactgttcggttttttggaggaagaagacgagctcagagcacaacaatggtttgggacctccacgcgactccgctacacggccaccgctcgcgcctccccacccgcacgcggcacgtcaccgacatgtgggtcccgtaaaaggtgtgacccacatgtcggtctgtgagacaagtggcaacgcggggtacacgccctcgcaggttgcgagtacttcgccggatgaggaattaaatggcggcgtttagatgaaactgattaaataccgggggtggcgcccgcgtgcgtccctatgcccacccggaaacgtatacagatctgtggaacactgacactgggcaagcgggcccgagagatccgagccatttcgcggtacggcctcgccttgggccatgaggcgcaatggtggaggtggtgataccgtgctaggagtgctaatcgtacccactcccgtgctcccctgcgtgctacgcgatgtgtcgtactgctgtgcatgagagggaatcttgctgtgggcagtgggcacaccagagtgcaccccgtcagtccccgtgccgggtgtatttacatgtatgggtggatggagtagggaaagtaagtaggattggagtgctagatggatcggtataccgatctgaatcattctccagaacggctttaatttgcggtgaggttgatgaggttggggggccgatttccaggtcagttttatttgtctaattatgtttatggtgttttgtcaggtctccagtggaccagttaagtgcagtacagtgctgttggctgctgctgcctgctggtggtccccattcagcaagtggaggaatggatggagtcttgttgccgcaa

SEQ ID NO: 39920 - DNA, 2783 bp, Oryza sativa
ggtaagggacgattgatgaatagcttctgctcactaatctgatagtggtatcagatggttgtttggatctctgaattttttttggtactcggagcaaattaaacacatgtcgttatgatgctgtatggtacaacctcatatgcctatgagatgttagacgtagaattaatgtcaataattttgttgttgagtagtactgggctactggcaattaccgttaagacatcttacataactcacacgatcagtactaatgaatcagtatagggtttaaatgaaccaggtattagtcagatattgtgcaacaatttcctagattaagtgcaaatttttgccatggtaattggtaggagtaaatactaaatttctcaggggaaaaacaacactaactccttgttaattttaccttatatgaaatcagctccgacaaaatttgaattttaaaacttaattttgaaggttttttaatcaaagcttatttttcaacattggctaggaacatatatcaaaagttttacaaacaaattcatttgctaatagtcatacggcttgcatatgcccaaccgataggggctaaatataatagctcttccgccctactatgtttgtcctagcctcctcctaggtgtcaagcaagaccaagtgaaaatctagcaatagatggaagctagtgatgcaagcgttcaagttcacactgatgattttaagcccatttcctaatagaaattataatagattattgcaaatattccttacaaatgcgaataaactttgagttactttttaagttactttttctaaggatgtgtctcaaattctcaagttgatattgcacagtagaacactttttcaaggatataatgagcaatattaactaatggtcttgctgtcatcttatcacatctttgaacacatttgaatcagttgaccttgtccttagatgtgttatatgttttcacgtgcagctcaaaaccagcatctatttaactctggttagttcaattttgaaccaatatcatctaaagagaaatgggttctcaaaaaaatctaaagagaaatggagtattacgcgagtgcgcggagcaatatacctttcctatttcctaagcacaaacatgttgggtactcgtcagttagcttcagcccagcgtgtatgctccaatcttaattaactccaacacaaagtagagtattacccatgttgtcttctgcccttaattagttgctgacatcctggaaacccatttgttttcttctgaattctgatgaagtttttctcggtactaagaaacaaatctgatctttcttgtccgcagcctggcattcacaagtttcttgtgcatgcagtagctgaatgctgaattccgacgacccacacagcttacagaatgccctcactggaaaggtagctaagctaacaacaaaacaataacagtgccagtgccagtgcagaaaatgacacaacacataagtaaaacaaacacaaaggcgctggattactagctcattgagctctgcgcctctgccccatgtgtgcgtccaaattcctgtgttgtcccaaccatgagatttgaaatgctcgctatgcttgaagtttcccggggtgaaagtgaactgtagcagtagaaatgatagagaaaagagatatgtgcttttaccagtttatcaggatttaagagtaactgtttccctggactgaagggagaaaaaggtgtgctgtcatgcgctttgcattgatagatgtctgcaatgcagcaatatacggatttttagtcttttcttcccgattaatgtagaagtttattgtctttttactccctctgtattatatatagtcaaatcatagcattccaaaaggcacttaagaagaaagacaaaggcccaaattgttagaaatttggtcataattcgacacattttaatccaaaatattaagacaataaacatgacatacacaatgagaagcaatctagtgataaggctaaacataacatatgagcatgcttaaggtaaaataagtataaacatcattgatattcacataggattgaagtcctatggataacattatgaacatgtaaataacaagaagaaaatcaaataaagttagaatgttataccagagaacggtgcagaagatgttgaggcattcgtattgcctccgttgatgttgtctcctccgttctctctagtagaagccatggtgaagcagaagcagggtgtaacaccctgaaaattcgaccaacgaaaatcaaaactctaaaactatgggccttcaaattttttttaaataaattgcatcatgccgattttattcgcccatttcattggaatttggtttcgaagtttatagatcgcgaatagagaataattgattaggaagaaaacctaaaattaaacgagcaaaataaataattgaaatataatttggaataaagattaggtgatgttggaaatgaataaaatattatcgcgaccatattagtaacaattgaattctagcgcgattgaataagaattaattctaattaatttcaaagaaaaaaattatataaaaataaaatatgggtactattaatctagagtaaatattttgattgaaataacacaagtattatgtaaacgtcatttgtggaaaattaggaattaaaggataggatttataaagaaaaggttaaattaggctagcactgttcattgcactctaggtgctcgacgaggttccctagcccttccccctcccctaccgtgcgcgcctcgcgccccgcgccgctgccgcgccg

SEQ ID NO: 39921 - DNA, 3664 bp, Oryza sativa
aggaggagagaaaaaaaagaaaagaaagagaagggtggagaaatagaataaaaacaacatagaaattagagggagattaaggaggattagaaaatttaaaataattagaaattaattatagattaattaaaatgtaggatttcaaaatattactataattataggttatttttggtaatctctataagtaatcaattcgcggtaggaaattagatttatttaaagaattaaacaattaggttgaattcttaggaatgtacttctaaatcacaaaatgacttaggttaaaagacccaacaattcgaataaagtggtttcgcaaactttgtagtcaatatagaaagatcgattcgcgttcgactttttgagttatttggattttaattgaattctaattgaattcaaatcatttcctcgcacgtaattttagagcccgagggagttgcggatccgagcgagggtcaagacccgcaggactacgagcaaggcaagtcatcactattccttgaacatgttgatcccaattgcgaaattattttgtttacaaataaaattgcatgcaatgatgaacatcatacttgtgattatgccatgccttgattattgtttaccccttatgtcttcgtaaccatgtttacgtatgagtccttagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgataacatgatttgtgaaaagggaaataaaattaaacaactgttttcgactggggcggacggaggatttgggtggtgtccggaaaatgctagtgccgtccccggttaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggcactacagtggggcagccattggtaggaccgcgaggcgggtgtctactgtggtgtcgccatcggtaggactgccatgtgagaatctaaacataattataacttaatgcatgtgtgagtcttcccttcctgggtacgccagaactcctctcactgctagaaaccgtgtacgcctagagtgcatgaggatgtaaagttcatggagcgggcactgccaatgcgaggttatcaaaaagctttgccgtgacgcgtctcatgtgttggaacgaggctcatgtgttgggcagttgtggagtgcgggtaaagtgtacatccactgcagtgtgagtaaaccaaatctattcgaatagccgtgctcgcggttattgagcaccgggacgtgtattacacttggctagactctaaattcttaacttgtgtgggatgagatagtgcatgatgatttttatactgatggagccacttcctgagaggagggaagatggacgtcctcagaaaaccatgacgactcaatggcgggaagctatccttgggattacaatggatggtggacagaactgtcattgtttaacatgaacactaaaactaaaatttggtcagtttatgctaggtcttaggcttgtgaaaagaattacaaaacttgctttgcgcaaaagaaccatagccattccttgaatacccctatcatgtgcattgttgctgtggtggcttgctgagtacggttggtactcacccttgcaatatataaacttaatcagaggccggagatgaagcttcggaggatccctatgcctattaccaggagggtgatgaagacgatggcgctcagtaggtcttagttacggtcgttgcctgtggcaatggcgtgccgctgccttaactccgctgccttatctacttctgcttttggaatgtattccggaccgctcggtccgatgatctaagactatgcctgcgggcttatgatgtaataattcgcactagactctcgtgtatgtgcatttggtatttcagctataaactcatgtgtaccagactacttgatccagggaaatggtactatttacatgattgattcctgttataaaaacgggggtccacacagggagatgcaacgttgtcgtcgaagaacaggagtagtcgcgtttgaagcactacccaaaaacttgatcgcccgcctacccgtgtagacggagttccggaggcacctgctcgtcctgtacacctgtgcgcgcaggtgaacagaaccgggaaaggattatgtagctcaggataatacggaatcaattcgcgttttatttcggagcagacggagttccagaggcacctgctcatctcgtacacatgtgtgcggaggtgaacagaaccgggaaatgattctgtagctcaggataatacggaatcaattcacggcgttttattccggagcggacagagttccagaggtacctgctcatcccatacagataatacggaatcaattcgcgttttatttcggagcggacggagttccggaggcacctgctcgtctcgtacacatgtgtgcggaggtgaacagaaccgggaaaggattctatagctcaagataatacggaatcaattcacagcgttttattccggagcggacggagttccggaggcacctgctcgtcccgtacacatgtgcgcataggtgaacagaaccaggaaagtattctgcagctcaggataatacggaatcaattcatggtgttttattccgtaaccgacggagtttcggaggcacctgctcgtcgtcccgtacacatgcgcgcaattcatggcgttttatcccgtaaccgacggagttacggaggcacctgctcatcgtcccctacacatgcgcgcgcaggtgaacaaaaccgagaaaggattctatagctcaggataatacagaatcaattcatggcgttttattccgtaaccgacggaacgttttatttcgtaaccgacggaatcaattcacgacgtgcaagtgaatagaaccgggaaaggattatgcagctcaggataatacgaaatcaattcacggcgttgtgcaggtgaacagaaccaggcgagcgcagcctgcctcgcctcgcctcgcgcgtgcatgtgtgtagctgtccgcccaccatctcaattggtcaatagagactctcaactagccccgtatttaaattgagacctcttcacttagatttccaagatggtattattacccatagcacttactgtaggccaatgaaatttattatgatttaattggcctagcccattaatctaacacaaaaaaaatccataattaatgaaaaattatattggcagacgagtaggtgatggagtattaaaggaataaaatttcttgatttacaggcagatggtaggcaagaaaatagaagttgattcattttttaagacacaattcaaacttcggaaattggtttattttgggataaagtcatgttgactcatgagtcagacggagtaaaaacgatcggaattggtagcatctattcgaaaacgacagtcgatcggtcggcaatggaccatattcatcatttgaactattcgttgtcgatattaatatgatatagaaagaaattagaaaaaaacaaaatttat

SEQ ID NO: 39922 - DNA, 3914 bp, Oryza sativa
aaattgggacgatatacgggctgcactgggcttggcccacgaaggagagcaacgtcagcatggagtgctcggacgaacggcggccccggcgcagttgtcgtggacggcgagtcggcgatcgatccgccagtgtccgcggagatgccgagccgtcggcgaacgccacccgctcgcaccgccgtccctccaagggtccagacgcagcctttcaggcgttgggaatcgccgggaggaactagatctggccggccgcagagagcccccacccagcccccgaatccggtggttcccccgttccatctgcgccgccgccggtccggcctaatcactccaggccgcatcggctgtttcgatctgccgcactccgccgcattgtttggtggggggtatgtcggtgctttctgacttttctgagttcttttaccctaaagaagtaataaacagttccttttactgcaaatcttcaaatatatttagggtccctttaaattatattataggaatggaaaaacagagaaatgataaaaacgtagtattcttgtaggaatgtaaactgtaaaaacaaggatgtgactgtaaaaatgtatgagtaggaaagttgtgttactggcccctttgaactaaaggatttatataggaattttataggattcaaatactataggaaatttttttatttggtcctttgattcaaaggattgaatctttccaaatcctattaaattcctatggaatggcacattgcatgtggattttggaggaaatttagcaagagctccaacctcttagaaaatttcctttgagtctatctctctcatccgattcctgcgtttttcctgcgctccaatcaaacaaccattcctgtgttttgcaatccactgttttacacttcaattctaatcagaatcctatgttttttctattcctctgttttttctaccctgcgattcaaaggggctaggaatttcacgggaaagagaatgtcaggaagtgtattaatacgtgtcactttggtattatccacaatattacaatatacattttcttctaaaagagcaataatgatacatagatctgtcatttgcctcaatcctacgcacacatgatggaaaaaagaggttaggatggatgtttccattttcctgtgaaatgagttccaaaggaaaatttcctctaactttcctatgtcctaatcctgtgaatcaaaggctgctacagtgccaaatcctaaatcctacatttttcccataaaatttctatgaatcaaagaggtctttaatcatgtccagcggcatgtgatttgcaaggcgattatgcagtgtcatcttgactgtttatgatccaagtcaccaaaatgaattcttgcactaggcgcaaccctcctggttgctattcaaatcagtggttcaatggagtgcctgatcgtggttgaactttgcactgcattgctctttgtctttgacctgcactctacataaaaaattcaaacatgtctaggccgagcaaatgtacgtggtgtcttctggttaaaagtacatggagtgatcagtcaaattcagttttatcagctaagtgggttccagcctacatatcagttgattgctacaccaaggaaacatcgactggttcactacatcttgatgagccacaagttgaccaaaacagtatgctgcaaagtgttccaatcttttggtaatcgtcatagaactctgctgcctttcgtttgtaccccggtcgagtcgttgttccattcagcttgccgacgcaacgagaagctccagggatcagatgtgttagagcatccacaatgtgagacactgtcctcactaaccgaggacactcgtaggaaacttggcttacaatgaagggtatccctagatgggctccttaaaatctgaagcaacccgatgaggatactacatctcacaatgggtgtcctggtccaaggtagcccagtacaaaaattccacccattcccctaatcagcccactagcccagccacctcttcctctcctctttctcacattttctcgtctcctccgcccaccatctcctcctcttccgatctctccctctctccctctctcagtcgaacggggtgccgtggcgaacggcgagcgcctcgcgaggtcggcgacggcgatgggcgcgaggggtggccgacgatgacgggcgcggggggtgcccgacgacttcggttgccagatcccctctccctccgccggggtcgtcgccgtcgccgtcggagtggcggcagggtggccagatccggcctgggcttgccggatctggcctcgggcagcgacgacggcggcttgccggcgaggtcagcgcccggtcgccctccgcctgtcgccgacgactccgccgcccccgtcatccccgcccagcgccgcctcgcaggtcgccctcctcccgctcccctctccctctagccgtcgccgacgactccgccgcccagcgcagccgacttcgccgcccctggcacccccgcccaacatcgcctcgcgggtcgcctcgctgacgactggctcgccctcctcttcaaggccgccgagctcctccccgtcgtcacgatggcggcccgtggagcggatcgacgagcgggcggcgccatgggagaggggccaggggcgagggtaggagagggatttggggggagtagcgaggagacaggagcctgcagtgggtctcctcccagcgtcgagggtcgttgctctgcaaaaaatgggcgctccttgcaaagagccgcgcccctttgccaggcgccgcgctcctagctggggagacgattcacgctgaaaaagggacgggagggaaacggccgtttgtgaggggacgggtcgagggcacccattgtggatggcctttatcttcttgctctaccaatagtgaacgcactttctggggtgctagctgtgtgctgtcgcattcagtcaatttcaggggcaacagaaaaaaaaaaagagaagagaggaggtctttgatgcagaatcaaatcttttcatgtttgatatttctgacgtcatactccatcatgcagatgttgataaagtaagttaaagccttggcaagcaatctgtgtgctgattagttcctgtattgatctggcgaatatccaagggacatgaggaattaatttagttggcctggttggggaagagaactgttcatgaggtcagtctattctctctcagtcaatgtgtttgtcaatatgatgtactatcagatcttcaagagacttgcaatgattattatataggttattttgagtaatcgaatgaagttatgcagggtaggtaaaggatgtcacagttgattactttgggttgttttagtttgctaccatgctaaaatgtagagaagttttggtattgccagtattttgacagcttatctgccttgatcgcacattttttttagcaaactagacatagacaatgtactatttaacgagccagagcatattttggcttcaaacaaaaatgatccattattttccaagagtatatatgaatcatttttttgtaagactaaacagtatggatcgattgctttaggattgctgtgcctgtgcgttgtaaagtttgcacgaggccagcatggtaagagtaagtttacggctttagacttgagtaggcacagaatgttcaatgcggccatatgaaaagcttcccttaacctaactaattcatcttattgccacacaatgattgtgttggtttgttaatgatgaacagatcatgatgtcccagggcaacgtgatcttggagaagagaataaaaaaggacgtccattgaacggattggacctaactgacgtaccctatagccgtagattagatcgtcctttgtcagattttccacaagatagtgaattaaaaaattaggaacatatcattggggttgaaaca

SEQ ID NO: 39923 - DNA, 17603 bp, Oryza sativa
gtgggctccaatcaagtcaatcaaagccgaatttccagtacataaaccctggcatcatgttaacagcatgccctaagtactgaataatgtgtaatctgcttgccccaccttgtccttgtgttctccaggacagcaagaagagctgcaatgaagtgttgttttatgcctgcggtctacaaatattgcccacttcggttaattcccttaagaaagagattgaagaagattgagaaggattaattccaacatctcgatagttatgaaattaattttctctagttttcctttaatcctcagagagagattaaccgagaacaagcctaattgcaagacagcattgccaggggcggagctagaacaaaatgaaggggtgttccactcacttgctttactctggtttgaatcaaatttagcttggtacgggtgcctatatttaaactgacggggtatatacatgatgaaaatagataaactatagataaaaaaaatttttgaaccaagttactggataccccctaattatactggctccgcccctgagcatggccatttttggaaaactcaaagatgagaacaagaactgttgactgggccggcagtgctgcaggttatatatggctctctcttcacggatactctgtctctctctctctcttttgatatcacctaaataaccataaaaattgactaacatatattaatataaaatatatcatataaatatgcaaagttaaatttaacttctataaattgtaacaaaaataataaatataggtgcaactgaacgttaactcttggaagatagtactagtatactacgggtagctagctttgggcttacaggcaacagcaatgggattatgggagcaattttctaaaccgtgcaccggaaattcagagtgatttgataccggcgcttggcagagaccggaaaagcgatcacgaagcgtcgcttcgtacctgtctcgcgcgtgcccgacgagcatgacaatatatggcttagagcaggtacaatagcagactataagtcagctataaatatattttaaaaagataaagaaagagagaagatcagtgggctacatatctatagccagctgcaccacggactccaaaacgtaatgtgtatatgacatatgagaccaggtataatagtatagtaagcaactattgtatgaattggctattacattggctatagatgatttggagttagtatcgggatatactattagagcaaatttaatagtatagcccactactagctccaatttatctatagccaatataatagccaatttataccacagttgcttactatactattaatatatggtcctacatatcatacacacactgcgtcctggagttcgtgctgcagctggctacagatctgtagcccgcttcttttctctctcattttttatctcattaaaatatatttataactggctaatagactgctattgtacctgctcttaaaacttgctcttaccctctgactgggcgcctcgcgtatgacaaaacgggaagatgtgtaaatgtggaaatctaggctgcgtagcatgcggcgaagtccatgtcggtcagctgcatcttcagactctagtggaaaagtcatgcttcctgaagcagacagaaacctttgacaccggagtgcatgctgcttgcgaactgtttgatcgatcgatcgagccatcgtctcccagcaaaatcggaggctcacatgcacgtctccaacaaaatcggagcctcacatgcacgcaccgagttaggggtggaaaaaaagcttggactcgtgagcttaactcgggcttggctcgagcttgcttagctcggatcggcttgaatgccaaacgagcgaaagcctaagcctacttttcagctcgttcctgaaatgagccgaacccgagctagctcgcgagccgcttgatttggctcgtgagtctaggccatcatgtatttatatggataattttattttctagtggagttattatttgtcaatatgtaatttattatctatattctgatgaattgaatatataaagttattttaattttacatattaatgatttgtcattgtttttcttaatgattacaaattatatagcttcaacggaaggtcgcaagccagctcgagctggctcgagccaggaaacgagccgagccgagctcatgttttagctcgtttcccaacccgagccgagccaaggcaagcctagcttgttgcgagccattgcaagccgagcctggcttggctcggctcatttccagccctacaccgagtgatgataagaagagcattggtgatgatagtcactgatctcgtcgatgcggctttgtgtattcagactcagcatatagagttaaatgcacagttagtgatcaagtaattttagtagcctctaatcactagtggagtagggctgtgtttagttccttctaaagttagaagtttaggttgaaattggtacgatgtgactgaaaagttatgtgtgtatgatagattaatgtgatggaaaaagttagaagtttgaatccaaactttagatctaaacacagactagctagctaaatacgtacatgcatccgactgtcctggttgtgtccttcgctgaaaagtactcagctatcagctaaaaaaaaagatcaaatatataactgtagccaagaaagaacacaatcctagcacgacttcggagtagtattactgtaccctatcgtacaagttatgcatgtcccctttgatttccaagggcatacacatattaattcagcctgacttgcatactaacggtccaacctatatatggagttatggacgatatccagacagatcaatgggcggccacatatgtcataagtgtatgcccgttcaaggcgatcgacggcgactaaacgtgtacagactttggtttttatcgcctccgttccaacctgccgctcaacctggtcttggttttgggcccccatgaacagttggtttgagagtcggcgtcagggtcgcctccatcgcaaggaggtcctgtacgctgtcgacctgccgtttgggcaacgcaaaaatatgagcagaaaaaagaaagggaaactcgtttatagttactagagcagatgttcactcgatcagtgtatattaactaaatatttatatattttttataaaatagtgatataaattaatatgtaatatatcacttcacaaatttataagttcaaagtcaacttctacggattagagaaaaataataaatttcattgtggatatacaaacttagggtttaattttttttacaatttctagaggttaaatttgagctcgtatgtttattgagtgatatagtattacatattaatttaacttactattgttttttttaaaaaatataaccaactagttgatatatgataactgcaagcatatatatttaaatcaacgacatgccatatatagaaaattgctatgcatataacttaattgtccgactcacgtacgacaaaatttaattaacggtggtaaacggctacagtgtatataaatatgttttactttaattgatatatagttacatgtatatgagttgtacaacggatcgtacatatagcggtactcccatatataattgtgctacaagctggagtatagagtaaactaatagtagcaattaatgcagcatatgcctaatgtctattagctatgcaagattgcaagcatgcatggaaggaataatgcatgtactacaggtataattaagcacctacctaattaagccttcaaaacttgccaaacttggtcaagcaaagcacgtataatatctgtgttaggaaaaaactggcaactaatttgatgttgatctgatcgaatgatcgtgtcctccgacgtgttctaaattccacggagcatcgatcgattctggcagcaaagtcgcacgcgcagaaaaatctccacacgtcgtccccgtctctctatatatacctccttcctgtttggatctttaattagcaggtcaataccagagtctctctagctacttctcctgcttgctatagccctgtgttgcgctaggctgtgtcatataatggatcacgctggcaacacggtcgcgaacgtgacggtggcgcagcagccgcattacgggcggtccgtgtcgccgccgtcgagggtgtcgtcgtgctcgccgccaccacctcctgtcggcaccgcctccttgctggtgggcaacacgtcgtcgtcgtcgtcaccgacgacgaccgtcgtgctgagcccgtgcgccgcgtgcaaggtgctccgccgccggtgcgccgacggctgcgtgctggctccttacttccctcctaccgaaccgaccaagttcactaccgcgcaccgcgtgttcggcgccagcaacatcatcaagctcctccaggtatatacatagtacgcccgcacgtaagagcgaggatttcgatcgatcgatcgtcgtggcacattgctgatcgaccgacgtgcggcaacgtgcaggaattgccggagagcgcgcgggcggacgcggtgagcagcatggtgtacgaggcggaggcgaggctgcgggacccggtgtacgggtgcgcgggggcggtgtgccggctgcagaaggaggcgaacgagctcaaggtgcagctcgcgcgcgcgcaggccgacctgctcaacgcgcgggcgcagcacgacaacctcgtcgccctcgtctgcgtcgagctcgcgcaccgccgccgggacgacgaccagcagctggaataccaggcgccggcgccgccgctgccgcacccggcggagtactgtagcggcggcgcaggcttcggcgccaccgtgtaccagccgttctacgactcggacctggactcggcggcgtggggcgagccccagctatggacgtgatacaaatttgcatggtcagcgcggctagctaagctaagctaagctaccatactccgtatttggcatgcagggtaattaataatctagagcactagtagtaattaagtactgtaattagaaacagatcagtttaaagaaggaactataattagtacctggcggcttagctagtgtcgtgcttcgagtacatgtaacagcaacggttatacatacttcagccggccggaacagtttatgcttgctttcagagtgttatgttcttcagatttaaaacaagatcagatattttgcaatgagcagggtcgatcaagtaaagttctgtaggagttcttgtaagcctgtgaaacacttgttaaattgtgagctggcgactagctagtggccatcacaaaattcgcgctgtacgtgttttgcaaaaataactgatgttaggcatgcagtgggttgacaatacactactccgatcgactgaaggagatcgatggaactcgaacgaaagctacatttgcgagctcacgaactgccgtagcgcagtacgtatctgtcagtcctgctagtttgattcattagcagaccaactcccgtcgttcggtcgaaataaaacacgcttatatagcccagtatgattgttttgaatgaaataaatattacaaagttaaaaaaattaaaaatactctactcactccgtcctaaaatataagcatttttagtatagtgccaaatcaaatatttttactttgactattaatagaaaaaaataaaaaaaatcaatctactaaaattgatgttactatatttatcattaaacaaaccatcgtaatatacgactctttttatttttcgttaaagtaacatctcaaaaaatgtgtcgaagtaaaaaatgattatattttaggacgggggagtaagtaattaatatatatatatatatatatatatatatatatatatatatatttaaaaaaaacatcgtgtaggaactaggaaacgcatgttcacaagtaatatgtacgatggtgctggtggccattgaacatgtagtacgtttttgtccgagctctggagacagcttgttgaaaaaaaaatctgctactgcacttgaataacattttagtttctagctcagctggctagcagctgtcgtttttctccctcgatcagcctgtttttttttttctctctgtggaacatgtcaatccgtatgaacattaaacatgtgcctgcgacgtactagctcccggcggcaactgtagcgtacgtagtttgaacaaacactcgctgcacgagcaacagatcccaaaatattgttcaattatattaattctcacgaagctagcaactggtcgatcaccatcgatcagaagcccccaaaagaaggctgcctaactctatctccagaaacctactttggctacttggactgtcacattaacacgtaccgtttccaagtctcgctagcctagcctagcatatatgcatgcgccaaccagagtaccagaccatacgaaatgacgatcgcctacggtcatcgtagacggccggccggctgccaatctgccatttgaaccagtaactaactgacactgtcacacaacagaacaaaattaaagccagtaactaattgacagtgtcacaacagaacaaaaaccagtaactaactgatgattagccagcctaagctttccgatacatgcatgcatgcatgctactgtctgtcttgtcttaatttgtttttatggaccgattggccatggtagtttccgggaaactagtaatcgactagttaactacagtactaggctactagctactagtaatcgattagttaatctgtttggtggtatacaccatcagtcttgaccagaaccatgccgcatgggtacgggcaaatcctttgtctccgtgtacagaatgtccaatatgttgcctaaaatgtgtccggctcggctgcttccccactccggttggaaacatcgagttgtgattgcggcggccggcacgacatatcgtgaagcttttagcttggtgaaaggattaggagacgagcgagagagaaaaaagtgcgaaattgtacgacgtgcagggtacgggtacgaaccccacaacacgtgcaagacgtgtcccatatgctgccacgattagcctacccgttttaatcgagtcaattcggcgtgctgtgtaagcccaaacaataagtgggcttctcttctcttggagacttggacaaaccaagttaccaaggccagatcggagtaggaataagtccacatcccttatttccaagcgagtttaaattacatcccttaattgcaatattatcataaatttttagtctccatcttgcaaaatcggattaaataagatccttttatccttaaacttagagttgattttaaatttttttcatcgaaatttatttttcagcttttccttttagatcgctaataatacatatataaaagttttatttataaattactttccgtttacaaatataccgcgcgaataagcgaaacatcgctcagatacagtcagaaaaagaaatgaaaaatatatgtgaccctttctttctcctctatgcctttctagctctctcgcatcttctctctccacgccgacggtcggacggtggcctcggcgtgcccaacgacgctcgcatgggtcactgacatgtggctgccgacccccgccgaatcggccggcggcatggttcatgtttgcagacgtgcagtcttgcaggcaaccggccggcctcgctgtactaaggacgagctcatgcatgtttcgagcagcagcaacaacaacttctagttggtgcatgtgtcgctcaaagcgatgactctaatggcctccgtgaaagagcactaatcatgtttagctcgacctatacactaagcctgtgtttttgcaggggtcggtaacccctcctctccacacgtaaaacagagcaacagattaacgcatgattaattaagtatcaactttaaaaacttaaaatatattaatataatttttatagcaattttttagaaaatgccagcgatcgggcgtccgatcagcggcagaaaattcaggcgcccgcctccgcccgtgcccctagcgcctccgcaccatccccaccacgcgccccaccacatgggccgttgtaataaatcactcacatattacggaaatgctctattaagggaattcgtttcattttttccaccaataatgtttcaccaagtatactcgtattgtttcactatatatagatcaaatgtttctgtgaattgaaacattctttcgctatttgctgaaaaattgtttttatatatggtgaaacagtttcaaaaggcgttgttttatacgttgtagcaaaatgtttcatgagatgatttggttgtattttagctttataaacaattaaaacattttcgatctacttagtgaaacaattccgatctacttggtggaacatcgttcgatttttgaaaaaaaatcgggcatccgatttataggcgcctcgcaactttattttgtagatttttttgtaagaaaatagtttggaaagcgtatggtaaacgaggaagtgaggttgaaaacttcaagtgaagaacacaacctaatccttgttgtactgagcatgagctttgcctcccctcctcaccgccgtggagcatccggagatggtcacattgaaaagacacatgtcagggggtcgtcggcatccggagacgaggacacgatcgctgccgacgaggaggacgaatcatggtggcaccggttgatcgaggctgcggcactgcggcatgtatggccggaggatggggaggccaacgacgagggatgaaggtcgagcggttcgcaagaggagttggacggcgaggccacagcgcgtcccacgccgtttgcagcaacgccgccacgatgggcggctcgatggaagtctcgaacaccaacaggagcctcgtgcacgttacgtcagtctgggaactccatcggaccactcgcgtcccctccgagatggcaatggggacatgtaaccccacacccgatggatttttactctattaaaagctaattatattctaactcttatacccatagacctattgacggacgaaaactcctattcgttgggtacctaggtatagtccgctctttacccacctgtacccaccaatccgtgggtgaaaaaaacccgtagattaagcctaaaactatgagtaaaagtcctaacgactactaaatcatagcataaaactcatttcacatcttaagcattcttccagtctattatatgaaattattttgattttttgattatgtaatgttgttgtagagtttttttatttgccttttgaacgctaatgttaatagcattgttgccagagaaaatattgataacttacagttctaatatggctaattacagtacaaaactatatatgctacaagtcaattatatgtgtatgggtacccgttatccgcacgggtgtgggtatgaggatgattttgtacccgccggatgtgggtatttaagtgaaaatatttagtcatcgtgagtgtgggtatggagcaaaggaacccgatagtatgcacctgttgccatcttgaggccctcctccatcgttgctgagtggtctagcttgacgaggtcactgcatggaggagaggatcgaggagatctctccaccagatcggcggaccggcggcgtcgttggaccaaggaccatggttcaaaattccggaacaaaaatttcaaaaactttcggaatgatattattttggctaaaatttttatttttaagctttttttaatgaatttagctatattttgttcaaaaaaaactagaaattagggaaggatctaatatcaaataattaggaggggtgaggctttgaacccaggtcgtctaacccaccaacttgtggagctagccggaagacccctgggcatttctcgctatattttgttcaaatttgaccaattttatttaaaatttcggtatatgggcaccctccgatagaacgtcgaaaacgaaagattgaaccctcccgaggacaggaccgatcgctagttctcgctaggagaggttggggtagatgagaaagaaaggatgtcaatgacatgaggctccatttattttttacttttataagactggaatgtcacgtcagccaaaaacaaccatctcatattacgagagaatcttatttaatccgggtgtgcacgatggaggtggaagatttctactagcattgtagttaaagggacacaaaatgaacttattgcatcggtgtaacacaacacaccgatcaactatttaagatgggccttcaggtggagcctctcttgggaagagaactggtttttttctgttggaataagttcatctaaggtcccttaatttgtcaacgatccgattttcgtccctgaaccgaaaaaccagatacattaggtgccctaactatcaaaactggtgcagataatatcccttagctgtttagatagcggttttgactgacgtgacgcctacgtggctaatttgactcggtcttcatctgacatggcattggcgtggcgcttaagtggcaatttgatctaagaataataataaagcccatgggacccacatgtcagtttcgcacataaattaataaaaaataatagggcccacgtgtcattctcacccctcctcttcttcctcctctcacatctcccctttcttcatatctctctcccctctcctctctcagtcgcgatggagagggagcggcacgcggtgccggcgggagagggagtggggcacgccctccgccgccaacccgcctccaccaccatcgtcatcctccagcactcaagcccaactcggtcttctctatctcctcccctcttcccctcctccttcccagatgcggctgacgggaggacgacagccgacgacgggtcatgaggaggacggcggcggtccggagcagaggtcggaggagggcccccagccgctaggatggcgctcaatccgtcgcctcctcatgctcgtcggccacgccgcgccgtccgccgtggccgccagagccgcgcatgttgctgtcagacgagcaggtagatagtacgttgtacgtacacgtacaaatcaatgccaatataaaggcccacggcgctagctgcccatggcaccagctgcctgcctcgccgccgatccggccagccgccacatggccggaggagccgtgccgcccaagcagtcacgagcgcctccccacggtgatcggcgccataggaagaagaaaagaatcgagaaaagaagaagaaaagaaaggaaaattgaaaatagaaaataaatggagaagacaatgccggccgcaccgccgaggccgcgacccgcgccggggccggcgtcaccgcacggccacgctcgtgccaagccgccgctcagccgcgccccgctgcctcggtgccgccgtcgctagtggcggagccaggattttaaagttgggtattcctgtctaacaaaaaaaaaagtccatagtaaaaaaaatcaatggttcacagtttgtcaataccgataatcgaagaaataaaactacaaattattacacggtacctctaattttctatttcacttacttcatggcttggaagagtagctttaattctgcgttccttcatggcttgaaagcggtttgtaatatcacagtcctttactttcaaaaacatctcatgctcaataaatgtgaccaagcaatcatttaagtattgatccccaagcctgtttctcaatttattcttcacataattcatggcagaaaagattatgtgaagaataaattgagaaggtgttcttttctcctgaaaatgaagatgaagataaacattaagttttttacgtaaaacgaggtggtattagcgtatgattgtttgagttttaattattacaaaattcaaaaaatagattaatatgttattttagagcaactttcatatagaaaatttccccacgaaacgcactgtttagcagtttgaaaagcgtggcacgaaaatctttatcttaatccaactcttgatggagaaatgaatgggactgctactggaagcactggaaccaatttgagaagcttgaaaacaatctcatgtctattgtgcaactttgtttcaacaatcataatggaaagatcagcaagagttttcacttttctaaaccttccatctatacgcatcttattgagaaagagtacttggctaactaatttgtgtacatgtgtatatattgaagtaatacttgtttcttgataaaaaaaagtgggtattcctgggaatacacaggaaccattgtagctccgcccctggccgtcgctcggccgagctcctccacatcggcaccgctgctcggccgcatcggcacccatccctccttctcctcctccgcctcctccctcctccacaccgcccggccgctgccggtcaccgtcgtctgcagtgcctcccgcgccgccgatatttgacgacgctgagaggaagagctggaagggagagaaatagagagaaggagaggatgtattgatatgtgggccccaccttttttcctgacatgtgggccccaacattttaaattatttttttagctgacaggtgggcccatagttttattatttttctaatatataattgctacatcggtgccacgtgggacgtagacctagtcaaaccagccatgtaggcgccacatcagctaaaaccgccttcaaaaccgccgagggaccttttttacaccagtcttgacagcttggggactggttgtatctagttttggggtttaagaatgaaaatcggattcggtgtaaaattaagggacgttagatgaacttattcattttctctttagggacaagaaacaagttcagatcaaaataaaagtacaaattataaatttacgtgaaaggtcttgtgaatttttctttaaacaaatgaatgcctgcaatatatactcccaaagtaaacccaagaaatggttgcgtgacagaacaatataaggaggtcaaatagtacaaggtcacccacatgtatcctacctactggtatatggtatatccactcgaatcttctatccacaaattgtctcaggcagcatcttcacagacagcagatgctaccaatcctttgtgccaatcttcatcttggagtaccttttccccatttcacttggatttaatacatatcatatattttcatttcgctcggacttaatctgtctgaacttcatatctaaccatctgctggttcgataaactcataaaatcaatgagctccttgtttggacataaattactcttattaaatcaccactgactatctaggagtgccagccatcacatttaaaaggaactgtcctttatttaagagctcctctgtctgtgtttatgcatctaccatgttatttttttttaaaaaaaaaactgtttgtgtattagtgtcggtgttaccgaccggttcacctattctggtatttgatgtcgcaagtaattaatcaacgaaacttattcggttgtcctcttgcaccatgcttgatacaccagcaaactccctcacatacaacacgaaacagctatcatcataacacaagtcacttttggacgccacacaatcaatcaaaaatcaaatgcgcaccgtgtgctctcatgttgaaatttcaggcatgcttgcagcgttaaactgttaatcccatctcactttttctgcaggaaactctcacacagattggacggccgcccgagctatactattaccgttttcactgccaataaccggcgacacctacaaatatttagttggttaaaaaaacactactaattgtttgggcttgacagcgtcgctggctatcactgtaggtaaataaatgtatcgctagcaagaaagtgagaacggaacaccccatgatccatgggacgacgcctttttcaaggcataaattcttcgtggccatgtgtttctccctgggccgagtggccggcgtggcatgaaccgaaagggcgaccacgaccgtgtgggcggccggggcgcgcggaatcgcggatgctggcatctttctccagaacttgcaagatacgtacgtttcgtaaaggttgccggtgacgttagaacattgctcacctcacacccccccgggttgatgtggacctgcccgtttcttagttttggtgattctttgcacgtttcccctcctaaaccttcagatttctatcagttggaaggttcaagtggggaaatggataaaagattgaaagaatagtactagttgaggagtttgctgattttctggttttgggagggggtggatggaagatgtttgtagggtgcagcttggaggataagttggttttcttctgcgttctccattgccctgttcgatcagacgatcactgaaccattccccggagaagagggagatagaagcaaataagctcttcatttccctctcaagagcagctcatcgaagctgtcagatttggccattatcggtgcaaattcagagatggttaagatcaaggaattgtatcctactagttcttgtgtccatggattttttttttcttttctttgctgtgttctttttctgtcatttttgggtgatcatgtgccatctgcttgaacttgggcatgccttgacttcaatctttcaccaagccggatcgtcgtgcctatgtcgatggaagaggtatggagaagtagtgtggcaaaaggaaaattttcaattgaaggctttgcattcttgtggttcgagcaatttggtaaatggactgatcagaaccgatcctttcgttacagtatgaaatagggatcagctacaccatcatgaagatggagcagcaaaacacgaacagcaaggagggcgtcgaggtgctgcaacaggtcccatttgaggatgagaagcttggcaagggccaatacacctcgaagaattatcatttgcagaggttagtttgttccgtgccagtcctgctgatggatttcagaagtttaattcaatcaggcaatattaaattgtttcagaaaatatgttgatcctcaaggcctttcagaagttcctgatcaattgtagtcttgaatcttgataagaataagcatgtcatgttaattacaagaggttagatctcgtagctactgaaagcagataggatcataggaagtgttcatccaagaacagaaggaagaacgaggttgatcagtagtagaaaggagtaacatgtcgaacattgcagatgtaaagacttcaagttattgtcctaattaggagcatgcattaccttctttcctaagttaagcaatgcatgctgatgtgtttcaccgaatgctagttcttatatacaattaaatgtaaaaattatgcagcaaaattccatcttggatgaaaggttttgcgccagcaagtgcacttaccgtgcatgaggaatcatggtgcgcatatccaaacagcaggacaggttagcaaagacctttcgctattaaagtgcagcagtcgtgttttaataattgatcattcttgctaaacaagttccatttggattccccttctctgtgttcatgtggccatgatttctactccgaccctcatcagtgatcaaggtaccacagagtacagagtagttaacccattcgctcttaaagtctgatactctttcagttttccaacctaacttcaggtttcttgattatttgttatcagtgcccgctttttagcaagtgttcactgaccatcgacactgtgatcagacctgacaatggctgctctgagaacgtaagtactctccaatcatctagcaaccatatttgctccaatctttttcagaccaaacggcaaatactaagagagcacaatgtacataaccaggcccacaatttaaccagtgaacaattagctgcaagagaggtagaggtcgtcgacatcgcgttgcagtcgagggactactggagcaaggtgatcagcgccccaaacgtcgacctgacagccttcaggtcgcagaggacgagccgaggccctctcttgaagggttggatggtacgcaggtttcagttcagaaaacaccaatatacactcgtgttgcgtcgtcaggtctgacgtgacatttggtgcaggattcatgccgtcccgtcatgaccacgtacaagctggtgatcatggacgctccgatctggggcttgggtgaacgcctggaagactgcatcatcgcggtaaaacaaaatgctttgatctcttctgcataacacaatgttcagaaagaaattcagaggtgatgccttacttgtggtctgtgcgtgcgtgcagggggagagggcgctgttcttggcgtgccaccggctgtgcttcgcgtggatcgacgagtggtacggcatgacgttggatcagatccgagagatggagcgtcagaccgacctgcttctcaagaaggtcagcatgaacagaaagtcttcaactccatgttctgcaacaatgaattccgaatttctgatgtgtggagtcactggccaatgttgctgcagacgctgaagaagcctgcgaaggccgggagcaagcacgatggcaagaggaagacgctcaaagaggagattgtagctgtcgggagctgcacgtagtaaattggattctacgcgagatgtggttcgctacactggatggctccaagctgtcactctgtcagattaggcatgcgttgagatctggcaaaaattaagcactgtacaaaggaatccacggatgatgatgtgtatatgttggcattcatcgactgctagtcctcagaatcaaaattgattgctcgtcctcagaatcaaaatttattggtcgatccagggtaccaggaaaaatcgtagtattaaggccagtccgatttgaccatcggttgatcataccagatgctattttcaggtgaaactgctcgtaaccctgtaagattccgaaggtgttttcccaattttttttggaaaaaagtaaacactggcccatcattgaaccctaacaggaaggggctattcagattgatgtcatttccaaccgtaccattttttaataaacttgccaaagattaggggtggatctacctattaggcagggtgggtcgaccgactaagctacggctcgtgtcgcccacaccctgaagacccgcttatccccttatagcagtcatggaccattaaaattatgtataacaaggtatgaacacccaacatattgagacagtgatgcgaatgaactattaatacgatgtgttgtgttcgattgctcttatcaagtaaacatctttgttctccgtcccatctttattttaaagctgcatccgtcactaagatgtgtctatatttagtttattgccaaactttggtaaattcataagaaatcctgccaaaattttggcaatattggtaaggtttattttggttacaatctaaacagccctcaaatataacatatttcttaacttataatagcagactatccaagatcccaaaacaatattgtgtttaattttaactaacttgatgctgagtcaacgtgagactcacatggaccccacatgtcagcggtcttcctagtcctctctcctcctctccactcttgccctctcttccccatctctcgcctctctcgaagcgacgactgacggagggaagtgcagtggatggtgggcatcggctggcgggacaaaagctgggcaatggcagcaacgcat

SEQ ID NO: 39924 - DNA, 35330 bp, Oryza sativa
gacttctccccatcatctcgtccctacatctcttcttgcctctctccaccatcgacacctcatccacttctcctcctctgtgcacagggcgaaggtggctatcgcccacctaagcagaacctagtgactagggggaggagcacaacaatgatagctcatctcggatgtcgtggcatgacaatgatagttcatctcggacgcctcctcccacgacagctcgtcaccaacgctgcttcaagacgaaggtgggcggtgcactggccgacaccgcaccctcgcactgcggcttcccgtcttcgtgtgagaggtagagaggagagtgggactcatcgacgtgggttccactatttttattttttttttgtttgactaactttttatatttttaaaatcttgcttctagtgccatgtcaacaccacgtaggacgacgactaactcgaatcagccacatcagtaaaaactgtataggaatcttgtttgcaatgattttgagatttgagggacgtattatatctgtaattgcagttcaatgttgtaataaaaactcaacgtcaagctgagtgatcaaagattcaaaggtgaacttattccaccgccaaatacacaacctttgtttaaaatttggccggcccgttacaaactaccggatgccaatcttgtgcagtctgagcacccacggcctacctgcgccaccgatgacccacggtcgttcgcatcaagcttgtactgtgaatcatctcaaatcccaaacggggaaaaaaaacctcctactgactactgtcattagagactcggtaaggttttccgtagtactacaattatatttcgcccgatctttcagacttcagatcaaggagcaaaacaaggaaaccagtacgttttactcagatatttctctctgtcatgaacggaaaaccttttgtagaactgtcatgaactgaaaacctttctttcatgaacttgctgtagtcctgattaacgtgctagctgagggttactccctccgtccccaaaaaagacaaactttagatttccgtgccaacgtttgactatcgtcttatatgaaactagtatggtggctcgcgcagattgcgcggctagcatcattatattttctctcatataattgtatatatgttttctcattatattattcaaatatattaaaatgacaatataattttaaattttgtaataactttacaaaactactaatgtgtaatattcatattatattttatatacgtgttaattattaattatttttaatatcagattttagttatttgtaaattatatatattcctatatggactctagactcgtcttataatatttttttaattccgaattttctgtaagttgtatttctatacatactctatgctcttcttccaatattatatatttttatttctgaatttttatattatattttatatacgtgttagttattaattatttttaatatcaaattttagttatttgtaaattatatatatttctatatggactctagactcgtcttttaatatatttttttaattccgaattttctgtaaattgtatttctatatagactctatgctcttcttctaatattatttatttttatttatgatttttttattatttctaattgtatttctacgtggactctaaactcatctttcaatattctttaacttttaatttcgaatttcagttacttctaaattgtattcctatattgaccttaaactcttcttcccatgtttttcttaattttgattttttttatttataaattatatttttatatggactctaaactctacttttaattttattatgtttattccaaattttagttagttttaaattcctatatggactctatactctacttctaatatttcttattttttaattccgaatttctattttatttttttcctagcctcctcttctaatattccttattttttaattccgaatttcaactatttctaaattgtatttctatatggactctagtctcctcttctaatattccttattttttttaatttcgaatttcaactatttctaaattgtatttctatatggactctgtcttttctttttctctccgattaatgtgagaatttctaggccatgagagcgaacgcggaggctcctttttctattcctttaataatataatagatttttttataattagtattttcattgttgttagatgataaaacatgattaatactttatgcgtgacttttctttttaattttttttataattttttcaaataagacggacggtcaaacatagaaactagggtttgtcttttttttttttttttttacctggggagtacacttgtacacgcaaactccgaagtccgaacacccgcgtaacaaaagccaatttatccgagtcattagttcaacttctaccacacgttgttatgataaagaaaacaaactgacaactggtgcccagtgtccatgcagcatggtcgtatctaccatcatcaacacgcatcacaaaagagcctcgaagatacacagtacaggtgcaaacaagcagggcaagccaaaaggcagatagccattgccttctttagttcttttctccaaacaactcaccagccaccgggagaaaacgacgctggaaagccagaagccccagaatttaagtactagatagagtaatccacttcagtacgcaacgaaccgccatgcgtggcgtgcaaccgcgacggcctcatgccatcgcctgacacgtacgcccgatctccagaaccgcatggttactgaaaaatacaggatataaacggacgtgtggtctcgtggatcggcctcagttccagccatttcgtcagtgagggagagagagaggtctgagaagaggagagagagccttctgcctgacaagaaattctgagaagagggagaatggcgtcggcgacgttcctggaggtgctcctagccatcttcctgccgccggtcggcgtcttcctgcgctacggcttgggtgtaagttgcatgcgaggcacacttaattcttaactgatatagttcttgttgcagtatgtgcttgtgtgtgtgtttgatgccgtttgatttggatcctgtttctgatttggggtactgtttgcagattgagttctggatcgatctcttgctgaccatactgggatacatcccggggatcatctacgcggtgtatgtgctggtggcctgatcgaaagagttcgagcagagccagcgtcgggtgatcgagcgatcgtgcaacggtgcaatagcaactgatgctgtgctgtggtgttaagagtacatttgtatgtgtgaaaatgtgatttatgcgatgagattagggtcttgacgtcttgtgatgagagtctttatgctattttagagactgtaattgggtgtcatgttgcttgtttctcttatctaagatacttttttgagaactcttatctaaggtactagcattgttatcattttttttaaaagaaacaatacacacacacaccaaacggtaccaaacgatgtgaagttttatacgtactaataagaaatcacaaattacaatcctaaaagattatagctagaaaaaagaaaggaaaacacgtcaagattatagctagaaaaaagagacaaaaacacgcaccacgggcttacataccaaagacgaacttagcaccaacctgacgcacgctatacgtggctggacgccattagccctgcggctccaagcccttcaccctctcctagaggtcactgagagagagaagatccattctccctagtgcagtcctgattgtgcatttgttactgcgatgctgcatttgcccatggttcgatttgttcggtcgttcatgtgatccacgcggcaaggcggcaacgtatttcacccacggcggtgcccacccagaacgccgtgtacgcctttgccaaaccttgttggatgccatcggggaggccgcggcgttgtggcaactggcacgtcgccagcaaccgacgagtattaattttagctggtatatagccacttcttgggagatgatcatgggttttttctgggaagccaaacccattacccaaaaccgcatcagcaaatccttggagatgatcttgcaggtgacatttggcattatccattttggattcacgatctttgagactttgaatccggctccggacaaaaccgacctgttattacattggcaaatcttgctaaaagatactgaaattgtgtggtattaatcgtaagacaccgaaaaaactaacttttagaggaaaacacttcataaaccaacctttagaggaaaacacttcataatagtggtattttgatagtgggcaccgcgccgactaaaatataattttgtgttgacgaggcgctaggggtcccattttttacgcggtgtgaccgaaatacctatgggacctcatcccctccctactctgctctgccgcgttgcggcgcacgctggcgtcagggttcacgttatcgtgcagtaaccacactatgagatcggttatcggctattagggtttgatgaattttgagcaaatttaaattttctaaaaaaaatcaaaacaaattagaaaaaaaacatgaatgtagctcttgaattgtagtgtcatatggtgaagaagttttttgaaaaagagttcgataaattcaaatttgagggctaaaccgaatgtcaattagaaaatagaaaaaaaaagaagaaatggaatgggcctgatctcggattgttcatgcggccattaaggccctttagtggagaaaatatctctcgagtcctctctccatgtctagtgatgttatttattgggtgttatatatatttatgtctagtgatgtaaatttatttttaatgataatgggtcatgcctaattttttaatttaacacttaaaagttagatttctaagtatcctatatattcttccaattatctctaatttctacacatatttaaccgtattttttgattttttttccaatttgtattcttcattgtcggcgataaagtgcggttatcgttgtatactgcgcggtaaccacggtaaaaccgcaaaactgttatttttttaatacgatttttgtgcggtttttcgtggttatcgcgtgaaaaccgtggtagccgcgctgccacggggtggtggtaaccccgggccaaacgatatggggaacctggccggcgtcacgttgcagcctcgccgcggctgctgaggttcgagttgagggcacgctgcaggtgacggcgggggtgctgccgtggctacttcgtgcgctcggcagctccgttggtggaaggagcagctaaaatctgcagcgaagaagatgacgtcctcattcatcgccaagccgtcgccatccccatctcttatgcattccctattctcctcatcatgccaaacaattcttcttttgataccgtcttatttcatctactgcagcgatgagaatgccgccatgccattgtcggctctagagcacgcaccgagcgctaccaccatgatgttgccgctgtttccggccgttgtgaaccaccccagaccgggccaccatgccatcgtgaccaccacagctttctctcgaagacccccaaaaatccccaagaatcatgcaccgaggtgggagattgacatcgtcttcctcacctttggccgccgcttcccctttccgattccgattcccctttctgattccgtccaattccttgggcgtgagccttcctactagctctactaatcttgtgcgcacgcttccttggtagaccttgggccgcttatcgctatcgacgtcgttctgtcatttctgccggtgccggagccattactcccgtcgccgctgttgtccaatcttcgccagcccgcgcacgacatcaggtgagtatccaagcaccatgtaggcacatatgcatgcacgggtttgcactaaaacaagctagatctcgacatgcactagcatgccaaagctcaccgccgctcgcaccgccgctgacactgattttggtcactactgtgcacgagaccaccaccattagctttgcaattctccactctacaaatcctcttttggccgcacctcgcgaaaccccttcgttcaccgccggtgccagcgacaagctcgtcgaccgccgctgcctctgctcctcctcatgctaaagtcactgccatgtgggcacatggaaattattgttttagtcggctcggtgtccaatggcaaaataccacgattataaagtgttttctcccaaaagttagtttttgcggtgtcttagacctaaaacaacacaatttcagtgtactatagtaaaatttgcctattatatatcaggtttaaccacagtattcgcacgacaggtttctcgattctattgtcaacgtcgaaataagaacaacacgggcacaggtctgtcccagacgttcacttctgagaggcgtataccacaaggatacaggggaaatttgattccagtttgcaaatgctcacgtggaacacgaagatggacgagtgatcaaaatcaaacgtcgaaacaggagccaacacgataagcattcagtatacatgcatacgataagagtctgaggcagctggtttccgcgacaagggaaacctctgtgaatgttgcacgcttagcatcgccatagaaattctcaaatatacggagtactccataattacatgcgcatttccttgccagcaaagtgattattttttactaatactagactaagtacatgagatgaaaacacccagtaacactcctggtttacaacactatcaaggtaggtcgtcacactcttaagtcctaaccgtttaatcttgccggcacgtatcatgagtatctgtgttcctcttgttgcatcgtttgctaagccctgcatatgcagcatagcatggtatatcagggcatcaggctgcaggctaaaagtataaggggcaggctgtaaatcttcagttcctttcatgtcacaatgcattcccttggatcagagttagatcttacattcctattggcatcatcaaacccagcgaagaaagactcatcatcatcacttgccaaatctgcagtagctggttcatgctccctgtacaattcagactgtctcctctgcaacctcaaaacatgcatgatgaggtcggatgaaagcgtcagctccggtcgagatgcatcaatttctctcgcccgcttgttggaagctattatctattaagggacaaaataaaaataacgtaaaacataaaaaaaaggaaatggataaatacaagtccaacattacttatgtcaatacaacttacttgctttgcgtttttaggcagcgacatcactttatttgctgaaggtgtccaaatcttgacagttttgtcaatcccactagtagctaggaacggaaaatgtggatggggttcaatgcaattaactacacttttgtcaccatgcatcatcctcaatagttcacctcccttctttctccatacaaatacattcccacaatccgatccactcaagacatattcatcgttcggtccaaaaaaactgactcccttaacagttcggaaatttctgtggcctgtgtatgcctgtggctgctcaagcctgtccaagaactctgcttgcgctgattcaggatttggaccaagacccatattgttttggaataaatagatatgttcatcattgtaagagacaagtatctcccttgcgtaggagtatgcaataccagttatgtggaccttcccacccataaggtgcttagggcagaaggtatctacaggttggttcatgtcatttgaagcacccaactggattctcctcaaatcatatacccgcacatactcatcagaaccaccaattgaaagataattagggttccaagggtcaatggcaatggtattaagccttacacgacgcctgctatttgagaatgaatagcagctgaagagcttcattggtgaatcattccgcaagtcaaactgtaaagaaataaatgttcaatgtacatgctatcacaaaacagttgccacaattgcagaaaattgttttgagtgacatacatgttgtaccaaaccatcttccccgcaactgtaaaatatgtaaggacttcctggttcaatggccaacttatgtgcacgatcatcgtgcaccccaatttgtttggttgtgacttcaccaccctcgttcagttgtcccactctaacctgggtatatggcatgttatcaaaaattatatcggattgcaaataacagaaaagtaaaatatgctaatgtgtttatcactttatctactaatattttcagttgattggtagagaagtcatttccaatataaccaacaagtgtaaaaacagagatataggtttacttcaaaactacatccattgcaaacaaaataagaaaataaactacaagtaaaagggttagatatatctatggttttttttgttgcaaacttactatgttatacgcaaaaaaaaacctagtctttctcttagtaattgcatgcaattcagagatctaagtctctttccaaatagtgcatgtaccagtaaacgaatacaattattataatgttccatgcaacatgaagctgattgctacgacttgtggagaacacaaaagtaaccgcacaacatgcttatgggaataattgcgaataacatggtggtattaaattagtattactattagaacacaactcagatgttgatagatacaaacctgaccatcagcagcaacagttacaatggcgctatcatctgtaaatggcattacacgagcatggaaaacattttcttgatggccagaagggtaaatgagcctttgtgttttagcaagccaatcccataatatgatgtccatgtcgtccgaaccagacacaaggaggttaccagcaggattgaagctgacagtattaacacaaccatcatggcctcgcaactttccatactgatgcatccgcatcactaggccctaaacaattggaggaaagaagaattgtaactagtccaacatgacaatgagatattcggtgttatagaaagaagcaattacaaaaaaaaaaaaatcagaaaggttgtcacatgactttagtaatttatctcaggaagtactccaatcatacatatacacattcttgaacaacaataacaatcacaataaactagtatgatcagacttcaatgaaacatccagaaaatgttctacaagttacaaacaaatgaaacggtagtataatcaaaatttatccaaacaatattatcaatttaagtgtgcctaatccatggaccctgacagtactcaattcgtatcggcggactcataaagtcgtaagatatgaattttacagcattaactccataatgcctatgcaaactgaactgttacgaacaagaacaagtagtatcaaatagtacttcacgattcacgaatacggccatcatgatccatcctcccttacgggcaaaaatacgcggccttattacttccttagtgacttgcgaactctacaagatcaacacctagaaggttccaagaaatcagacaccaggatcatatgggattaaaaaccgagaaaggggcacctcggagccgctgattcggcgcgaggaggcgcgcggggtggaggagccgatctcttgcctgccgacctcaaagaagcagctagccgcccgacgacaagcggcctcgctggcgacggccatggtggaagctgcggcggtgcagtgccgagggggcaggaggaggaaacgagacaaagcggaaggggatttccgcgggtttagccggcgtcgagcttgtgctttctcgaagatgttcctgggatttggacccctcgtctcatcgagtcacatacttttgctttgtttttttttttcactttagttattgcctgttttgtttttctttttcctttttcatctactgaggattgggttgcctgaaacgcatctgcggttgggagtaaaggtactccctccgtcccataatacaagcgattttgagtttttatttgaactgttttgagtttttatttgaactgtttgaccactcgtcttatttaaaaaatttatgcaaatataggaaaataaaaagtactttagataataaattaagtcataaaaaataaataataattccaaaattttttaataagacgagtcgttaaacagttcaagcaaaagctcaaaatcccttgtattatggggacggagggagtaataatctccagcattgttataaatgttacatgtcctctattcggtattttagttggatgtcattgggagggggacagggatttgtcatataatctcaaatatttttgttttttttttctttggctcgttgaatgtgtgctgtttaacagtgaccgagatgtaattgttattattatcttaaataaatttggaaagactagatggagatatagctatagtgcttgatcggttgtgttggctgcccattcacagctgcagcaaatactctttggtttggattggggctgactgacagccagcacttccgatcaaccccatacttaaaattaattttgagcgttaaaaatattatattttaaaacgtggtagcatatgtgacgataccatacaccacgattttaacaaggaagcagagacacgcactatatctatatgtgtatctacaagcagcctgcatccgtacttgagttgaatggtacttaggctcagttatattcttcaactccaaattctaactttctcgttttttcatttgcacgtttttttaatatgttaaatggtgtgtttttaaaaaaaattcgatatagaaagttgttttaagaaagcaaataaatccattttttaaatttataatagttaatatttaattaatcatatgctaatgatatttcttgttttgcgtgaaaaaaaaactatctcccaaagagagatcgaacggggcctaaaaccatatatcggccaagatatatgcgtattaatctcacccttgctgagtcacgaccatctatgtcgtgactaagatcttttttttttttttgagagattaaggtttcgagaaacagctggtgagaatatatatggaaaagctggaaaatccagtttttgtcttctagtttgttttctaaattacacaactacaattttatagaatttaagtgaaaatatgaactatttgacaaagcttctgacaactgaagattctataagatgccactgccaaaaactcccccaaacaggaggtagggatggtgtcgtgccctgcgagttgtactgccacaatactgtgtatatcatccatctcaaaataaaacaattacaagttattcagattcatagcctgtaattgatttatttgaagatggaggaatttcgtctctcataggtataatgtatacttacccatatacgtaagattgactagtgagctcgcttgcatgtctcgattcatagtatgatgatatatcttatctatccaaaagttgttatattttggaacggagggagtagttaagaaaacataattgttttaactatgctcttctaatgtattgacatatatattttttttggcaaattttgctacaggacacagtgactttgcggttttaggcataggacaccgcacaaagtcacttttggaggaagacactctcaaaatgtggtaatttgctagcggacaccgcacccattaaaataataatttccggtaggagggaagagagaaatcacgtgaaatgtcaaaaatacccctggacccagttgtcagctctcccatctcttatctctcacccaaccatggcaggtggcgcggcaagtccttcgcggcggcgctggccgtggcctgcttcctcctcctcgccgccttcgcttcctcgtcggcgccctcgtctccggctccgccatggtgtggctgcaggacaacttcggctggctcgtcggcttcggcgtcccggctctctgcaccgtcctcgccatggccagcttcctcctcggctccgccatgtacaggtaccaccaggcaccagcctcatggcagaactgtggtgcgagcttgccaggtcgtcgtcgccgccatcagtaagaggaacgtcgcgctgcctcacgacagcttcgtcctctacgacggtccgccaaagtgcgggcagaagctggcgcacaccgaccagttcaggttcttggacaacgcggcgaggctgcggcggcggtggcggtgtcatcgttggtgggggggggggcgaggctgcggcggcagcggcgcagccgtggaggctgtgcacagtgacgcaggtggatgagctgaaggtgatcgtgcggatgctgccggtgtggaccagggccaccgggatcgtctactgcatggtgctcgtccagcagccgctcttcacggtgcagggccgcgccatgcgccgccgcctcgggttcggagctggcgcgtttgccatcccggcggcgtcgctccactctgtctacgccgccgccatgctcatcctcgtgccgctctacgatgccgcggtagtgcccgcggtgcggcggctcaccagcaacaagagggggctgaccgagatgcagcgcatcggtgccggcatgacgctgtccgtcgccgccatggccgccgcggcgaccgtcgaggggagacggctggcggtggggaaggcagcggcgcggctcggctccggcaagcgccgagcggagcaacagttcggtgggggtggagatggagcggtgtcggcgacgacgtcttctccccgacggcagcgcggagctggatgctggaaaagacgagcacggccgtggcgccgaacgagttgagctgcttgatggagaagaggcgccgtccatgacgtcggtgaccggaggatatgcaggattgtgagagggagttcggggaagaatataacaagtgggcctaggggtatttatgacatttcacatgatttttttctccccttctatcggaaattattattttaatgagtgcggtgtccactagaaaattaccacattttaagagtgtcttcctccaaaaataactttgtgcggtgtcccacagctaataccacgaagtcgcgatgtcctatagaaaaatttgtctcttttttcacgttcgcgaaatgtagttacaaatctcttttaggcaatataaataaacgtaaaagtgacaaatgaaaaatgatccatttataaacagaaatgtaacaaatactcataggagttaaagggcctgttcactttgatgaaaaaaaacattatcaaattttggcttgccaaaatttttataggatttcttatatagttattaaaatttggcagcaaattaaatatagccatttttttaacaattttattaaaatttagtaagattgaaaatggtataaaagtgaacaggccctacattcgtagaagtcaggtgcgcgttagttttagaaggttgtgccacgactcacgtccgaccctaccaggcctgcttggaagcctgttttgggcctaaacgagtgtacaccaccggcccgtgttctgtgagaaccatccatccatccatctatctatctatctatctatctatctattatattattaaaacagctttgaaatgaggcaccatgttcgctgtgggggctagaaattcccacgttaatcggagaaaaaagaaaaatctatactattagattatactgggactaaactttgatggtgtagattaactttgataatagaagtctgaatagaaaacaactgctagatcaaacggacaacactgattaagtaatagaatacaagtccaaataggtggacgtactcctgctttgattctttccttatcctatatggatactaaggatcaatcaacagatcaggtgattaggattcaaacacagtgcgtgcatatatattttggagccggtataattagaattaaaatgtgatattttttttacctatggatgaaaaaaaaagagtaaatagaccagaaaacttatgcattggtagagatacatctctccgtccaactcgctaaggcgtgtccaaatttagtacagtcttaaaaactaaactttaactttaaatttttcattgtagcaacaaaatcataattatataaaattaaatttaaatgaatatccaatgatattatttttaacaactaaaatttaatttataataaaatacagctttgaaagaaggcaccacgttcactgtgggggctagaaatttccacattaatcggagaaaaagaaaaaaaagaaaaggagagtccaagtagaaatacaatctaaaaatagctgaaattcggaattaaaaataagtaatattgaaagaagtttccatataataatccaatacaagattaatcaaaattcgaaataaaaataaaataaaatccaaaattagaaagaaaaaaaagagacccaagtagaaatacaattttaaaatagctgaaattcggaaataaaaataagcaatattgaaagaagtttccatataagaacccaatacgagattaataaaaattcaaaataaaaataaaataaaataaaaattagaaaagaaaaggatagtccaagtaggaatacaattttaaaatagctgaaaatcagaattaaaataaggaatattaaaaaaagagtccatataagaacccaattacgagattaattaaaatttggaataaaaaaaataaaatctgaaattagcaaaaaaaaaagagttcaagtaggaatacaatttaaaattagctgaaatttggaattaaaaataagcaatattcaaataagaatccatataagaatccaatacgagattaattaaaattaagaataaaaaataaaataatattcaaaattagaaaaattaaaagagaattcaagtaggaatacaattttgaaacaactgaaattaaaaataaaaaataaaaatattaaaagaacacaatacgatattaattaaaatttgaaaaaaaaaataaattctgaaattagaaaaagaaaaataagatttcaattaggaatacaatttataaataactaaaacttgtgataaaaataaagactattgaaagaaaagaccatctaaaacacatgacgagataaattaagtaacaggcctttaaaggagtagagtggtggcggttgatacgacatataaaaactgttaataaaacaccaaatagaatcccaatgacgattaaaaggagggacgacaggcaggccgtgaagcaaacgagcaatgcaattaccgggactactagaaagtaaaaaaaaataaaccccattgacaatcatattcaatttttaaaatctcaatgacaataaaaaggagaagtagtgggcggggtgtatagtagtatagtttcagagccgctgatgtttgacgtgatttctagaaaataaaaaatgaattctagcgatagttatgctcaatttttagaatcacaatgataataaagaaagagtaggcggcggacgggctatagaggagcatagtggcatcgtttgacgaggcttctaaaaaattataaaaaatgaaacccaacgagacaataaactctaaaaactacaaggtttaatttttaaaggttccgaactttgaaaaagtaaaaaaacaatgataatcatgttcgattttaaaatctcaatgacaataaagaagggacgcagtgggcgagccgtagagaagtacaatgtcaaagccgctgacggtttggcgggatttctagaaagtaaaaatgaaccgaaacgataattatgttcgatttttaaaatctcagtgacaattaagaaaagagacagtggacgggccatagaggagtataatgacaacgtttgacgaggcatctagaaattataaaaacgaaacccaacgtgacaataaactctaaaaactataagatccaatttttaaaggtttcaaggagaatgaatagaaatagtggtagatcgagcaagcaaataaagaagcagatgtcataaggggtagcaactggtgtgacttttaaaaaatatatataattagaaacacggggatgataaggtttaatctttcaaactcttaagacatgagatagctatttaataaattttaagtaaaatcatactaaaaaatatatgattttatttgggtgctagccgcacaattgtgcgggccacccagttagttactaattcagcccaactgcgtgctttgtattgtacgaaccggaatcaaattaggaccttaatggggagaaataattcaatcataacgaccgacacactacaatcttgttattcgatcgacatcggaaagcttcggatctaaatcgcacaccggcggagctccgttcaccggcaggcggcagcccaccctgcctgcttatctccccgagcaattctcagctctgagccgcaatctcggcgccgcgtcgagcacgcgactaacaattcagagcaccacctcggttattcctcctcaatgcatggctccatccatccacgcgacgaatcgatcgaacagcctgtcctagccgagcacccggatcgcgcatctgtggtctgataagctagctagcggactagtttccagccaattttctagccgctagccacgccgtgatctcgaaggcgattaggcgagaggcgacggtggcatgtacggtgctgccgctaattcctctagctggcctgtaccatcgcgtcgctcacgcacgcaagaagcctctgtttacagccgtgcggtgcatattggtgcatatcatgcatacatgctgacgcgagcggccggccggggtctctctcatcgatcgatcgatctaagcccaattattagaacgcacagtagggactagggagcgagccatctatcaggcagacaggccggggccttgcttacgtcgtcgatcaagttggtcccttttggtcgtgttccactgttctcccaccggccttgctggcttccagtcgaactgacaacacactgttggtacgtacaggtacatgctccgagtgcaattgggacgcatcgatcagctcagagtttttggaccatatataatcggtaccactgcagcattacagataaaaatcctgatattattgtaacagaccaggataaatctctcacgctggatcgatctacgacgccgatgttcatcatttcacccacgaaattaaagcggtgaacaaattgacgcgagcaagtggcgagaaaataacgcaaacacacaagaggctgccaggcactagctgttttctacttctcttctcttctctctcaagctgtcgttctaagctctctgccatgaacgtgcacgcagacatgtcgtactatactactgcttatttattcttctctagttttttttctctctcccggttaggagcgtgcaggaagtacaggatcgaacgtggcagcgggtactaacctaggtgggtggcctcaaatcgacgctcaaatccaacatggctgcctgcatgagtccatgattttcattcaacacacacacgcagatagtcacggtctcgcagacatgcgcgacatgcggagatgaaagaggaggggaatcgaagctaagcggtgacagatcgtcgacgctgaaatcgccagtcgactcgatctctctccctacccgcattatgcctgcgtgctgccggccggccagctcgcccacacatgtgcaccacctggtgtcatggggattaaaaaggtggacagaacattgcgtcgtgtgcggtgcccatggccatggggatcatcatatttaacacattctcgggtgcgtgacacacatccgtccacccttgctcctcaagctagctaggtgcactgaacataatttgactaggaaaagtatactgatgagtgagaaccggctgcagtctagaggatcaaatttgactaaacataatgttcagtttggagctagtatcaactgctatacatgtttggaattcagaaatgccaatcttttgtctgtctggagtagctgacattcatccataaggttgcttagcagttagtaactgagagcgatttgatgaaaagggcaaagcaataaaaaaataaagatgagaaaaggctgcccagatgacaacatgcatgggccatcaactgtccgtctaatctaatccgatctagaaaaacaaagccaaccccaaaccagcactgccaatatgcccacctgctgctggctctctgcaaaacccggccagcctttctaaccccatattgcatctgatgatgattacaccgcggttgttttctccatcctttttctcccccctttgcccctttgagaggcatgcaagccagctcactcttctggtcttacagctaactcccagcccactcttgtcccttgctacttgctactagtcttctcccctcctctcggtccagtcaaaccaagactaaattctctctctcataccgtggcagtgcaatgcggcgtgagcctgtgtaatgcgtgtgtggcatccgggcatgtagacaggagtaacagttgtccacgttacgggcacgcagcgaggcagcagctggtgcagtgggtgaggagaggaggagggagattctcgctgttctgacgtgggcgcatgtgcctgcgcccctcctctgccgtcttgcatgcggtgtgctccggcccggccccatgcatcagctcgtatccaccgcgagatccgaccgtcgtctcgcctcatcggagactcgcgtgtgcgcgcgcgcgcgtatgacagtatgcatgacagcatgagcgcgtacgtcctgctgcactgcgggcgcgaggctgcctcttcgtcgtgtcgcggcgcggcgccgttaattgctgccaccatcggaaacgtgtacgtgcggcgtcagggtctcgtacgacgatctggtcgtagctgccaccgctgaatcgaggacagcggaaacagtgtcgcgcaccggtaatcgctgcgctggtcgatgctcgatggtacgggtgggctcgacgggcatgtgacgatcgatgtgtgtgactgtactcatcgatatggtatacggtcgggggcggagctgaaccaccggagtcaccaatgtactaatccctccgtccttaaatatttgacgccattaaatttttcaaacatatttaaccgttcgttttattcagcgccgacggagagacgtacatgccggggtctatttgtagggatgcaaagtgggtagtctcactatccgcataaatattcatttgctagtttatttcagtacaaaattttgtagaaaaaataaactagaagtgtgataagcaagtaagaaaaacccgcttgtctgctccatttacatccctatctgtgagcatagattataacatcacatatttatttgttatatacaactccaatatggatatatatggttgagaaatggttgtattttaaaaaagttaacttcttttctacttaggcacattagttaaacatgtatacattatataatctacaatcgtttttttttgtataaaggtatttgtttatttgtaatgctaattagactatgataagagaggttttcgtttcctcatgcaaagatcagaactatagtaaatgcttattagaccaaagtatatcaaccaaacaaagttgactttaatgggcttggtaggaggcagtgaaacaagtaaactgttttactgccctgtgagagcgtgagagctgaagtgattggctggggtcattagtctttagctaatggggtcacatgtggcaaaatataagacattaccttagatagctggatgtcatcggggtcagatgaccccagtaaatgtactgtggatccgcccctgtatacggtgcatgcaaactgcatgattagcgctctgacgactaacgagggactcgctattttaaggacgctggctagactgacgcttctggactgtgggtttgggttggtcgcggctactctatatggggaatggttagaataatgtggtatagctgacgcagatgatggaaaatgctttgctagaccttttgtttggaacagcgagatcagccagcggacgagcatgtacaggccgggcgtcatatagattctctctgtccacgagtatagatatttgcatccgtacgtctatctatttctgcctttcgcttttgagtatcggtagacgtgatgttcgaagcacttctcaaacactagtaaagcaccctgatgaagatggacaagaatattgctcgattgcgggatcagtatagtacgtgaaacagtcacttactcgtacatgtccttccatttctagctgtgtctcacatgaggagtactcgccaggtttcaagtcactctttttctaccttctccgtgggatctcagggacacacacgtacgcatctcgtcatcgtcggatcgtccccccagtacaccatatccatgtgcatgcctcctagtatctccgaacaaagttccagttctacccaaggcaatgccgcaggcgactgaccggacactagatctgccgatcgaccgatccagcaaggcgcgcatgcagccggaggtgtgcgcgcgcggctgactgcgcctctacgcgattccgcggcgaaatcatggtgtttcacgagcaaaaagaggagagacgtacgttctcccatcccatctcccgatcgatcggtcgcggggctcgcgggctgggtggccggggagcaagtggcaaattaaactggcgatgcatgggtcgcccactcatcatcgccgagacaccaacccaccgggatcgcgcgatcgatcgggcgcatgcgtgcagtcgctagctcgtcgcgccgtgcgggcgcaggggcgcgcggcccctcctcacgtgaggggagggagggagccgggcgggaccgcggcgcatagtccgccggtcccgcggtggcgtacgtcaccggaaatactgctacactgcgagtgtatgctttggttttgcgatgccggcgaattaacgcgagatctgcccgatcccctccgtgcaaatgccgcgtccattatatttgggttggggtcacagtctcagtttgcccatgccgtcgtgctgctctttatggaacacaatgatgtgtatgtgagggaatttgtagccctagcttgtaggtttaatgtgcaataccctcagtcgatcgatctgcttcatcttaggttagaagcagattttacgtgagacaacaactggataaggggcggcagggacgttgtttttgttacgatgagtagcagttaggagtactagtaatataggaatagtatactctgcatctagtgtatatatacttttggggtctgagtcttatgttttcctgccagcaaaatgacgatccctaccggataccctcacgtgctagctagctagctttagatgtgttttcaggtgtaccgtatgactgtattttctgtcaacttaaaaatacactcacatgcagcaactgtatgcattccccagtgcctgatttgcaaccctaaacagcactactatacaatacgaggaaaggaaacaggaaaagcttcttttctgagaatcacaatcgccctgatcaatcgtcaagattaacatggttcttaattaaaaacagctaaagactacagtaatatatagggcaacatgatcacgcagctgagagcgagcgagcgagctagctaagcaaatcaaaggcgcgagcacgttgtgtggtaaaggcgaaactgcaaagccagctggttccatcttctcgtacagctccccatatggccactcgtccatctctcgttttctccagccaggtaaataaacttgtaatcgaatcatctcacagcctaatacattgtacggacacacgcgagttactaccaatatgaactgtcaaattaattaaaccaccccaaagacaactcttcttcaggaagattaattttggttactaaggcggggtttagttcctaattttattttccaaaaacatcacatcaaatcttttgacacatgtataaaatattaaaaatagataaaataaaaactaattgcacagtttacatgaaaatcgcgagacgaatcttttgagcttaattagttcataattaaccataaatgctaccatgctaatgacggtttaattaggcttaaaagattcgtctcgcaagtttttagtcgagttataaaattggttatttcatttgtgtccgaaacctgactacgcagaataatcagagtggtgtgtagagatcttagccggagagtgaatgtgtgttgcagcctgcaggaattttctgttagttacactagtcggagaggagagagagagagaggccaagtgaggcacaggacagagttgccaggctagaggagcagtgcgacaggctagtagtagcagctctcctgtttccgttatccagcccacccaaccaccactctccctccttccccccaagaatttataaactccggtctatataagcagccgcagtagcgcaccacatagctcgctctcgctcgcctcccccttcgcatatcaccgcgcacgaacgcacgtcgcagctagcgggtcgtctcagctcggcgtggtgtcgttgaggtggtcggtagctaggtagctaggcgcgcgcggccccggccacgaagagagatgacgatgatgggcgggcagccgcagcagacaccgccgccgccgcaggtggtgcaggtgcagcagccggcggcggcgttcggtgacacgacactgaccaaggtgttcgtgggaggactggcgtgggagacgcacaaggacacgctccgcgagcacttcgagcgcttcggcgacatcctcgaggccgtcatcatctccgacaagctcaccggccgctccaagggctacggattcgtcagttccaccactccacgctctcattctcgctttcgtgtcgcgacgtgcgcgaggttcggttttcttacggtggtgtggctgcaggtgacgttcaaggaggcggacgcggccaagaaggcgtgcgaggacgccacaccggtcatcaacggccgccgcgccaactgcaacctcgcgtccctcggcgccaagccgcgcgcccagccgccgcacctcctccgcccctcgccgccggcaaccccggggccgcacgcccccgcgcttccctcccctcaccaccaccagcccgcgccaggtacgcacccggtgcagtttttaaccaacgctagttacagctgtttgttaattaacgtgcgtcgtccacggtcgtactgacgagtgagatcacatgcctttggcgagcagccatcgcggtggggtccaggggcgtgtcgccggtgccgtggtactaccacccctccacgacgccgcctccgccgccgccgccggccgcgcactacgccgcccatggcggccaccaccagcaataccacggcgttctccccttctaccccgccgccaccacctacgggtacgtgctctcctccccttctaccgtactacaattctactcgatctcttcgcgcgcacaacgtttcgaacccaaacggctccaaaaaaagaagaaaaaaaaacggacgagaattttgcgccgccatggcgcgacgtttcggaggggcggcgcgcgtgaattctctcttctcgctagctagtatctccgcgctcgcgcgcgtacgaggatccgtgtccggtgcgcgcccggacggggcggagggggggaccggtgcatggggtggggcacatgcgaggcagtggctggctaggggggcacgcgacgcgacaaggagcgcgcaggcacaggctggacatggaccggaccagctgcctcgtcgtgctctcacgtgcccacgtgccggcctgcacgggatgcagggaaagaacgcagaagaacaggggagggcaaaaaaagaaaaaattaacggctgcgcacgcagttaaagcagcgcccatagttgtcaattgattacgcgatctgacttttaggtgccctattattataaccaagtgttacaccagcgataattcgttgcactgattgattggtttggctcgatcaggtactccccgaactacgtcgctgacctgagctacaacgcggtaagccttcttgatctacccaattctcctctccctgatgcaccaaaacgtcctaaatgttgccttgcagccatgtacggtttcatatgaactgagaataattttgctttgtgacgcgggagcagaagctaggccaggcggcagcggcgcatggcacgaacggggcctacctgcaggggcacttctcgtacccggcggcggcgcagggaggcatgctcgcggcgaacgggatgatgcccgtgtacccgtactaccagtaccactaccatggcgcgcagggcctgggcgtccccgccgcccacttcttcccgccggtctcggccgcagccgtcaccaccgtgcccgccatcatctccaagcccaccgtcatggcccctcccaaaggtaaaacatgctactgattcacgagcactacaagttcttaattccatggacagactcctgtttaggaacattgcgatgaacaattgcactagaggatcaatgtagctgcattttttagtcggtagttgcattgcaaaggaaggagttaaacccgttacctatgtcgacaaacttttctgaatctgaacttgaacttcaatcaaagagagacagctacgaagatactactaatcaccttaactaccatcagttagtacagctttcgcatgtgcactgtcttttgctgcccaaagctttgcagatctccagctagctacacatgatgtaaccagttcgcaggatctaccgagtacaccgatctaactctggtgcctgcatgtttgtgatgtacatgtactgcagtggagcaggtgacgggatgcagttgaaggggcacggcgacagtgcgaggaattaagaggaggccaaaggtgctctggcgattaacaagctgcacatgaagggttcgtccggttgtcggactaggctgcctattcgattcgtttaattcgctctaactcgtgcgtccatgggggcgcacgcccatcaaaaatctgtaacaagaaagattcaattcgtctctcgtttaccagcgtatttttcaatggtaaaccccttctttttccaagtgtctgtagtccagtcgctgcaggggacagtgaacctgaataaatcgtcataatctctcgtcatatattctctgaaaattctgtctggaaccatatgatgaatctgatgaaatatgatactcctactacagtatcactcgctatgactcttgtttggttcccacttcaaccagctctgcaaactattatgccccttgttttactgcagtagtaactcaggtttttcttttagatgaaaaaaacaactaagtttggtgcacatatgtgagctcaattattggttcccacgttgcggttattttcacggactgaattatcagttctacattgctaaactgtccattgttcagctcggtacttagtgcctatcgtcagagaaaacagagcttttgatggattccgcgagagtctaaatgcgcaagtttgctggacttcaaatgaatagacgctggaaaccacacgtctaattactcccgtttaattggcaaaatctcgaattatcgacacttcgcctacttccacacgttgtttacctcaatccacaagaacataatacgatagcgctactgctcattctcttctgcaatttgacgcgcatttagccactatcgtacatagctaccaatacagtagacacggagttttcattagcttaccttaccttatcagcattttgtaaacctggcctactctgcgatgaaaatcacatgtttgagaggatgacgttatgtgttcacgctatatataaccttgaccatcaatagctacccctccacatggacagtggaggtgataaggaagatggaaaagaggaagatggaagtaacgtgcatggcaagggtaagggtgaagacatatccaatcttaaggatggttctataatggacaatggtggccagaacagtggttctattttcagagaaaggggcttcttctactccatctacccaggtaatgttgttgcctgaatcaaagggcttacaacatcttatgagagtatgatggattagcacaggacacaactgtggtggagtcagtccagtcccaggacagtttagctctaaagctacatgttgttccagaggcgttaatagccccaaccagacagatcaagagaagggcaagtgatagactagcttcacactgcaaagggcagaaaagatgaaggcaaggaggaaccttgaaaatcagaatgtcaaatgtactattcaggacaacatattagtttcggggttggacccaaccacaaaatgcatgtcataaacttgagtcaacgattatatatatattttttgtcaatttcggatataggttcttttatcttgtgttgcagtgttggtgtctttttagtttgtgttttctttacattatgtcagtgtgtgctgagtttgtccatgtgtgaactttgtaataattagttgtagctcgttgagtaaaagccatagtgttattatcttaaaaaaaatagctactcctattcatggtgtaatcttaagtttccagtaaatttacttttatgtagactctatttcataaggtaaggtaaactacaatgaagcagaacagcatcagtgtaacaacagctcactgtgggattaaattcactgtcataatatattagggggtcctggagcaaagtttggtacaggcaatcttcagagaaaaaacaaaatgggggaacatgaacttacaataaccgatgaatgactcaaacaatttccacgaactaaccgtattaaccaatgttggcaacgtgagccacagttctctaaacacaaaaaaaaaatattctattgatcatttccattagcaaaacaaaatgcctcccagatcccatgggcaaactacatgtattattggacttctatccttgctatccaatcaggctccatacagtgcaggatttgttgcaattgtccccgatgtagttccccgtcatatattagccctgggcatccaccggaatgagaaaggacagccatatttacggcattctaaaatattcagggcttgttgcgttttttggattcactgtaaagaattacgcctataactgtaagagtgtaaccgagcattccggttacagatacgggattcctgaatattagaattgagacaacaactgccacagcacctttcgcgttacctaggacctggaaacaacagtggatgttaaaaacttataaacacaaaattacaattcagtctgctacggttaaatgatcataaatgaaccaatgatctaatagcaactacttgaacaaattagtggtgtttcagcaagtggttacaaatcataacagatcatgttttgtgcataaaaaatatgaataatagcacagatgatacaatgatcgtcattgtgtacaagtcgaccatcaaggcaccaaggaggcagagtcgcagagaagtgtaaagcagagcagagatggtgagcaacaaaaatcagggattgggagggaggcagagcaaagcagattgggggagctctacagcagagccaagcaaactgggtaagaatgcacatgcctactcagacctagagcttggccaggcacaagatgaggaatcctgacaggcacttagatagattggagtctcagagggagcacgatagaggggggcttggccagtggcaggcagaggagtaaagcaccattgagaggtaagcctctgcagcatcctacctggattgcctagatgccaacgcgtagcctagagacctagacagtgccgtaataacaatactagatagtaaacactatctatatcactatcttaatagggcaatagttgttggcgggtcaattaagttgcattctccttttgtattatcaaatgggcttcagtcctccacaagattgtcaatgatagcagtgcaacagacaatcttctcatcaggtttgatagataacttgaacaatgtgtcaagctgtatgctagttactgaagactaatgctactatttgcgaattacttgtccacatcccaatattattaaaatagaacttatttactcaactgagcagtgggacaaatagaaccaaaatatgctaacaatcttaaggtaacccaatggaattacggaaattttaagagggaactaagctaagcacttttagttcaaatcaatggacatagtaaacatatttccaagctcagtagctggctggccgataagtttaaaactttgatttgatgtcattccctgggccacctcaaaattctacagttaaacttatagaagctaaatttgttaactgtggaatgcgaatattgctgtgtaattatgtattaccaatcaatcaaacgccattctaaaatcatgtatggaagtgagtgggtacactgtactaacatgtcagcaacaaatttgaaatctaaaacaatttcttgaacactgctaaattctactccagtaacaagagatgaattaaagagtgagactccatgccatacctgtagagtcaatgcactagtatgcttagtcaccaagaaattggtcaaattgacaaaatatgccaaacaggaattgaacagcagcaaccaaacaatcgtggtgtcctttttggccagttctattgtaatgccaacaacgttgtcctccatgaagatggtagcagggagcaagagaataacagcaattggagccatgtataaaagcaaattcatagaattaagcttctccctgcaaaatggcagaatatgcatcgtcaaattttaccctgaaaaagataaaccctcaaaatctgcacattactcaacaggaatatcactttcatgaaagcaatagtttgaatccagaccatgcatatcagttatgatctgtacataaaatgaaaagaaaagaggtttacccctcggatgaaaggaggattccttgcaacaccgtcttcaatgcccttgcagcagtggccccaatgcacatgatgaatccaaacagatgaaagctaggctctccctgtaagttcagtttgcatgatccatattaattagttgatgacagaagcaatgtatacccttaagcagataattaaacaagaaggtacacagagcttcccacaattctatggggtgcaatgctgctagccaacccacaaatttgctagccttggatgctgtatttaatttaaaagcagtaggcaccatacaactgcgcagctaaacttgtattcgctatacaactcataatatgtgttataaaaattgtgttgtatacttgcgccatttgttatacatctatgacaactctaattaatctatgatgacttcatgatgtaggcccatcacaataagtgatattttttgttctcattcaattaatgatataggattctcctattttcttagattacctgattttaagattattagagtgcctagaagcacaacaattgtttctaatcagctggcagcataatacctattgcatggaactcaatgtaagagcaccacaattaacgtcacaaggttcaagaacactttgaagaacacaattcttcatgtgtcaatctaacgagattccacgtatcaatttcatggcaatcgaaaccgatggctatttccatcacctacactggaatatcacaatatatctcccaaatcccaacgcattgtaactcaaccaataaggttggtactacagagcaaaaaaaatggcttggacgtccacaacttcaccggtgaagttttacagtagaacaagtctacctacagaggaacctatctccctcaatgactctggcctgtgggttatcaccaagcaaacaattatttggatgttgctctgggctccggccaataaaacaagaaggatactgaaaagagctgtatcagctacccctacaaactggtgaggaaaaaaaatctaaccatgtgtcaaaagagcaattttctcaaattggtgggtgcatttgtgtcaggaatttagtaaatactaatgaattggtcccaaaaaaaatcataacccaaatttccaacataaggagtagtagaaaaggaaccatcagcacttcagatcatctgaagcaagccactaacgtaataaagggattcccataaggcacaataaacagatcctcctgtttgttagccttctcagctgctagatctcacgagaactgagccccccatcatcatccagccatggccggattccccctcagatccaacagcagcggcaccagatctaccaaaaaaggggatagatagggagaggtaggcagagcaacaactcactccgctggcgatcatgacgccggtgacgacggggacgagggtgaggtaggtgacccaggactccctcttgacggtcatgatgtaggcgaagacggcggtgaagaagggggtggtggcgccgacggcctggttgaaggagacggggaggtagcggagcgagacgttgccggagacgacggagccgcagaagacgaggctgagggcggcgatcttggcgagctggacgcgggagcggacgagctgcatggggacgacgcggagccaggcgatggcggcgtaggaaaggagggcgcaggcggacatgtggcacatggtgaggaagattgggtacttgaagccgtagttgctgaggaggtacttgttgagaaggaggacgccgatgttggaggagtaccaggcggtgacgagccccacggtgaagaagcggccgttcgggaggccgcccgcgccgcccggcgacggcgcggcgccgcccttggccgtcatcgcgggcgctcggtggtggtggatctgaggagggagggttgaattggtgggggtaggtcggggtcgcgggcttggcttccttgccttccttccttccttcctccggggcggaggcgtgtgcgtgagcctgctgtgtttatggagatggaggtgaggagggaggagacgcgcctcctgtcggtgactcggtggatggacggagaacggtggcgaggaggcgagagcgagatttctttctcgcttcctttttacctgtttttttaattatataaggctttttaaggctggttttggcttaggtttatttattattgaccagtagtagtagtaggcactggagtagataatgtactagacggagtaatttttcaatgctgctgtttagattagacgtagtcatgcgtatataccttcccagcctaaatgtacattgtttggtccttcgtatcctgcgaattttgctacataacatttaaaatttatataatttactgatagacatcgaaaaaatatgtcacgacaaaacgacaaatgacacttttgactcaattagagaaatgaattcgagaaagacgaaaatgcccaccacatgcttcagacatggtgttagagtgaaaatttataaattatgcatacatcgtattccatgttcactttaggcttagctcaaaagcttttgaccgtaggagtatttttgtctttttaaagaatttttcgctctaatcgagtcaaaaataacctgcaacaaattacctatggttttataatgtgtggcaccgttcacttttgatgtgatgtttgatcattcatcttattaaaaaagaaatatgtaaatatcatttattttgttgtgacttattttatcatcaaagaaactatagtcttaacttatacttttacatgtgtataccaaatttatttattttaataaaacgaatggaccaatgttatatgaaaagtcaatggtgttattaaaaaacaaaggtaatagtaagttgtcatagggtaagtttatatatacctgagatctaaaatgcatctatagtgatattcgtctttattagttatctaaactaaaaggattattctttatagctaagctgtatacctatctttaagtaatgttatatacttatatcttcatttagtttttcttttaagctaaagtttcgaggaccaaaacctagctcttttcccccctcaaaacacatacgatctggtcgaaatccactttctccttgcaaccccattgtaatcgtagcaaaaccccattgtaatcgtagcaaaggtatatatgcctcacgatagtactagtgtgcttggtcgtactgcaccaccaacggtatagcttagcctctcagtgatcactaccaatcctaccgccggtactggatcaacaggtcagaagtttggcagcaaaccccagttggcgatgaccttattatgttcggcagcagagcatgacaaaaaacaccaaaaccccccaagtccccaattactcctacctaaacttcgccatggtggacgtgcgcccgcggcaaaaaccgatcgagtgattgcctgcctaattcgtggcccctgcggtgcggactcggtcgcttgctccaccgatggagcaaagcaaattgccaccccgatagcgatggcgagcacactactacctggttgtggcggcgaagcggtcgccgcgtgccccgtttgcgtttggtagagcgcgtgagcgagccgcttccagcacagacgaagccctcgtgttaacgttatcaaacagcgacgtgacgtgtcccggatatttgtgcttcgtggtactagtagtggtggctagtagtagcagtcacctgtaaatttctgcgttgggcggtcgtcaccagcgacagactctccgtaccaaaccacgaaatgtacagctgaactgtagatgatcagggggggtggaaagcgaggagaaaaccggtctcgagacgagagatgagatcggttcgctttttgccagcagaaaagcggcgagcctcgcaggcgaaaagcaggtgagagagattggcatattccggatgctcccgcagggagggaatcgcgcttctcttcctcgtgacctcgtcccccatactcccatggcgcggctgatgatataattagacgatttttgtagtgtgcaaatggaatcatggaatcggcttgactaaaaacgcagtagcgcaaaggaaggtagaaaaaggtgcaggcttttgcagtgcggtgtacggttctcagaaatgaagacgatcgcagaaactgcacgcgaatgggctgcatcggtcgacggcgagggagaccgtttcacgcgatccgaactcaagtcacgtgtgagtgtgtgattagtggcgtcgagatgagccaacgaaccattgaccatgtttttgtttcttttttctttcttcaaaatcggcgagagagagagagagagtttacagagaacaagcagggaacgagagttcactggaaacaaatagcaaaagaaaatatctctaccatgttactccccctgtcttaaaatataagcatttgtagctataaatctcaacaactgtgttcagattcatagctaaaagttgttatatttggagacggatgtagtaatacataatcattctcctttgcttttcaccctattccactaaaaaccgctaaaaaacggttagaaaaaaccaaccgagagaagaggtatatatgggagaagagaaatttttcaaccatgttcgcccgatccgtccagagataaataatggagaagagagataaaataaaccatcttcatcagatttcatcccgttacaacactactccctttgtcccataaaaatcaacttctagttacgaacctggacgtaacgtgaagttggtttttatagtacggaggaagtatttaccaaatcttgtcatgttgacttgtgtttataaaagggagtacttatttcgaacatatgaagtctacgataattcagtacaaaattattaatttcctaccgtcccatactaagttcaattttggctcatctgccttgtcccaaaataagtttatttttttgttatcattccatcggagttggtgagagtaaaaaaaaacttgcgttgagaatagataaagtggagaatagttatattggaatttaataaagtaaatgtattttagttctttttattttgtattggtagtatatgagatggattaaaaatgaacatattttgagagtgggaatatgaaatttcaggagaactactccattcctaacagggccggaagggttaagacccagcagtactaaaatggcaagttgcttgtgacagttatcagtcgcatctgatggcagtgtagctccggagctgcaaagatcgcctctgaaaacatgcaaccatagggaattggtaattcctgagatattttttggcaacttggatgaaataacaaagatcccagtgcagaatcgtgttagtccggaagcacatgccctggcagctggaatgtttcttccagcgcagccagagagagaatatcacctactcaccacttgtccagagagagagagagagagagagagagagagagagtatattgattaacaagcatattcgtcctggaaaatacgactagtatacagttaaacaactcagcaattaaccaagtagcttactacaaaaatgcaactcgttgacctgccaatccgaagtaaaatgtaacaaaggactgcaaattttctgccttaggcagaaagtttggcttaggtttggccaaaccagtacaaaccgaacccccacatttgtccttccaataccgccataagaatttcaaagacacagcaaataattttgaggtactgtgccatgttggcacgagggaaacatgattgaactatctgctacgagctcacgactaagagtccatgagcacatacaggacaagaaaatacaacagttgggtggcaagccgactgaagggtttgaccagcgcatcccctgggaacgagcgaaattgttctacaccactacctataaccaccggcacctaccaaacattcaaccctttgagctctacctctgttgaacatgattgcttagaagaacataagttacaacataaggactatagggcatggatggtggtaagtatatcactataaagctcttagtaaaacgtaaaacccactattttgttcttttccatcttctaaccaagtcacatgcagcttccttgccgataatacatggatatgctttattgctcttcaaattagcatcagtctagaaattattgatgacttcccaactcgctgtgaaattgacagcccacgctcaatccatccctggtaatcctgcattacagacaaatcaaatcagttccctcaacaaacaatgtcagcttatttatgaattatgactagcgaattttccacggagttagactctaaaagtcgaattggatttgatactcaaatcttagctcctgtttccatagatacgattattttgtatacatagatttaaaaataagaattgtatttataatgga

SEQ ID NO: 39925 - DNA, 797 bp, Oryza sativa
ttcccttagttagcctctgcctaggagttcaaataatctagctctactcagaccaaagtaagcaagcccatggggacaatctgctggtgcattttaccagcaacttgtcctaaacaaaccccatccaaataggtccaaagtgttgcatgtttcctactacctcggtcctagaatataaggagttttagggttggacatgggttttcataaagtaggtggaattaaatgtgggaaggttgtgattggtgagaggagaatataggtggagaagtttctatattctgggacaaattttgaaagctagaagttgttgtattttgggactgaaggagtgccttttacactcgaattaaaagggttggtattttctacagcaaacaatacggagtagatagcaaaaggcagatatgcatagtcattacttactagcatgtgatatgcagaaggtgcttgctatttaagcttcatttacatctgtaggatagcttccaaggactcttaaaaaggttgcaaactcctgtaaataaaacaagatgagtcacactgtttgcttgacacaaggtcatgcgaatgaagaaattgcaccttcaaatttccaagagcattctgagtttttggatcagccattgatgcctcaaggtccatatagaagaggtagtcaaactgcctggttcaaaccaggatcaaaagggttaagaagatataaacaacacaaagcagttctcagtttttttcttaggtctggaaaaaaaaaacttaaggaaaccaaaacgacaagtatagcaatcattgggttg

SEQ ID NO: 39926 - DNA, 2697 bp, Oryza sativa
  unsure (1)..(2697): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattgtctcttgtactgcaccagtggcaccgtcctccagtcctcatcctcctctcggccgggggcccatataaacccccaaggggagcgtggcttccattcgcccaagcctttcgagtcgtcttctccccttcttctcctcctcctcctcgattcggagctccacccgcagccatggctaagaactaccccgtcgtgagcgccgagtaccaggaggccgtcgagaaggccaggcagaagctgcgcgccctcatcgccgagaagagctgcgcccctctcatgctccgcctcgcgtaagccgtcgccctcgcactcgctcgcttctaggttttgtgtagaggcggatttccgtagactgatccggtttttgtggagacggatcgcgcaggtggcactcggcggggacgttcgacgtgtcgtcgaagaccgggggcccgttcgggacgatgaagaccccggcggagctgtcgcacgccgccaacgcggggctggacatcgcggtgcggatgctcgagcccatcaaggaggagatacccaccatctcctacgccgatttctaccaggttcgccgcgagccccggatagatctggatggacggccccgatctggtcaaacggacgtggttctgatgttttttccccgttgtttttgcgcagcttgccggagttgtggccgtcgaggtgtccggtggacctgccgtccccttccacccaggaagggaggtgagatttcctattacctttcaactcttggggtttttctcagggttctagttaggccttgatatggcagtggtaaactggatggcgtgtggatttgtttgtgatgccacgagattagtcgtaatttgttagtgctccattgatgtgtgtgcttttcatttgtggggactgggggttggtggttcctagagagtagacaaagtgatcaccactaatctaaggccagcagtataataatattttaacagtacggacttttctatattatatacccggataataccgtcaaattgggtttgttcgtattcttgttggtgggtcggcgttacttgacatcctctagatctagaggtggttaaatatccgtgacctcatttacatttccgtaagaccttgtttatttaccataaacatgctaattgttattttttagttattgttggctcatgtgtttgtgtcagttgagtcacataggattcattttcatgcatgctgtatggtgtgaagtttgttatccattcatgcacaaggatattatttttaaggatgtcgccttatcctttttctttgtagtctggctattctcaaagtagtcactgatttaccatggttgtttgcggcatttccctgttcagggttttgatagttactgatctttcattttatcatttttattttttactcaggatagtagttctcatcctaatcgatgtcatactctaaaccatgacaaataaacaattattttctgaattaatggaagaagccttggggacctggaagaagccttggggaccggggttgtttccgttctctatgcatgatatagtttgatctgttggattgtgccatgtaggatatttgttgtgctttgtgaatataaacttaagaaagcatccattatttacaagtctagttggttcagataaagtatattagggcctcccaacttattgcattgacataaaatgataattaggggttcaatctgaaggcagttggaaagcttaatgaaaaaacagtgggccgatatatatctatatgttatgttttaggaaactttagaaaggtgacttggtgcttgttttaggatataataactgttatggatatatctttttttataaatacataatgttcagtaattattatgcaccttcaacaatatcaccgatgatagtaatatatatcatatatgtaacattatacagtgcttaaaatttgcttgtgcatatctggctcatctttatatttatttctaaaatggagagatgattaagtgtttttttatgttccattttatattcattgtgttgttaattgagattgttttcatccttccttgaccttttgcaggacaaacctgcacccccacctgagggccgtcttcctgatgctaccaagggtatgttgccagtttacactactagtctcttccaggaactatagaaacattcaccactattgccataaaagaaacccttgcaaataagtcatcctttaaaatgtttttgtttctgcaatagttgaggtgttatttctgtgtagcacatctaaaatgcttagttatggtagaagtttttcccactgcacacttgacaaatgattcctgtgttgtagtaggcatgttgtatttttctgcatgcttcatttctgatatgatcctgctttgaccttgttctagtaaacctcatgtaaagcaccattgcttacactttgagcttgattgctt

SEQ ID NO: 39927 - DNA, 10124 bp, Oryza sativa
gtcttcggtgcgcagatgggcttgagtgatcaggacattgttgccctctctggcggtcacaccctggttagtttggctattaaccattgtatgcctctgcagtatgtaggagtacatgttctaatgtcggatttctgtgctttgttctgcagggaaggtgccacaaggaaagatctggttttgagggaccttggacaagaaaccctctgcagtttgacaactcttacttcacgtaagcgatgttacgagtggttgaattttgttcttatgctgaacaaagttggtaacaaaaatgttgaactcatctctccgcgacgattttaatagggagcttctgagtggtgacaaggagggccttcttcagcttcctagtgacaaagccctgctgagtgaccctgccttccgcccactcgtcgagaaatatgctgcagtatgtctcctatcaatcatcatcttgtgttccacgttttgcatcttgtgttcctcgttttgcagagatatgccagaacatgatactgattgtgttttttttccccaattctgctaggatgagaaggctttctttgaagactacaaggaggcccacctcaagctctccgaactggggtgagtaatggtttgtcaatccatttatcgtgttatctttcatgacaacaaggtcatggtagctaattgtactcttgtgatttcaggttcgctgatgcttaagaggtttctagtctactactgctagtacattgcccgtggtactcttgttttgcatctaggctagggccagtgtgaaccagcagactaccactgtgagtcgcctctgtaataaaatttgttcggcctatggccatcctcagtacgttgtcaatgtctcggtgggctgttatgctcaactgcaatgctgcatccactgaaacctctttctagatgtgttggtatgaaatgcggtattgcgttcccgatttcccctgctactgtcttgaacctgccgtggtacaatccttgtttgctgcacttcatttttagttcgttctaattccgcctggaatgacttttgagtgcttcacgggctgactgcctgaccgtgttgctgtacatgcctaccccatcagttcaaaaaaaaacaatcctacctacgaaattcgttttttattgggacaggacatcggctgagtttaatttcaaaatttttcaacaaactttcaacttttccatcacatcaaaactttccctatacacgtaaactttcaacttttctgtcatatcgtttcaatttcaaccaaactcttaattttgatgtgaactaaacccacccatcattggatggacttggcaaaacatggcttgaccattgagatcgttttggggattttgttcagtcagctcttccatggtgtctatcagaagagttggggccgtacaacgcaaattatttcccagatggtgttgatatcatcaatgatcatggcaatttggcaaaccatttcttatttcccagatggggttggtataataattaatcatggcaaccccatttgtttggtgctaacttgatgaaacatgaatgccctcaacctcaacagatgggctccagtccggccggcgccggccagcactcggtcaacacaatatgggcacgagtggggctcaaggaagtgtggggcgcagcacaaggagccaagagacaaggagtcatgttggtcctttcagtttcaggcaaaaaaggaaccgaaaggagccaaggatcggaccctttcgaagcttttttgaccatttcgtccgacttgcaaggcaggcccagaaacaaaaataacccaactgtctagtggtaatatcatttgggatctgttaggattttcagttcgaagaaactgtcctgattcagagttcagacaaaatacgccttcagtagttggtcctgccgcccctcgtagtttcactatcgaaagggatcgctgctgtcgtaatacgtttggttttggcaatacagaaatcaatctgctcgcaaagtataatatcataatccaaagttccaaacccttttattcgaacatagtaccatatatcatacaaagcagccacaacttgcagagaatgtgggtttcgaacatcaacaaacaaacaaatgcaatgttcagtctacccggctctcaatcttgatcatatgtacaaagcaggtatagacgggatctcatttccatggtgattcaatctagtaccggatgtttgggttcatctcgatcgcttcgttgaagatcagctgcttcatttggtcctcgtttagagccttctgctcgaagtcgaaggagaagggctccaggcagatgggctcatcggcgatgtcgtgcaatctctctaggtaaggatgatcgagcgcctcctcaactgcatgtcaagaacgatgtcagtgagatatagttcttaagcacaaatcttctgtcatccttctaaaccactctgctattgtctagtgtttcaaaactaaggtctactgaactctaaccgacagaggctgcaaacgtgctacctattctacttctgcactactacacagtaaagtaacacagtcttttatcgtcacttgagcaacatgcaaaatcgttggtagccccaaagacagctaaaagacgggttccctttaaagtgacgagatcaagagaccgactgttcacggcaagtaaacataaaaatagttggggatgggtcaaacaccggcggctatatacgccagtcaaagaagcagtgcgatagaaaatactagtgctatactagcacacatgcagtagcatactgaacagggtactgtacacagtacacactcagctagtaaattagtacttgtaattttgggtactaattttagtagtttagaagcagagcagcaagcacgagttgggttagccctctgcacgcacctgtgattctctgcagcgggttgaaggtgagcatcctctcgatgaggtcgagcgcggcgggctgcacccgcgggaacatgctcgcgaacgtccggcgcgggtactgcggcaggtgcctcatgtacttcctcgcgtcctcgttccgtatgaaccccagctcgtcgtccgtcggcgtcccgatcacctgatcatggacccaacacgatgagacccaagaacaggtagcataattcagcgtgtgagtgtctacgctgattaattcactcacctcggtgatgaggcgcatctggtgcatgtggtccctgccggggaagagcggctggcggttgatgagctccatgaagatgcagccgacggaccagacgtcgatggcggcggagtagtcggtggagttgagcagcagctccggcgcgcggtaccaccgggtgaccacgtactccgtcatcatgtcgctctccgacgacggccgcgccagcccgaagtcgcagatcttgaggtcgcagttggcgttcagcagcaggttgctcggcttcaggtcgcggtggatcacgttcgccgagtggatgtacttgagcccccgcaggatctggtacaggaaatactgcaacaacacggccgcaatcatacatacgtgacatgaggaagatcgaattgatgtttctgcagctatcgattgattgtgtgattgatcgatatatgaaaaaaaaaatcattcgctcacagttcactcacctggcagtgctcttctgacagttcttggttggagcggatgatgtgatggaggtcggtgtccatgagctccgtggcgatgtagacgtcgttgaacgcctgagggatcggcggcgggatcacatccctgatgcctatgatctgcgtgttgttgtagcagttagtgacagattaccaaattcaggtacacgccgctgcgtaattaaccacgtagtcttcagttccactactagttatagcctaataggagcttacgttctcgtggtcgaggtgcctgaggagcttgatctcccggagcgtgcgcttggcgtccatgtcgttgttgaacgcgttggcgatcttctttatcgccaccatctccctcgtctcaaagttcatcacggagctgtaggcaccagcacacggaattcagaagagaaattagaaaaacaaagcaccaaaaagtactccgaatagacatgccaaccagtcaaccactacgctgataataactaactaaaaacctgctcagctcagctgcagaatcaaattaatcatccctgctctaaaaacaggggattagtaattggtcccaattactccatcctctcaaccactcatcgacgcgtatcaatcaatcaaaaggaactgacgaaggatcgattaacatggcaagaaatctagggcaggcagggaaaagaggaatcggcgtgtgcgtaccagacgatcccgtaggcgccgcggccaatgggcatgatgggcggctggtacttgttcgtcacctcgaacttgttcccgaagatgtcgtagagcaggtaccggccgccgtgcgtcatcgtcggcctgaactccgccaccggcgccccgtccatccctaatccctcctcctcttctctcgccgcaagcagccgaattgacaaacctaattaacgaccttatctgactctctctcgattcgcagagacagcaaggcgatgagggagaggggacgagaggcgaaggcagctattaaaaagggaagggggcggcggtttgtgaattggcacaatttgtgatcgctgctgctgctagtggctctctccccgatcgagcacggagtcctcggtccggatgaggaaggaaggtggcaagaaagccagcgaagcccccgtagactctgcaccaccctgtacccgttttcgcgcgtgcgtttcgtcggcgggtacagcggacggcgaggatggggggagcccgtggcgatcggacggcgggggagggcgttttcaacggtcaaacggcacatgcggcagccacgccacgcaccaaccgtgaaactgattggcgacgcgggggggtcacgggctcacgcgtgtcaacgggggggaagagatgctagtggtgtactgggtgtggtgcgtggatttccggggtgggcgatggggacggaccgacggaggcggacgaagccggacgcggtgcggtccgtcgggttgggttgggggccggccgatcccccggtgttcagctggtgggttatgggtaaaaatgttcgtggaaatttccgatcaaccgaacatcttttctgtataagaggtgtcacatttgattgtatcgtttttagctatttataattttttgtttcttttatttttttacatcaatactaaatagtttaaatgataagtataattaattactagtcgatcgagaggatcaattttttaaaggagatgctaccattccgaccgttttcactccccggtgatacgccgtccgtttgccgcgcgactgctttggtgcggacgcgcgcgttggtgtcgtttgattgaccggtcgcgtatgcgcccgtgtgtccacagcgggttgagaacctggcgtgatgctgcgtgtcgcgtgagcgtgactcgtgccgtggaataacctttccgtcgggttgtgcagggtgtcgtgagcgattcgttgccctgctagtacttcaacgtgtagttttcgccgtttttattggagttgagaataccctgaaaaaggttggtaagtcgtgagtcgtgaccaaagtagtaacaacagcatcaagtataacgccttttaggttaaaaagggaacggcaaaagtggatggagaactgacgtgttaagtaaaaacagactgacgctttactgaaagttacccactgattgttattgactcgtggctcctatttaaccatagaaacgaaacggtcataacgtaagatttcaggtggaagcgaagcacaacatcctcctttcttccacagtgaaaacgatcgatttgatatccacagtgagcgcttggtccgtaagaccgtaaactctggacttccacgaggaaatgagtcgtccccgtccagtcctccacggaccacggcgacgcaacgcacgccacgcacccttttccactgaagctgctgcgtaagttcagaagaacaaattcagaagaaacactaggcagtgtggtaagcagatgatgtcatcaggatcaagtgccaataataaaaaccagagaaagcacagttttaattcacagtcgatacgaagcaccgaggatgatacttatcactggtaactctgtgaggagtttgcgagagaaagcgacagggcggctcgatgcagatttgtttttcaaggagttgatggtgcagtgcccccaatttggcacttcattatcccaagtaattaagaagaataagagggctcggtcgatgagcaatcgtgtactactaaccaattgatgtgtactagactactaatggcccagatgattggaacaaggagggcttagaaaccgaggtcacatgattgcgagccgagccttttgctatgctttgttacgaacaatcatacatgcctggcattcttatttggtagattatgatattcttattgagtagtaatagacttataagagatgtgacacccgtctgagttaagaatccgtgaaacgcgacaacatcgaggcccacggagaatgatttgcttgatcgatagtaaattatcaattcgcatcataatgctcagtatttttcaggggagtgtttaatgttcttaaggggataatgttttgtattagcagcgtgtaggatgaaccttttcttttctgaaacgccctaaaatatgctgctccgcagacgggattattccccaataggatactgggccaatgaagttgacgggatactccggctcccggcgatattgtgtagggatagattccaggcttgtttctcaccaatagaaaaccacactctcatttcgtgtaaaagaacagaaacacgagaaaaaaacgtgtctgttaacatggatgcacgcatgcgttgccacgagggaacatgatatgcaaacttcaaggcagcttctgagcgctacaccagcaacatttagcaacaaagatgaaagagaactgtctccaggaacatttagcaacaaagatgaaagagaactgtcgtcaacgttgttcagcgaccaaagcaacaaaagttgcaatctcagggtgataccagaccgcaaaaacaatgcaggctaatagaaagttcatcgatccattacacaccaatagcaatatagcatagccccaagggcaccaaatcctttcaggtgttaagactccttgatctcgtcttaaaccggaaatataactattacaaccatagcatgaccatccacaagatgaacgccagagactgggattaaatttcaagcttcaggggactcgcttgctctgggcgagcgtgagccgccacggctaccaccatcaccatttccatccctagggctcgggctgccgttgtcccttgggcttcggctattgttgtccattggactagggcttccattgttccttgggcttgggctgcgcccattggcagccacagggctacggtagccgtcagatgggctcctgctgttctccctgccccaggggctgtcaccattgcgctcatcattatccttgggtggtgggcttacccgatcctgtggactccttggactccgcctaccattcgggctggggttgcgctcctttccatttgctgctggggagatggatcgcctgggacttctgctgtagctaagactccttgatctcctatcatcacgatctctgcgtcccctgggagatccagatagggatctggacctagatcggctgatagtaacaaaaagattgtaaaacaatcaggccaagggaaaacaagtaccaggtcaacaatagcatatctgcgatttgaacagacagcatggagagtaataatttgagcaggtggcttttgaagcatacctgtaactcctgctccggctccggctatagctacgactacgaccatgaccacgtccacggcgtggcgatggggagcgcgaataacttctctctcgcctggaaaaccaagtacgtattggagaagtcttgagtaattcaaacatagtaccttagaacagagtgctacagtgtatctgaccaacggtatcaatcaatacctgagatttcttggactgttttggcagtttctttctatgtgacctctttctccacaacggtaacatttgttcttccagtcaccagccttgcagtctcttgcccagtgaccatcaatcccacagttaaaacagcgacctgttcctggaggaggtcctctccccatatattcacgtgaaccaccagcagcaccacgtggaacctgcatgcacaattttttgaaaagaacatcagagccaacaaaagtacagataatcaattcagcagcagcatgacatgaaggaagaaaataaattagtatcaggatgtgcttaggaatgcaaccaaagaactgcttactcctttagcaaactcaacaagaatgcggcttccatcaacatccctgccatctaggttataccgcgcttcatcagcatcacggggatcactgaattcctgtttggtaaaatagatgtcgcaaaatataggactcatatgtgaacaaaatacacctcataagaacttaaaaagagagaagttacgcaataaaaaaatgagggaagtattcacatacaataaacgcgtagtcgcgcttcaactccacttcacgtattctgcaccaatggttgccaaacagtaagccatcatgactcaagtactcaaatgcatcaccgacttgcaacttccactaaaacagtcaataacattacaccaagggcacccttcaccaaagtcctcgacaaactttggaagaatggtcaccaattccggagaaaaaagaatggccaccaattccaccaagggcaccccttccaccagaccaccacagacctcccgggttgtgtaaaaaaccgaaaaaccttcaacaagatcattcaagtcaaacacacaagacctggggggtcaaacttctacagcatacttaaagaaataacagaaaatgtcacactgaatggcttgaaggaactctgtccacaaagtagctgaaaagagacggtatggtaccactgaacccaagacctgccatgagctggccaatgggaaagggtaggaaggatatggtgctttactggcctatgctgagcacaaccgaagatttgcacccacattttggaaaggtcacaattttaataggaaacagcttgatttgtttggtgaaatttgaacgtaccaacaagttgtaatgtcaactgttaagcaagcgttagcgcagcactagtgttttacacttacaccaaatgaaagtgacttatcataattttaccagaaaaatccattatacttcagaaaataagctctcttaatgcccattgttctgttcttaccttccatatctgccgaaaagatattctaggtcacgagaacgagtgcgcgaagacagtctaccaacatacaagcgtgtgcttccataatgatcatcatagcgaggcatctcctgaaaacaaaagcaaagaaacatcagtacttttcaaaatctaatgaatatgaatgactgaaaagagcatgaatacttgcgcagaaatgcattgtacagttagggaatatttttttcatgcaggaaaaacttacaaaacaaaagttcttggtaagtacaacgcacacatacagtatagacccaaatttaggggtaatcagattagaggatgaggtaagacatgattggataggccttgtcactcatagcagcatagacaatatcaacaagcatatatgcaaccactaaagttcacaaagaaccagttcagccaagtctagccagtaatcttagaactgactcgtcgtatctacatacaattctatataacttcaaagaatcaaaataatgcaattatagaatcctataggttgcatgagcatcaacatatagcagatattaaaaaccggagcccaagcaccatgtgactatacaatcacgcaggggcggatctaaagtgcgacatgggggagttcagttgaaaccccaaatcctcttcaggaacaaacaaactgttattagtactagtgataacaaggttaaggcaaagagaaacgcctccagatctagcagagaagctagggtta

SEQ ID NO: 39928 - DNA, 6396 bp, Oryza sativa
ttttttgttagaataagttcaccgtaggtccctcaacttaacagcgagatttttttaaggtccctaaaccataaaaccagaaatgttcacccctaaactcactcaaaccattcacctgaggtccctcggcagtatttttgtccggttttactgatgtggcatcctagtcaacaaaaaataaaaaaataaatatgtggagcccacatgtaagtgacacaaaaaatgtggggccaacaatcctagtcagcaatctcttctcaatcaccttttcctttgccgcagatggggagcggcagcggcgcacggctggaggcaggcgcagcggcaggcgagcgcggctacggagcatcggtgttggcgggcgagcggcggagagcggagcaggcaggcggcgacgtgcgaacgtggagggagacaaggtcaccgccgccgctcggagggaggggcgctgcggacgtcgtcgctatgggtgtgggaccacgccgtggagctgcccgagatgatggcacgggcggagaggcggcggaggaagccgcatcaacatcagcaacaatagcagcaggggagcgcgcggagggacgccattgccaccgacaaactcgcgagtgaagctcggccggctcggccccctctctctcctctcccgctgctgctccgcccgctgccgccgcctgcctgctccgccctccgccgctcgcccgccgacgccgccactccgcctgcctctagccgcgcgctgctgccgctccccactgcgtcgccgcgcaccccgcctgctgcagccgcgcgctgtcacccgctgccgctcgccctctgcggccgtgcgcgtccaccgctttccactgcctgcagccgccgacgtcgcccctccacttgctccggccgcacgccgccgctcgccctttgtggccgccgactgccgccaccaacgccgcccctctgcctgctctggccgcgcgccgccgcctgctgccgctcactctctgtggccgagctcacccgtagtcggaatggctccggccgcctgctgccgctcgctctctttggccgagctcacccgcagtcggaatggctccggtcgcacgcccgctgccgcccgccgactgcagccgtcgagccattcctcctcctcccccgtgccattcctcctcctcctccgcttccttcctctctgctcgcccgctcgcctgccggccgcgctcgcctgccgcctttcgcctgctgtgtcgcgcgacctgccgcccgcccatcgccgctctgccggcctcactcacattgaagacgggagagaagagagaaaagagaagagaaggagaagaaaagaaaagaaaagaaaagaaaaaaagatgtgcaactgacatgtgggccccaagtatttttattaaaaaaatttgctgactaggatgccacgtcagcgaaaccacccacgtatactgccaagggacctcgggtgagcggtttgagtgagtttaggggtgaacatttctggttttgtggttgagggaccttaaaaaatctcgctgttaagttgagggacttccggtgaacttattccctttttgtttggacaattgtttaggtcatggatatagatggccataaggcccgcccggcacggcacggcccagacacggcccaccagccatcgggccggcacggcccctcccttatttttggctgttacatatgtatagcttaaacaagtctatttttcgtccctcttctttgggctgacatatatatagctaaattaagtctattttatgtccctattctttcgactatggcatatgatgtctattttactccctattctttgtgtgttggacctggttgccgggccggcccaacgtgctagtggggagtgggggccaggcacggcctagcggtcgggcggggcaggcatggccccgacccccgtcggccggaccggcatgggcccgacccctgtcaggctgtgccgtgcttgggtcgggccaaaacgtcgtgccgtgggccaggccgtcgggtctcggcccttatggccatctatagtcatggaccacgtagacgcaggagactaggttcgtgcttggggactcgtgaaaagcaatgacagtatgctgggactgcttgggtattactacggtttttctttggaataagttcaatttaggtcccttaatttgtcgcttagtctgaaatttgtccccaaaccacaatactccctccgttttaggttacaagactttctagcattattctcacacacacacacacacacacacacacacacatatatatatatatatatatatatatatatatatatatatatatatatatatatatatatattaatgaatctaaacacacatatatatctaaatttattaacatatatatcaatgtgggcaatgctagaaagtcttataatatgaaacggaggaagtaccgaatataatacatcccctaacttacagtaccgtattaattttggtcatttggcagtatagtggccggttttggttgacgtggcgagtgggacccatgtggaccctacatgccagctgccaactcttcttcctcccaacatattctctctccctccctcacttttctccacacacatcacctgctcgagagaatgtctgtgaagaaaaatctccctaaccgctgaaaaatatcttcttcatgtcttacccgtgttcggccgtcacccgcatccttgccagtcgttgcaccgcccgctccatcgccatcatgcacctttccacacagcatcgtgccgcatgaactccgtgtctatcgtcaacttcctctcgttcgcttctccccactgccgcacgagggacgatgatgacgacacccacagcgacgaccgtagcgattgttaacaaccaaatttggtaatatcggcatcgggaaagaagattagatcgaagcaaagtcggaggcggagatcgagttcggaaacagggcaggaatcggctggagtccagatcggctacgattaggatcggctgggtctgagtcgggctaggtaagccgatgcagccgattccgacaatgcaacttggtgtatgacgtcgggttgagttgaggtgtttcaaggtgattgccgcacatggatagagtcctgagaaggcaattgtatctattaattaggatgttttagataatttccttagagatatgcttgggcaaaagtctgccgcaaagacttatggtatcttagagtttgttagagatagtagtcgtgtccgttatggacatatcttgtaattttcgggtataaataggcccgagccctatgtaacttttaaacacacatgttcaatacaatctcggcgcatcgccacccttttttgctttagttttatttcgacgagttcttgctttcgggttgagctgaatcagtttcgatcttcaacaagaggtaaaacttgttatggcggcttgcgttctcgggattagtgcttccatctttatgacactctaatcttgttgatgtaatttgttgagttatcatatatcctacataatccttggcaatatcgatatccagcctacaatcgggtaacatccgtcaatagaaggcagccgattaggttaaataccgatgttgacttagattatataggatatctaccactctatgacacatccaacggcttgattgtctagatattgtccttcttttcatacttatagctgcatcagttaagtttgatcttatgagtcgtgattagaatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattatgcttttgtttagtatattatacttactttaatatcttaacatagagtggtatcagagtattagccgatacatgctagatctatctgatcggctatgttatgaacgtatatagtctcattattaatatatatttcgatctaagtgatttatactgtctccgcatggtgaccgatctatcccaatcacttgatttaagtatatattgatataaagattatatattggtaatatctacagccgatcaagtagattcagtccttccttatttattaatgactgctgatcgatgcatatatgacgtcggctcaaaaataaatgatatgtcatcggcacctagccgatcggctatcatttatagatttaactgcggtttctttgcttctatttcttgttgattacaggatcaaatcaactggcacgctcatacatttgaaggcgagctttggacctgcactggagttaagcagatctcccaggcctcgtgttttctgtcaacagcgatgtgtcgcgtcggccagccgcgccacgcccgcgccttcaccccgctgttgtggtgtcgttccctcaccaccgccgcactatgcttcggccgccgtcgtcaatccttcgccatcagtccccagtccactagcagcggaagcctggatgtcgagggcatggcgctggctgactacttcttcggccccgagttggacgacttgatgcagtggctgggcgacggcgacgtcggccggaagggcacgctgccaactaagaaggaggccagggagacgatgccgacggtggaggtgaccgccggccactccgcatccgccttcgcaactgcctcaaccgtctgtcgtgaggactacgccgttggcgagcacgccacggggacgccctacaggcacaggttccacgcaagtgcattgtgccatggctgaagatgcacagctcgtgccacgtcttccgcttccaactcccaaccgacgacgacgaccctaaggccgcacgcggcaacaacgacgcccacaccggtgagaagtcgtcacggttctccagttcgccgccatacaccatcggccgtcgcttccaaccagggtcaatcccctccggtcaaaatccgacgtggcgccacccaattagacgttgtttcaatgatacgtaaggcccacaagggttattattattatttttcctttgcgccatgtcaccaccacttcagccaaaaccaccattcaaaaccgccctgggaccttatttggattggttttagaagttaagggacgcgtcatatctagtattatggttcagggacgaatttcagactcggtgacaaattgagagacctcaagtaaacttattcctttttctttttcggccgtaaatgaaaccgctttgtaactttggttaccaaagataccggtgaaagagaaatgccgtaaccgagctgtttcctgtttgctataagaaacatttgagaggagaaaaagaacatgttgctgccgaaaatgaaaggtttctttctcgtcaaagagtgaccataaacatttcatagtacatatatatgtcagatttttcttttaggaaaagggagatatattactcatggggaacatccacatctaaaagatgtgaaatgaaattacaattgttatctggccagaaagcggttaaagactcgcttatacctttattagctaaaaaatgactaacaatgttctgatcacaacgaacttttgtgagtttaatatcccttcgtccagtcacgaggctctgcacctcctcgactagaaatcccatctccgagagcactctctgcttggatcgtattagattcatcgcctcatggcaatcggtttcaaccaacaccggtagcagcgtccactgtaacgccatacaaatcccttccctgcaagccaatatctctgcttccagcggttctccacatctatctagcttcccacaagctacaaagataaccttcccagcaccgtccataagaacagcaccaataccacctttgccatctctttcctcaaaagatccatccacgtttagcttcatccaacccgcaggtggcttctcccatcgttgtttcttcgcagcctgttgggactgaggtttccttcttctattatgtctagctaactatacatttagctacgcaaaatctatttcgagaggcatctcgatttagacttaactagcgacgcggacaattacgtgagaagtactagtagcgttacagacatgcatacaagtagtttttctattaggttgtgtatttttttttcttacgaaattttctcttaaattacttatccgatctataatccgattacaccgttgtgttcgtaacaattaaatctttacaacaagatctcacatgattatattttgatgaaaaattacaaattactcttataatatgtctaaattacttttagattccactaagttacttcttagacataccaaagtaaattcagtaaagcctaaaagtaatttacatataatatattataga

SEQ ID NO: 39929 - DNA, 1706 bp, Oryza sativa
cggcctccatctcttccgcgtcgccgcggcggccggacgtggtgaacggcgtggggcccgccggcgtagacggcctcgcgggtccgcccgtgcccgtaccggactcccccgcccccgcctcccgtgatctccactggctgcctcgtaagtgacgacgcggcggcggcggcgccggcggcgtcttccgtttgtcgaagtcgatttcgggggggttgggtttgagggttctgctatcatctcgttctgatttgtgttgtgttgtgtggtcaggccctctcaccagcgccgacctgatgggcgtcagcggggaggggctcaaggttgcctaccaggtgctcgacgaaacgcgcgtgttttatgcagtcccgtttcgtatcagtctccgtgcggccgtggctggttgtgcgtgggtgactgtgtttctgtctgttcatctaaacgttgttctgttctgatgatgaatatctcagggttgccctggagcgtacagcgaggcggcagcgaagaaggcgtacccaaattgccagactgtgccctgtgagcacttcgatactgcattcaaggtattgcagtggaaaacattgcaccttgtgtgctgtttatgtatgctgtagatgcagcattgaagatgatacacgtacaaaaaaatgtctacaaacatattagaaaacggatgtgcacattgtgattatatcttgatttttcataactaaccactaattatatccatcggttgaaatctttgttagttagagtttagtaaagattctttagtatgtataacactactatgcttatttatcacattgttatgcaaaggaacaatcctttgtttgtccttaaaagttttttagacagtgttcagtgctacttggcatgtcaagttctggaaataggcatgtaagggtccttacataatgaccagatattaataagttgttgtgtaacaaaatattattttctaaaaatagtatttggtggacacttggacaggcatgtatcaaagactgagtaatgttatgaacattatgtgttcttgtttcccttttaccttatgtacattgaagtttgtgaattatgtactccataaatgttacttgtgtggagtatttgatttaattagctgattttcccagccaagtttgacattttattttagttctgttttgcaaacaaaccaaagaagtccatatttgaggtgcttgatttcatattctattagcacaaattgatcttgagatctctgtccctatgttagacagaggatttgagagatcacctattcgttctaagcttttaaacttttggatccaccaaatgaagggcttgttttaactttttatgagaatttctatcatatttattatacttttatctatcaactgtaaatcacctgcagtcaaattttattgtacacaagcaaatagacataatgtgcgttgatgccccttattgcttttacaggctgttgaaaactggttagctgacagggcagtattgccacttgagaattcattgggtggtagcatacataggaactttgaccttttacttcgtcatagattgcacattgttggagaggtccgtcttgctgttcgtcattgcctgttagccaatcccggtgtcaagattgaaaacttgaaaagtgcaatgagccatccccaggtcaaactcttgcacaagatggcctaaatattctttatttt

SEQ ID NO: 39930 - DNA, 984 bp, Oryza sativa
ggagcggcatcggtgacgacaggagcagcggaagcggcgataggaggcaggagccgatgcggcagtggtggagggaggcaccgcgcggaaggggaaggaggcggcgatgaaggcggagaaaattgcgtggtggaggttgggaggaaatcacgtgattttgtttctgtatccgagtcgtggtatcccagtgtgggcaaggcgatggtgggaggtgggaccgtgggagtgccgtgggacgctgtgggtggggtatagttgatttgtcaagggttggaatggtgaactcctcctttttttttattagtatagattaaacgagtaatcgaattgtatttgcgtcctggtaataccatctgattgaagtggcaagtgattaattttttttccatcatattttacttgtctgtaaactacggttacaagctaactgttcgatgtcttggtgcatttctgttcaaaatgggaatgtactactacttaaatcactcttgtgtgccttccgctaaaaaaaagatatctttgagctttgaactttgttagaatccatttttcactccgaactacaattgttttgtttgaaatagagataattatcgcaattcataatcttattgtgcatattaaaaacaccatggcatatggtttaggatgttatatatctaattttggtatgaaaccccttctatctctctccccgcgtcgctctcgcgcgggcggctcggggggcgaaaaaaccctagccgcccgcgcctcttctccatccccgctcctcagccgccgctggagctcgccggcggcgaagccggcagcgagcagggaaggcggcggcgaggcctttttctttgtggtgtttacttcctcggtgtgaagtggacgggacgaagacgacgaagtcccccaccggcacggtccgaggcggcggcgaggtggggagaggcggcggatccggcgcccccaaggccggatccggccatcccccacctg

SEQ ID NO: 39931 - DNA, 1145 bp, Oryza sativa
aataagagtttgtatagcttggctgggtgttattattgtatttcagaactataatttatgccattatctgcccacattttcagcggtgatttgtgtgggaagggtaaattaatattctatagttgctataaattagttcttggcaccttttgttatctaaaagacggttttatcgggtgcaggtaaaaagagaaaacagaaacagcctgggatgttgctgggatcctcaagcaaaaggaagtccgaaactccctatttgacaaatgtggtgctgccactgccaacgaggcacggtgtgcaaaaacaaccggatgcggaaggaggtagcatggaagctgaattttcagataatatgttattataataagctgggatatgagtaatagtggtaattatcatattttattgatatagtgtgatcccgtatcaagactatgatccctcggttattctctcctatgtcgtgcttgtatgtgtaagggacgacctgaatgaactcagttcagacatttttctgtcctatctatgtggtacacttgttttatcactctgctgagtatgttctatctctgagccagttcccactaaactgcctcccttatcccttcttttcaaagccgtagaccacggcaacccctcgacaacggcaattagttaacctataataaatacttttttgtaactaggagagcaaagctgagaattatacccttcgtcctaaaagaactcaacctaggaagcacccttcatccttaaaagaaactcaacccaaccaagaaagggatgtaacctctcacaaagctgtgttcgctacatcgctaggggaggataggaacaaatctcctacgcacggaaaacggagcagtccattaacgcgcgattaattaagtatttgctaatttttttaaaaaagtggattaatatgatttttaagcaactttcttatagaaatattttgtaaaaaaatacattgtttagcagtttggaaagcgtgcgcgcggaaaacgagagaggtgttaggaaaaggggcatccgaacgtagcctaggactatgaatctagactgtcttttgtctagattctttgtccagatttttttttttggcagagggagtaagtcttgctacttatcagcaaattgccttg

SEQ ID NO: 39932 - DNA, 5234 bp, Oryza sativa
ataaatcccagtatttttcacttacctttcacccttttaacttttgtaggtatgtgactttggcctttcacgactaaaagccaacacctttttgtcctccaagtctttggcaggaactgtaagtaccatttccattcttcagaagttcacccttcaatccctttttcattgaaaatattattcatctttggcttatcttgttctttttccatttaaatattagcccgaatggatggcacctgaagtgctccgagatgaaccatccaatgagaaatctgatgtctacagttttggtgtaatcctatgggaacttatgacaatgcaacaaccatggtgtaatctgaatcctgcccaggtaattattcccttctatctaattttttgtgtccatgctgatgaagtgatgcaattagtccttggtatcattcaatgcatgcataacatatttttcttatctagaagcaagtatactcctgaagttatgcagatcattttttttaaaaaaaaacttttaccattttacatgatgctatgtttttctgcaggtagtcgctgctgtaggctttaaaggcaggagacttgatatcccaaaagatttaaatcctcaagtggctgcattaattgagtcgtgctgggcaaagtatgcattgacccatctatttttgtatatgaatcaattcgcaatgacatgcgagactaacggcaattttgtctgttacagtgagccatggcggagaccttcatttgctaatattatggatagtttgagatctttaattaaggttccactgccgcagttgattcgttcagactcatagccatttgtatattgaagagtcatatcatgatttgccttgataagatcaacatggagaagtttttcaatatctgacttgcttatacttggataattctgaccacattatttggtgctaagaaaatggagtcttgatttacatttttcaagcaaaacaaaacgtacctggcaactcctgtccatggtttcaaggtatgttgctacttgcagagtttaccttcaatgtaaatatataaccaagaccttggattggtaccacatcagcgaattgagcttaaataaggttttggtttcaattgaatgcagacttgctgattagtgataaattgtatcgttcgcaaccattgaactggacagtctttgttatctcgtcatatccttcagtctcaattttatcgtattccccaatctgtatagacacattgaaaacaaacggatgagttaatatgtatcaaacggtgtctgctgtctaattagctgatccatccaatattccaattataatgtgttctaactcttcagtgcacatataaaatttgttttgtccaagctgagtgctgttgctgttaatatatctgagtgagactacagtaccgttgactttgggtgtcattatttgaatttacacggcgttgctgttttctgattctaaactgatagcattagttatgttaagcatggcagttactagcttgttatggtctggagccggggacaggttacggggtagtaactggccagaatgatatggatttaaataaaaaatatattaatttttacatatgtaaatttagaattattctgtccggttaccggttgctggccaaactaagttctgttcagaatggcttgtttgtggtgactgtcagctcataatagaacataaggatttctatgtatagttcaatggagtgtgtgcttgcctactgggtcacctttatttaagagttcgtaattttgaccttgttgctaattgcagatctgttgatattccttgtatgaacatctggttggccaagttatccatgagatgcagcacttcacttgtctgcatcctttactgatagagatctccgactggctgcaacctttgataagaacgtcatccttccctgtgttggtagctgaatcacatattggaaatgcatgctgggaggttcatcaaacttgaggatcctgactgtaaattctagtctctcctagatgtctatgtataatgttgactgcagttagctatgatgaaagtaaagaggtttttttttggcttatgtacatgtaagtctgttacactatcctagagcaggtagtactgtacatatgctgtactagtgctcctacatgtgtattgcttgttgtaatgcactgtgttgtttcatttttactaacatgtttagtttaatgctccgtttgtactacctgtggctgtgaggcggtgcaatatttggcggataatcacaggcggaacttgtgggttcgtcggaggccaaatatttggactgtctcgttgggcggataattgtgttccttgtcggccgccactgtccctcctcaatccggcgactccgctttccaaatcccccgcctctccaaatccgatcccgaatgattccccaaggtgaaggtgagtgctactcctagataataaccccggagtcgtcggcgattgatctaataacaattactactaagattgattgatcatgggaggagatgagagtgagagcgaggagtgggaggcgttggagctcttgggtcctcctcgactacgtcgccttcatctccaactccaaccaccacggcaacgccaccaccgccaggtccaagactaggaccggccagcccatcgaggtatccttctggacggcgcctccgccgcgcgtctcctacatgtgcgtccactgtcctagattggatccctacaagttcgccacagagcccaccatcatggccacggaggccgacctcgtcctcatccgcgtcaccattggccctcgcggcaactgctttaataccaaatgcagcgacttgttcatgtactaggccaccacccacacctcgtcgttgcgcttgatcccgcaccctgctgctgtctgcagcttcttcgaccgcgaggttggcctcctccgctgtggctcggtcaggcgtcgccatgatcccacaagattgggcctgcacgcccataccggccctgacgacggtacctacatcgtcgccgtgctctgtaacacctttcaatcagggaacctggagtatgccctctacctttaccgcgccggcgcagatgcttggacctgccatccactctcccttcatggtttggtcgatccaacatcatttatccatgtcaataccaacaccatcacggttggaggggaagctggcaccatggcctgggtcgacctcaaccgtggtattctcttctgcgaccttcttccctgcccatacacccctctgctcctccgctacttcccgctaccgccaccactcagactcagtgcacacaccaagctgacaggatgtccaaggtttagccacgacattgctcttgtccaaggtcgattcaacttcacccagatgcgaattcatgtcaagccaggctccatcaccaacggcacatacatctctcagggttggactcttgccacttggagtgcaccagccaccaatccttggaagcaagggtggcgccaggattgcaacctctctgcttccgatctctctgttgatgccaacaccatgaattttcagttactgcctaagctctcggatcaccaacagggcacacctcagcaaaccttggagagacttcacgtgggccatccaacgctcagcttgcaatccaatgacattgtttgcctcatggccaaggtcgaccaatgggacgaccatgcttgggtgcttgctgtcgacatgaagaacaggaggctaaaagatgtggctcagtttggcgctgaaagaactcttggcattagcttggtctacatcagcagtatgatatcagaatatcttcgtacggctccaggtaattgtttttcgtttttgttctacttgttccttcctatttccgtggtccgtccactgctaaccatcataatcttgcctgttttcacaaatagcaaacctgcaataagttataattgacaataataccaaacctattaaattgatgcacatgcatatatatatgtgggttaatcaattggaaacatctgtttttgtctttgctcacaagaacaagggacattgctgtagggcatgatgcccctgtttctatggcattgggtgtacatgatactccagttcaggatgctaatatttctctggtgttaacaatttacttgacacacctgacttgggaacaccttttctcagctgataaaacatattacatacatacaacctgagatacatgcaaataaatcattgaagggaatgggatttatgagcaatgcccagtaaaatggcagtacatatacgactgtaaaatggatgccttcttcaataatcacaaaatgttacatgacaaatagatggtggaaacggaaactgcatcatgaccatgtgctttcacagaaagggcatgtcacctaggttgattgttttgctttggaattttagagggaaagggtagatatgagagctactatttagttgtaattgagccggttttcactaaatattttgctggctgcaggtataaagggtaacctaaaacgacaaggggttgtgttcaccgtaccctctcacaagaagcagacccgtatggttcatctgtctactccctcttggaaaggtggagatcaacagaattctggaacaagtatggatgatggagaggataacatggacttggacttggacatgttttttggatgaggggcatggttaagttaagtgtggtgcatcttcagttaacttatgactagattatctactgttttatcaggtctatttatgaggggtactgctggtattttgtagagcagatgaatagtcttgtttatgcccctgttcgtttcttatcaatgtagcgaggttgtaaaccgtatagtccttggtggtgtcaaattgctcacaatttatgcatgtgtgccccctagtagcgttgggcgtcttaagtccgattatttttctgctgcaatttggttttctgtcaatgtgaaatgaagaatctaaaatcggcagactgcaatcatcatttgttatgtgttgggcaatcaatgattctgtttagattcatagaactccctccgtttctaaatatttgacaccgttgactttttagcacatgtttgaccgttcgtcttatttaattttttttgtgaaatatgtaaaactacatgtatacgtataagtatatttaacaataaatcaaatgataggaaaagaattactccctccgtattttaatgtatga

SEQ ID NO: 39933 - DNA, 18888 bp, Oryza sativa
gcgtcatacattaaaatatggaggtagtaataattatttaaatttttttaataagacgaacggtcaaatatatttaaaaaaatcaacggtattaaatatttagaaatggtgggagtattagatggggtctaatcgagtattagggtgagtatgttttatcagaactttttaactgaacaaacaggaaaatgtaaactgatgaggccacacctagcacagcaccatgactagactatgatcatcaattacaagctctaacacggaggaattacacctcatccaatcaagtgttcactgtgccttggtttgtccattttttaggacaattttttggtttgcgtttcttagaactggagtgtttttttttatttacaaaaccgaaccaataaactggaaaatctacttgttagttgttagatacacccttatatttgagtactgctacacatactaaaatttttttacaaaactcttactaacaaatttctcaaccgtttaatttaactagatggaagttgcaataaatctagatttactcacagcttgccacatcagagtttgtaaacattttgtaagaaaattttagtacgtatagacttttcccttatatttaatccctttgcatattttttattaaaatcctaaataaagattgtagtactaggctctcttttagcatagctctatagatccaagatctaatagagcgggggtatttttaactttacaaatcgacaaatctagatatatgattacatatataacatttgaagaaatcaatttattcatattttaggtgaaatttaactgtaatttaacatacaaatatcaatcttcttccagtttttttttaaaaaaaatcaatatgtttgcgctcatcttcttcctcactcgatcagttccccaaatcccccaccctatccaaactcttcctcccccgatccaattcgactccactccatctccctcctccggatccctaatgcacaaggtgtagaattaaattccggggaaatcgacggagtcggaggtaggcgtagcagcatggctggaggagatgactggtcgaagaggacgatcatggaggaatccctgcagccgccggcccacggcgctgcggcgactacaccttgggtcctcctcgacatccgtgctttcatggccaaccaccgcaacgccaccaccgccatgtccgagaccaggagcggccaccccatcgaggtatcctcgtggacggcgcctccgccgcgcgtctcctacatatgcgtccactgccctggattggactccaagaagttcgccaccgagcccaccatcatcgccgcggaggccgacctcctcctcatccgcgtcgccatggggcgccggaacatccgcttcaagagcagcttccatgactacttcgtctaccaggccaccaccccaaccccgaaactcaccttgctcccgccccctcccatcgacaggttcatcgaccacgagcttggcctcctgcgctgttgcgcctctcctgattacattgttgctgcactctgtaacaccttcgaatcaggatactttgagtatgacctccacatctactgctccggcgctgatgcttggacctgccatccaatctccctccatggcctggtcgacacatcatttacccatatcaataccaaggcaatcaccattggagggaaggcgggcaccatgggctgggtcgacctctaccgtggtattctcttctgtgaccttctccgcgacaccactaagctccgctacttccccctgccgccgccgctcagtcccaacaactcgttaacaggctctccaaggcctcatcgtgacattgcccttgtccaaggtcggatcaagttcatcgagacgcggcttcatgtcaagccaggttccatcatcaacggcaccttcatctctcaaggttggactgctgccacctggactgcaccggacaccaatccctggaaccaaggttggcgccaggactgcaaactcactgcttccgatatctctgttgatgacagcaagatgaattttgagttgctgcctaagcttttcgatgaccaaggcacacctcagccaaccttggagagacttcatgtgggtcatccaacgctcagcttgcactctgatgacattgtttgcttcatggccaaggccgaccaatgggacgacgatgcttgggtgcttgctgttgatatgaagaacaagaggctaaaagttgtggctgagtttggtgcagaaagaacccttggcattggctatgcctacatgagcagtaacatatcagggtatcttcgtacagctccaggtaactatttgttctgctgattcatccctaaccctgtgatccgttccaatgctaaccatcataaccttgcctgctttcacaaatagcaaacctgcatgttgtaatcgataagaatattaaacctattagatcgacgcatatgtatatatgtatgtgccctaatcaattggaaaacacatgtttttatctttcctaacaagaacaagggacatcgctgttgggagccctgtttctatggcattgggtgtacaagatactccagttcaggatgctaatatttgtctggtgttaacaagatacttgacacaatatttgtgggcacactttggtgagctgataaaacatagtacatagatagatataggcaaataaatcattgaagggaatgagatttatgagcaatgcccagttaaaactgtaaaatggaagccttcttctataattacaatacattacctaacaaacagatggtggaaacaaaaactgcatcatggcttgtgctttcatggaaatagcacatcacctaggttgattgtttcgctatggaattctattagagggaaatgatagaaatgagagctactatttagttgtcattgagccaggattttttattttgctggctgcaggtatagagggtagcctaaagcgacaaggggtttgttgaccgcaccctcacacaagaagcagacccatatgatgcatatgtctcctccctcttggaaaggtggagatcaacagaattctgtgggaggtgaagttgattacatggattttggatgaggaggggcatggctaaggggagagcattttcatgtagtattgctgttgtgttagacttcttattgcttgattatctactgttttgtcagttctatttacgagggggtattgctggtactttgtaccgaggatgactatctaagcacaaaatcttaagagtgtagtttatgcctctgtttatttcttatcaatgtagcgaggttgtaaaccgtatggtcctctcgctggtgtcaaattgctcacaatgtgagcctcctggtagcattgggcgtcttaagtccgattaatctggaagctgattacatggattttggatgaggaggggcatggttaatggttagagcatgcatgatgcaaatgtctggaactctgggagcagtacaacccgatgaaaaagaatattaaacttgtctagctcttcaagtattgaggatttagtacttgttaatttcaggtacaagtagcagagtgtctctctctattgcactcattgatgaaaccttagttgacgcttacaggattgtttctgctgtaattctactagcactaatagtatatgcatgctttagtaaaatgaatgtcgattagaaaagaagatgtgccaaactgtgctacagtgatagcagtatatatttatcgaccggtccatggggagagagatatatacacatctctgcgttcatgtgcttgttcttttttgccgggcaccaaaccaatgcaagggagtgtagttgaaagcaagcaatttaattgcaatcagatgtcaaatatggagtactttctgcttatgcctcatccgccacccacggcgttctttcccgatggatgacgacgaggtgagaggttaaagaagaagaaaatgaagaggcaagagcagaggcaggcgtgagctcacctgatcgaagaaggagctgggctcgcccggagacgaagagggctgagagaagggtggcgggcggcaccactgcaatggaatggaggacggccagcgagcgcggcggcggcggcggagacagcatcacagcttgcctcgatctggtgcgtggaagtggctctaaccaacgggatagtgggctcccggctagtagcatatgtgggccttctttttagcaggccggccttttaacgggcaactgggctggctatccatcatcttcatcttctcttcttccccggccaattgaattccactccaccgtcgagagcacagcacggccaccgaggtcacactccgtttccctaaattcctcaatccgatccgatttcttcttctcacccaaaaccagaacggaaggtgtgtgtgtgtatatatatatatctactacttaataaaaaataaaaaataagaggtgcttccatcgtccgtcaaaaaaaccacgagaaaaaaaccgagcgaaaaaaaccggacgaaaaaagagtccgatcccaaaaaaaccgggagaaagaaaaaaacgtccgatccaacaaaaataaacggagcgaaaaaaaactggtgaaaaaaaaacgagggaaaaaaaccgggcggaaaaaagagtccgatccaaaaataataaaaaaaaagtccgactcgaccgattcctgtccgtcaaaaaaaaatagcgaaaaaaataaaaaaaaagtccgattgctataagaaaggaaaaaagaaagttcgactctagatctaaatcacccttaaaaacgaaaaataaaattgatgtgccggattaaagatctgtttgcaaaaacgaaacctaccggtcgagagcattccatttttatatgattttaatttttggatctatacttttgcatttgagtccctgtaatttttatatttacatttgagtccatataagtttgaaataaggtattaaggtcgtttttgattaaaaaataataaaaggggaagaataaagacagaaaggtgcataaaaagaaaaagaaaaaccgcacaataaaagaaaataaagaaaaagaaagaaaaacaacaacaacaacaaaagtccgtttctcctaagtggcaaaaaaaaaccgtagatccgattcctataaaaggcaaaaaaaaagtggtgaaaaaaatgctagatctaattcctttaaaaaggaaaaaaaaaggtctaattgctataaagatgaaaaaaatcccaaaaaacatctaaaaaagttcgtccgattctctaagaagaaaaaatggttcgtaaaaaataaaaagctggttcatataaaataaataatgcgcgcgagaaaaaaaatgaaaagggcgaaccaaattccgatttctaatcttcgttatgtctaatctaatctaactatttaaaaagagaaaatgcatgacaataaaaacagttcaaagaaacgtgtgagaaaagttagaaaaaagcgcaaaaaaaacacgctaaaaaggttttccatcttccgtaaaaaaaataaaaaaccgcgtgacaataattatttccatcgtcggtaaaaaaattacttaaaaaaaagggaggaaaaaactgtcagaaaaaacacgccatttctaaaaaatggtttaaaaaaaccgtgcaagaaaaaaacatcgtcgattaaaaaataaatcgctctgaaaaatctgtcagaaaaaaaagctaaattgatggacgcttgagccggataggatccatcgattttttgtcatctactacacggttttatttcatcagaaatttgttttaaaaaaaaacatgcgaggaaaaaacgcaccatttctaaaaaatggtttgaaaaaaccgtgcaagaaaaaaatcttctattaaaaacaaattgctctgaaaaatctgtcgaaaaaacgctaaattgatggacgcttgagccggataggatccatcggttttttttgtcatctattacacggtttttatttcgtcatatattctcctgtattggaaaaaaacaaaaaagaacattcgaaaaaaaagtaaaaaacgcacgagaaaataattgttagaaaaaacatgcaaaaaaacacacgagaaaagaaaagcaaaaaagggagaaaaatatggttttcgtcgtcagtaaaaaaacaaaaagaacatgctaggaaaaaactgttagaaagaaatgtgccatttttaaaaaatggtttgagaaaatcgcgcaagaaaaaaaatcgtttatagaaaaacaagtcgttcgttaaaatacaaacattgtcattgacatgattatgtatgaaaaaaatatattatcattagaatttttcacccgttgcaacgcacgggcatttttgctaatatatatatatatatatatatatatatatatatatatatatatatatacacacacacacacacacacacgtgtgttgttagatcagattagattagataggaaaagattgataaattcacattcacccagaggttaagtactccctccgtttcgttttatttgacaccgttgactttttagcacatgtttgaccggtcgtcttattcaaaaaaaaataaataattattaattctttttctatcatttgattcattgttaaatatatttttatgcatacatatagttttacatacttcacaaaagtttttgaataagacgagcggtcaaacatgtgctaaaaagttaacggtgtctgacggagcgcggcgctcctcaccgggagaccgcacaggccccccctttgccggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgcttgcccttcttcaaacaacatcttgcttgtaatggttaggatgaagcctggcatatatcgatcggggctaacgtgtcatctctgggatgtaacacgctagctccagccggggacgagtgcctagaagctctcgtcttgacgggatggggcgaagcgtgcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaggagtggtccgaccccccccccctcggggagaccaagaggtgggcgcacacatcaccctcgggcccgacgtcccccgagggtgccaggccacgtgggcgatggcgtctgcctcaagcctctagtcatgatactcccggtcccatgttaccgacagagcccccggcgttatgccagggcgatcgcccttcttatgggaagcggccgggcgtgacgccactcctaaagcctggtgacaggtgggaccggtctccatggttgggcagaaacccaacggtctcaaaccatgcacaccggttatggtaatttggctgtcaataatgggcggtctcttcaagactgccacatcacctgagcggcgaatgaatctgggcgagccgatttgcttcgcctggagatacggtaatgtcgcttcggtcggcgagcgtaattaacgcgcgcacgatacgatctatctcgactgccgcaaccgcatatccacctcacgcgccgcaagcgggcgaatgggatcagtggaagcgtgggcgcgagaaacgagggggcgaaataatgggcgcgagaaacgaggagccgggcacagcgttggcaagggtataaaggcactgaggataggatttgtttccttcctttcgccatcattccccttgccttcgccgcttgcgccctaactccttcttccctgcgcccttctttcgccacacgcgctcgctctccatcttctcttcgtccggcgccatggcacggggctccgcactgcttgatggtagcgtgctgccgccttcccgcatcgtgagcgagaagcaggctgggttgccgcgccgctttatgccggaatctgccaccggccgtgagatagtcatgctgggcgagggacgcccggcgccagactacccggggaggtccgtcttctttctcccctttgcaatggcagggctggttccgccattttcttctttcttcatggatgtcctggagttctacgatctccagatggcgcaccttacccccaacgcagtgatgacattgggcatcttcgcacacctgtgcgagatgttcattggggtgcgcccatctcttcggctgttccggtggttcttcaccgtgcagtcggtatcgccaccgtcggtggtcggcggctgctatttcctgccgcgggggccggtgttgaaccgctacatcccctgcgtcctccgcaaaaagtgggatgactagaagagcgactggttctatacccccctcgccgacgaagcgcgcctccgacttccgagccagcccccggcgcaggcctccagctggcgggcgccggtagatctgggggatggctatgacgccgtcctcgaccgcctcgcgggcctgcgatcccaggggctcaccagggccatggtgtacggcgactacctccgtcgtcggattgcgccgctccagcggcgcgctcggggcgcctgggagtacaccgggtccgaagactacatgcggacccaccagggagtcagatgggattgggctcccgaggacttcaagatactggtccaacgggtgctaaatctcaactccgtggaggcgtccctcatcccccacggtatcctccccctctgcagcgatccagatcgcgcctccatcttgaccattatgacggcggtcggggcctcagaggagcaggctcctaagggccatgacgacgcaggcgggagccgccgaggggatcaatctacccccggagggggtcgtgcttctgggccccgcgtcgggggctcggggagcagccgccctaccgactcccgggggaagaggaagctgggaggaacacctcccccatctcctccccgagggggcggggcggtgcgcgccagcagcaggcgcccggagggggccgcgccagcatcgcagcccgagggggagcgcaagaagaagcggctgcgcaagatgggggagacagaaccatcccggggaaacctaatttcccctccaaggtggtcatttaaccgaccccctcgcaggttcgtcccacgctcattgcgaccgtcttttcttctatcccaaaagcaagttttctcttacccatcttgtttgccttctggtttttctttctgcttcagtgatatctcatcgcgttcctcccaccatcccaagtccggccagtccgaggccgaagatccggcggccgcagaggcacggaggcgggaatctgaccggcgagaggccgcagaccgcctacgggaagctgaagaggccgcccgggaggccgcccgggctcgccaggctgaggataccgctcgggaggaggccgcccgggctcgccaagccgaagaagccgctcgggaggaggccgcccgggttcgccaggctgaggcgatggcggcttccgaggcagttcgcgacgaggccgcgggcgcctcgcttgggtccaccccttcgggcgacgcccaggaccaaacaggtccgggggcggctcgcgacgaggccgcgggtgcgtcgcttgggcccactccttcgggcgacgcccaggaccaaacaggtccgggggtggcccgcgataaggccggcgcgtctattggcgggccgagccgcgcggcatcttctccaaggcagcccttccccacgccttccgtcgccccgctgagcgcagagccccttctgcaggccttagccgccgcaaataccgcggtgttggatgggttaaatgcccaggtggaggccctgcaggcggagcgtgcggagctcgacgccgcatgggcacgtgtcgaggaggggcggcactcggtggaggccatggttgaagcgggccgcaaggcacaccgccggcacgtctcagatcttgaggcccgcaaggcggcactggcggagatcgctcgagaggtggaggaggagcggggggctgccctcatcgccaccactgtgatgaacgaggcgcaggactccctccgccttcagcacgggaactgggaggcggagctgaagaaaaagctcgacgccgcccagggggtccttgatgccgccgctgcccgagagcagcgagcgacggagaccgaagcggcgctccggcggcgtgaagaggccctcgaggcgcgcgccatggcgctggaggagcgcgcctgcgtcgcggagaaggacctggcggaccacgaggccgccgtcgcctcccgggagacaacgctggcggcgcacgagtctgcctgcgccgaagaggagtccgcactccgcctccgcgaggacgcgcttaccgagcgggagcgagctctcggaaaggccgaggccgaggcgcaacggttggcggacagcctgtccctccgtgaggcagcgctgacggagtaggcccgccgcaatttggaatccgtccgcgccgagagagccgcactggagcagcgggctgccgacctcgaggcgcgggaaaaggagctggacgcgagggcgcgcatcggcggggcggctgcgggcgaaagcgacttagccgcccgcctcgcagatgccgaacacaccgtcgccgacatgcagcgcgcgctagactcatccgccggggaagccgaggccctccgtttggcgggcgagatagggcccggcatgctctgggatgcagtctcccgtctggatcgcgccggtcggcaggcgggcctctggaaagggcagacaataaagcctgccgccaacctgggaggccttgcccagcgcctctcgaagatggccggggctctccagcagctccctgaggagctcgagaagaccatcaagtcatcctcgagggacctcgcccaaggagcggtggagctcgtcctggcgagctaccaggccagggaccccaacttctctccgtggatggcgctggacgagttcccacctgggactgaagacagcgcgcgcgcgcaggtccgggatgccgccgaccacatcgtccacagcttcgagggctcggcccctcggcttgcgttcgcccccaactccgacgaggagggcgatgccagcggtgcagacgacgtggaagacgaggccggcgacccgggcgcatcggattgagcccccaggcccccgccaatcttcaatttctttctttttctttcttctaaggccttcaggcctgttttttgtatagatcaacttataatctgcaatcaaaaatgatgaaaaaattctttgtgttaattttattttgctatgcggatgagatgaggatgatctgtgccgtggtcctctttttgtgtcttagcttgatttaagggcccgtgtccaagtcccagtcctcgaaaagcgcgggtcggggctagtgcctggggagatccgcatgtcgagactggccaggccgggaacgtggtgaccgagggttatgggtgacccgattgtgggtttttgccgattccccccccggagttcaccacgccccggggcacggctcggttctgggccccgtttggcgattttagctgaccgaaccgagcccccgagggcaaggttgagcacgagtgacctcatttcaagtcaaaattcttcaaaaaggaaaaaacggcacagatacagcccttaggaaattgaaactgcttttattgaaatactgaaatgagagaaatgagaatgtgcatgtgtggcagcccccggccaaccctgcacacccgagggggggtgcggggttggcccgagcccgaaacctgacacccgacccccccctcaggggtagaagcgacgaaggtgctcgatgttccatgggttaggcaactctgtgccgtcgcccgtggccagccgtatggagcccggccgggggacgccgatcactcgatacggaccctcccacattggtgagagcttgctcaatccagcatgcgtttgaacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacgaagctgatcttgatcaacctcgcagtacatggtgacccgaggagacctcagggtgagctcggatgggagaaccgcttctgcgccgtagacgaggaagaaaggcgtttccccggttgctcggcttggtgtggttcggttcgcccagagcaccgctggcaactcctcgatccatgaatcgccgtgctttttgagaatattgaaggtcttggttttaaggcctttgaggatttctgcattggcgcgctccacttgaccattgcttctggggtgggcaggtgaggcgaagcagagcttgatgcccatgtcttcgcagtagtcgccgaagagttcacaagtgaattgggtgccgttatccgtaataatacggttaggcactccaaaccgggccgtgatgcccttaatgaatttaagtgcggagtgcttatcgatcttgatgaccggataagcctcgggccacttggtgaacttgtcgatcgcgacatacaggtactcaaacccgcccggggcccgcctaaacggtcccaggatatcgagcccccagacagcaaatggccatgaaagtggtatgatctgcagggcctgggccggctgatggatttgcttggcgtggaactgacacgctctgcatcgccgaaccaggtcgaccgcgtcattgggggtagtcggccaatagaatccttgacgaaaggccttgccaaccagggtgcgcgaggcagaatgggctccgcactcgccttcatggatatcggcaagaagctcaacgccttgttcccgaggaatgcacttcaggaggattccgttagccgcgcgccgatagaggatcccttctaccagcacgtagcgtttggaaatgcgttggacgcgttcactcccttcgcggtcctcaggtagagtcttatctgtgaggtatgcttggatctcagagatccaagcaatcaatctaagggagcttggagcgctcccctcgggtcccgaggcctgggctccgacaggcctcggggaccgatcaggcgcgtccgtctcccctaaggggtcgggtcgcgccgacggctgggcaagcctttcttcaaagacgcccggtggggtctgggctcgcgaggacgcgagccgtgagagttcgtcggcaatcatgttatcccatctgggcacatgccgaagctctatcccgtcataatggcgctccatacgccgcacttggcgtacgtaagcgtccatctgcgggtcagagcaccggtactccttacagacttggttaacgactagctgggagtcgcctaacaccaagagacggcggatccccagtccggctgccactctgagtccggcaaggagtccctcgtactctgccatattattggtcgctcgaaagtcgaggcggaccaagtatttaaggacgtctccattcggagaggtcaacgtgacccccgcgccggcgccctgaagagacaaggagccgtcgaactgcatcacccagtgggcggcgtgaggcagctgcgaggggtccgagctggcttcagagactgaaacggtctctggagccggggtccactctgccacaaaatcggcgagggcctggctcttgatagcatggcgtggttcaaagtgtaaatcgaactcagaaagctcgattgcccattttaccacccgtcctgtaccctcccgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcgctaacaaagtagacaggccgctgcacccttcggtggggccgatccccttcgctaagggccatatccccggggcgctcctcgtccaagtggcccctcggggcgcactcgtcttctgtgccgatgacctcggggtcggaggacgacaggggcggccttcccacagtggcctcggggccgttctgggggtcgtgggctcctggcgtcgtcggacaagcgggcaaagggccaactctggtcgtcaggggccttaggccaccgttcggctcgggggcctcttctccctgctccctcccgggtcgaatcggtacagggttagcctcggggtcagagggcgatagatgcagccttcccgcagtggcctcggggccttcatgagggtcgggggcgcccagcaccatctgacgagcgggcagagggccgactccggtcgtcaggggccttaggccaccgttcggctcgggggcctctcctccctgctcgctcccgggccaagtcagcacagggtgggggtgcacggaatgaggatcgtcctcatcgcgctccacaaccaacgctgcactaactacttggggggtcgccgctaagtagagtagcaggggctcatttggctccggggcgactagaaccggaggagagctgagatatgctttcaactgagtgagggcgcgttcagcttcctccgtccaagtaaacggcccaaagcgcttgaggagcttaaataagggtagcgccttctctcccagcctcgatatgaaccgacttagggcggccatgcaaccggtgacacattgcacatccctaagtttactgggggggcgcatccgctctatagctcgtatcttctcggggttggcctcgatgcctcgggcagagaccaagaacccgagaagcttgcccgcaggtacaccaaacacacacttatcggggttcagttttatgcgggcggagcggaggctctcaaaagtttccgctaaatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggagtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatagatgacctcacggataaatccggcctccagaagtctcgcgacctcctcgcggatgaaggcttgacgttccggggcctggcgccgcactttctgccggaccggccttgcgcccgaccgcacggcgagacggtgctcaatcacctccctggggaccccgagcatatccgccggtctccatgcgaagacgtcagcgtttgcccgcaggaaggagacgagcgcgtcttcctatttgccgtccagaagaccaccgatccgtgtggtcttggacgggccgtcgcccagtgcaacctccttgaccgggacctcatcggacgtgactatccgctgcctcggggcggcgggggcggatgtgccaagcctctcgtcgccaccctcgggcttggacacgacggcgaggcggtccgcacgctgctccatacaagcgagcgcgactttgaggtcgccatggacagagatggggccgtcggggcccggcatcttcatctggaggtaggcgtagtggaccgccgccatgaacttcaccaacgcgggcctccccaggaccgcgttgtagggcagactgaggtccgccacatcgaagttcacccgctctgtgcggaaattggcgggtccaccgaaggtgaccgggaggtcgatatgacctagcggccaagtgtgccccggcgtcacgccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctcccctggcaacgcacggcgggtggtcggtctggtcaaaagtgagggcaacttccgaccaccgcgcccggcgcgtcgcctcatgagtaggggccgcggccagaagctctcgcttcatagccttgaggctccggcgagaaacgtgagcacacgctcctccatcgacggtggcaatggtggccccaggctcttggaaacccaggtcatcatcgccatcatcgatgtcctcggcgggggccttctgcctggcctcacttcgccgacggccggaaggaaccgccggggacttgccttcccggcgctcctgcctcctctcctcctcccacttccttgtccgctctgccaagcttttgactgcgcgacagtccacaaggtcatggagggaggtgttgtggacggtgcaccacttgccggtagggcgctccctgctgggaacgctggcctccttctttttgtcgctcgcaggcctcccctttcgggtggcccgcgaagcgccctcgacggcgaggacatgaccctcgtcgtcggaacggactgacctcttcttcctcctcctgtcacgccgccctgcctgagcggcggatccgggggcggccgaagctgccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagcgactcatcgtcccttcgctgtacggcgtgcaagtccgcttcctcaccggggcgcggatacgtgccttggaagttcatggtgaactgctggcacaaatcctcccaggagtggacagacgcgggtggcaagttcattagccaaccccgcgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccacgtccatgtcgaggtgacactctggacgaggaagcgccctccgttgcgtgggcagcacttcggtcattacgccggcgctcgatgctggcgcgggcgtcctgctccccatgcagatcttcccgggtcgaaggagtcgacgaaggagtggcagccgaacggcgaacagcggctgccgctcgtcgtgccctccgtcttgacaacgcggagccggtggtagcagcaccagaggccttggtggcggaggaccgcccaccagcatctaggcgctgccgtgccgtcatgaccaatttggccacatcgtccagccatcgttgggctggagactccgggtcagggacgacaggcgggtggcgtaagagcgcgcccgcagcttggagcgcgccctggggcgtgctgccgtcgccgtagacgaggaggcgacggtccccatctcgccgttctcctccatcgcccgcgatcggtgaagccgcggatctttcgaccctttcgagcgcctccccctgcttaggactttggcgtggagggggcggtggagtacgagctcgacggcgtgggttcggctccccgtcgtcgccactcacactgggagagaggtcggacgcctttgcttgctcagccatgaggctgatcaagaaaaacttgacgcacacggaaaagtgcgagagctcagaaaacacacgctgagccccctacctggcgcgccagatgacggagcgcggcgctcctcaccgggagaccgcacaggccccccctttgccggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggac

SEQ ID NO: 39934 - DNA, 3791 bp, Oryza sativa
tagtcatgatacttccggtcccatgttaccgacagtgtcaaataaaacgaaacggagggagtagatagtagctgcatatagagcatgggaggagatgagagtgatgggtggtctgattgggaggagaagaccatcatggatgagtccctccggccgccgacccacgtcgctactgcggcgatgacgacaccaccttgggtcctcctcgaatgcgatgcctacatcgccaccaaccacggcaacgccaccaccgccacgtccaggaccaggaccggccaccccatcgaggtatccttctgggcggcgcccccgccgcgcgtctcctacatgtgcgtccactgccctggattggatccccagccgagcccaccatcatcgccaccgaggctgacctcgtcctcctccgcctcgccttagggccccgggacgacagcttcaaaaccagccgccaagattacttcatctaccacgcttcttccaccgccccgaaactcgacaacaggttcatcgacaaacaggttggcatcctgcgctgccttgatgatggcacctacatcgtcgccgcgctctgtagcgccttcaaacgaggtgatcatctctaccgctctggtgcagatgcttggacctgccatccgctctccatccatggtttggtcttcgatccatcatttagccatgtcactagcaaggtcatcacggttggtggtgaagccggaaccatgggctgggtcgacatcaacgatggcattctcttctgcgaccttctccgcgacaccgctgagctccgctacctcccgctgccgccaccactcgagcacaaagacgacatgatagtaggctgtccagggccacttcgggactttgctcttgtccaaggtcggatcaagtacatcgagatgcaggttcatgtcaggccaggctccgctatcaacggcacctacgcctctcaaggctggattgctgccacttggagtgcaccacccaccaatccttggaagcaaggttggcgccaggactgccaaatctctgcctctcatcttgctgttgatcacaacaccatgaattttgagttgctgcctgagcttggcacacctcagcaaaccttggagagacttcacgtgggccttccaaagctcagcttgcactctgatgacattgtttgcttcatggctaaggtcgacctctgggatgaccagaatgcatgggtgcttgctgttgacatgaagaacaagaggctaaaagatgtggccgagtttggcgcaggaagaactcttggcattagctctgcctacataagcagtaggatatcagactatcttcctacggctccaggtaatttatgtgttctaccggcgcatccactaactaattctgtcatccgttgcattgctagccatcatgacctacaagttttaattgatactcctgcttgctttcagaaatattaaacctgtgagttataattgatagttatattaaatcaattagattgatgcatatgtatgtgctaatcaattggaaacatgtgcctttgtctttactaacaagaacaaggggacattactgtaggacatgatactcattgtttctatgccgctgatgataatcaagttcagaacgctacttgtctggtgttaacaaaatacttgacacagctgtcttggaacacttcagtgagctaataaacatattacatagatataacctatgtacaggcagggaatcatgaaacagaatggggtttatgaccaatgcccagttaaatggctgtgcatatatgactgtaaaatggatgcctttctctataatcgcaaaatgttacctaacaaacagatggtggaaacaaaaactgcatcatgaccatgtgctttcacagaaagtgcatgtcacctaggttgattgttttgctatggaattttagagggaaaggatatatatatatatatatatatatatatgagagctactgtttagttgtcattgagccggttttcacttaatattttgctggctgcaggtttaaagggtaacctgaaacgacaaggggttgtgttgaccgtgccttctcacaagaagcagacccgtgtggtgctgtctaatccctcttggaaaggtggagatcaacaaaattctggaacaagtatggatgataaagaggataacatggatttggacttggacatgttttttggatgaggggcatggataagtgtgatgcatcttcatgccttgctgttgtgttaacttatggctagattatctactgttttatctgtcctatgagtaacttatatgagggggctattgctagtattttgtagcaaggatgaatagttgtatctgtagcacaatcttaagagtgtgctcttgtttatgcccctgtttatttcttatcaatgtagcgaggttgtaaaccgtatggtcctctagctggtgtcaaattgctcacactttatggatgcgtgcctcctggtagagttgggcgtctcaagtcctattatttttcttctgcaatttggtttcctcgcagcttttcgttttctgagaatgtgaattgtgaatctgaaatcggctgactgcaatcaacatttgttatgccctggatggcctggcaatcaacaggtctgtccataattctagatggtgtttaattgagtactagagtattatattttgggacaggtggggtatgttttatcagaacttttgaatggaacaaacttgaagatgcaaactgatgaggacacctagcacaacaccttgactagagtaggatcatcaaccacaaaagctaacacccaggaattatcttagcagcttcactcgatcatatattgtattgtttacagcgataattatctgattagtatcttgcagcattcatggccttgctagtaaattgtatgttcgacctcatcagataataccatggctttggtttaattggaattattagattctcttcccgcaagttggagtcgtactttccgagtctttttcctttggttttttgtttttctcctctcttagaataagtcggtctggcttaatgcattgtgtaacgaatattcttatcttttaatatattgacgtgcaatccttttacgtcttcgagaaaaagaattattagattctctaacgaattgcacgcttacttgatactactactctactagtagagtacctgcttgtatgagacatatccatgaaccgatcagtttgtcagtcaattctggagccgtatcaagttgctagcccaataaaaacttcagacacttctgtcactaactacctatgcctggacctgcatctctgaaaccaccaaattcagacctgtttggatcgacggatggaattataccacctaggactgggaggagtgcctgagttgccttctggccatggtcttgcccatcaattaaatacttgtcgtatactccctccgtctcaaaaaaaaaagataaatcctgtgttttttttccaacatttgactatccgtcttatatgaattttttttataattagtattttaattgttgttagatgataaaacatgattaatactttatgcgtgacttgttttttcaatttttttcataatttttttaaataagacggacggtcaaacgttggacacggaacctaggatttgtttttttttggacggagtgagtagagattaagaaaaagaaatggagcaacgtgttttatcgatcatacattctcaagtaaagctgacactgatgaccttctgaagagttttgtcttcccttccactgctgattcggtaa

SEQ ID NO: 39935 - DNA, 1132 bp, Oryza sativa
  unsure (1)..(1132): unsure at all n locations
ataaagaaagatttacaacatacaccaagtcaatatcctagcaaccaatcagcattacaaaaattacaggttgatatggcaaatattccatgtggcagcaaagcataagttcatgggttatatttacaagaacactttggttaccatgtgacagtaagatcacctgggtagagaaatgctggtgtctcaaaactaggtaatagacaaggtattaaaaggataatcattcacatatcttcacaactcacaaggcatgtacctttcaagcccaaagcgtacgaggcaggaggtggcatcatcacttttgcagtatttacagcccttganctatcttgatggaacattgattatctgctaacatctgcaatatacaggcttcaataagatatgactcaaaactctcaaagtagggaacacgtaaaacaattatgactattcatccttgccaagctatgtattgacgattctacatgaattctgacagaggagaaatgtgattaatcattagctgctaaattttggctgcagttctgtttttcatttgtgcaaatttcaacaaatgggcaaagaggaaagtaacttaacatacacacacacagggaaaaaaagagagagaagccaaacgtactttaaatagcaaagagcggtgtttgcagaaaccgataggtaactttcccagatggagaacgatagaccctgtacttgacttgatagcatcactgcactctttccagcgtggaagaaaactctcttcattggaggttgtaccccttcatgattgaaacaaaaaaaatagtattagaaaccacagaaacaagacgatacaaagacacttttgatgagtagattagttgtacaatagtcaccccattctggaagacacaagcttggctagctggtttatcacatccttcatgtcggcagaactggacaagaagctggaagcgtaattctccagcatacctaaatcgaaatcggttcttctatcgatgagaatggcttgcatggaagaatcatctgggcggacagacttgagtgaatcaatagaaggtatgcggttctcctcgagtagatcagtgcagagtgaccagacaaaggggtccatgccatgaatcaagtaaaaaccatctgg

SEQ ID NO: 39936 - DNA, 3513 bp, Oryza sativa
ccgcgtggcggccgcatgagaactagtggctccccctcaaccaccgagctatcataaagggaggttaaaatttcaacctatacagaggtcaccaccgagctatcataaagggaggttaacatttcaacctatacagaggtcaacgccaatgagagtggcgctgacctttgatgatgtggctaacttatgacacctcggactgagtttagcgccaaaattggtggcgctgaaatgttagatctcagcgccagttcatttttgaaataaatttttgacacggtttattcttataataaatttttgtaaagagtcaaactgtcaaaatttgtgaatccaaggagtgtttcagacacgttcactgcaatcgcaccgcaccgcaccgcatcccgcatcccgcagcaggccagcagccgatcgcgagtgtctagtagtactactactcggcaccgagagctgcattcccgagctccaggttccagcaaagtagggtttagggtccttaggtttaggaggaggaggaggaggcggcggcggtgagaaggagagtgggatatggacggcgacggcgacgacggcggcgactggaccaaggtcacatataaaagtaccccaccgtcctctgcctcgagtagtgacagcgggggacgcggccgcgggcgcgggcgcggcggccgcggccgcgggcgccgtggcggcgggcccgggccccggtccggcaggaatggcggcggctgggacaagcgtggcaagaatagcagcggcagcgaccacgagagtgtcggaagtggaacccccccctgcaactccgtcgagagcttcgacacctgtaccctcccctgtgccttccccgtcatctacgttccctgatttcgcggaggaatacatccgtcactccttcctggttaggcttacccaatcttcggatgccagggtggccgagaggttcatgcagtttctggtcaagtatgttcttttctcatttaccttatttgcgaatctatccatatgatgtatatttgacttaatatttctatttctatagctacactgcccccggcgatcaactcccattttacccaacagaagctagagcccttctgcaaaggaaaaactctgattgtcatgagttgttggtgcacttcgaccacctgagagagatggacaaaatactcgccttccacatgtgcaacaaccagaacaggtaaatacatttatatctactatgcactgtgatagtgtggcctcttgagtttgccttgctgaatcgatttgtggatcacgcttaccttgttctattggaggtagcaagtcatcaaggccgaatcgtttaggtttttgttctttttttaaaaaaaaacatttgtatttgatgcttttggtgctctcatgattgggattaatttgggttgcgcgggatttatttatatggcttgtgcatgtcagatttaacagatgatttagctatagttgatgtgtatactggtctgatatggatggtttagagttagctttggtgtgctgataatgtacatttagcgtagcttcttcatatttagctctgattttatttggatctgatattagtatgagggctgccattaatattatgtgtagagtagcatgggtgattttgttttagtggtgctggagtagatttttatgaggccatgacgtgtggttagaagtttttggacactttttcttgtgacccatgatggctgaaggggtgaatgggttcatggaatttgtatgtgtgttatttgttcatggtattaaagagtcattatgtatttttttattttataactgtaaataggcatctaagcatgactctggtatctgaatatactagtgcaggtgttatctaatcatacactggtatctcaacagtgttctctaatcataaagtgctgtcatctaagatctgaattgtgttatttaaataggttagttatatcatgaaatagtgctattgaaatgtgacctgatattgccttgttggctgttgcttgttctactttcttcaaattctatcagtatgttttgcttttcatttcctgcattttcagggatgccttatattctgatagaacattaaagaatgagtaaattatttttactctaaaattagaaaaattaacaagattttgagctctgttatacttgcagaggtacatgctgagtagcattttgtgctaaacaaattggaatgaattgtatgcacaagattcaattccagatgcaatggagctgcaatttttcattttcttaaatcttttatttgacttgagtgtatgattctgtccggggactgtgttgttgtttctctccctttcttcgatgtgtctgttgtgaattttacttctctctgattgtttactgcttcttaggatattctgcacttatgagattatgtatcagtcacagattaaagttagtaggaaaaaaattagagcttggattattgtatgggaagtgtctgaactagtcagtgcaactatagtctttatattgtgagctaaatttctctaggttatgtagattttgggaaacataggcatataagatttcaagaggtatctatatcaacattgagcatataatatccgaacataactgcataagcatcatatattgatatttatgctttaaatttgttcttgtgagaagatttctggttgagttcacgtgatgtagtcttgatcacgggattgttttgcttttctgagaagctttcttgtctctctctgatgttgggcttttatttgcagtctattaggctcagcggtctgaaaagtgtttgggcttgtcaacatggttgagatgttttttgggctctgtatggacttcttttgggttttggttgtttgttgggcttgtttttaactagtctttcatgattgattgtctatatttgtgggctgtttaatgtgctgcagtacaattatatttgggcctgagattatatttgggtttttcaactagtcttttcttattgctcacatgatctctctctttcaggctagctcccatactatcgtgtgttgcatcacagttccttctgaacatctcccttcaagatgacgtctcagaagaaactcgcgaggagaaagtgataaagcacaagccaacgattgaatctaaagtgatactcagatttatcggcatgccaaattacaggtactccctccgtcgcaaaatataacaacttctagcactcagaatttgtcctaaaatataacaacttctccactaacattctcttcccaaccaatcacaactctccaccaatccattcacttttcccacctacctccatttctcgaccaatcacaacatcttcccatttaattctacctactttcttaataattgtgtccaaccctaaaacttcttatattttgggatagaggtagtaactgattaatatcatttagtgtccattaaaaggaatatatatttttcaaataaatgtatttatattgaattcacttgcaggattaccactctgaa

SEQ ID NO: 39937 - DNA, 9357 bp, Oryza sativa
tagagaacaaatcatgttcagtatcagtttcacactgaaattaactttggaaatgtatcattgcttaataagaggaacatgtatttattttggtaacatagtttttttcagtagtaaatagtaggtatatacctatgcaggcacaaaataagttcaggacaaccaagctaggtttcataggatatttgtgtccttgaggctaagtagcgatccaattttgaattgctgcacccaccccttgtagtatcatatttcatcatgtgcatcattatccacttcactgttcgttcctaccaagggaaatcactcagtaatgtaattagtgtggctactgtagtgatttttttttgtgtccattgtacataaaaaatgatttaagtatatgcaattttttttttactttactaacgccccatttgttttttaatttcagtggaccataaccaagagcaacagtacagacttcagtttaacaacgccaattgttataaatacgatgttggcaggtgtattgagtgcattctgggctttgtatgcctggatatttgacccaaaatcacccaattactttatggtaagtaatacattgcttgtttttgtttttactaattattaatagtttatattttctttttaatgtacgtcattacagatagcaaattcattggcggctggcatgagctcaatacaatttgtatggctgttggttctgcgcaattctcacagagaagtaaacggacagattgtagaagttgagagtctgcggtgtgtgttacttagtgtcgcaaagtcgttggagaggttgggagcagcagctcctaccgaggagttcttgcaacaaaccaagtatctgctgaggttacaagaaggtctgtccattgggctgcagtcgttggatttgatggagagtgcattccttcggctggaacaggagctagtgaagaacgttgctcgcactgctaatcatgttttagaaatgcaggataaacaagatgcagcggctaatttcgtggcaaggtctgatgacaacaatgcaaatgatgtgctaagagcctgtagaattttacgtgaaggatgcacaacgaacaagaatgcttttgatagcatgcaagaggctatacaacacaagattgcaaatgccgaaggaggagaaaacaacttgaaagacagaatcaatgccgcagcagcagccataagaggcttggccatttccatgggatacaatatgcaaaccatcaacggtcgagggattccacccacggtgaagatcgccttcaatttttgctgtgagcagattttgtcagttaaaacttgcgccgacgccccgtttgtgtggttggggtttggtggattttctctacgaaggcgtctgaacttacggtttgataacgtgaactggcctgatgtacccttgtagtacgaattgggctacgtactgtacgtgaaacttgctctaatagcttcagcgagcaagcactgtgcaacttctggattgctagctaggatacttcgtgtccctaagtagtcatatgcttgttagctctgttagtttcttctgctgcttttgtgcccgattgttgtggagtgtgatgcttctactggtgccagacagctctatatatctttccagcaaattaatttctaaaactagctagatgggatcgatgatgtgtcttgtgttgtagagattaaaactctgctctttaggcagtgattgtgtctttaagtttgctgtgttgacgattatgcactgtgattaattatttagctggtcgtggatgggcagcagacggccgggttttcgctctggctctttcaccgtcaggctactgtggtgcgagggctctgcaccgttgcccgtatttgccgctcattttcgcgcgtgacgtacgcacacggcacatcgcattgacatgagagagacaattgtgtcgatcagtttgggatttgccccaaaaaaaaaatcatcaaatcaaatatgccttctgatttgccattggaattaaactcaccaggatcctagccaatatattattttcagttcttttggagattattagtagttctttacaatgttttgtcttcttataatgctagaaaatacaagcacctgttaggacttgttgcctaccaccaattataatgctacaaaatacaagcaccgaggtgatgaggtcttcctatatatactgcaatctactactcatgttctggcctatgaaggttgtgcaggatgtacaggggagccgaatccgatgacaagaaacgctcctagttggtggatggtcttcagcagcattggccaacctcactatttcccaatgaacagaacaatcattcctccccatggtgacatcggctagcctaaaaggcgaggttttgacaccatcgtcatcttggcagcctggtcaatctgaaaggattggaacaatcggatgttcaacggcaagagcaagaccatgcgggaagtgacggagcttgcggacatggaagccgcgctctgacgcgaggcaggaggagtgcccatttaagtggcggtcatctatgaagttgcgagagattggccttaggaaaccaagctcttttttccttttctttgcatgtacatagttgttgaacctatgtggaacatctaaatcctgatattaatacaaaagacacgcattttgtgtattcatgaaaataaatgagagaaacacgtaccgatgaacatagattttgagttttgtgtcacttaaactagggattggcccgtccagctttgtgcggagctagataattcacgttgttaatataaaaatatgtttttttttgagaaatcacaggaggggagagcttccccacctgaatcttccattgagaagagtgaacatgggagtacatcattacaagggccgatcacagccagcgttgtgccactaagaatggtgagaagaaagggggcgggagagagtagctttccaagcttggattacaattcaatcgccgcgcttaagtcttttagcccacaaatatgaaatttaatttttattagtattattacatgtagaagtatatttggatttcatatataactcttagcttctatttctataaggtatggatttcatatacaactcttggattctatgtctacatgcttagatttcatataaaaatattaacttttatttctactagcaaaatacccgtgcattgcaacgggttaagaaagaaaaaagagaaaatttaccattgtcaagcactttgccatgcattttttctaatgaaaaaaaaatctagattacccctaaactatcatggtcagccccctgaacacgaataccagacatttttcaccctcaactatttaaaacggacaaataacccatccttgtccatattcaatatccggaataattttggccctatgtggcattgcagtcagcattttttttctaaaagataggtgggccccacctatcatacttttccctttcccctttctctatctttttctctctctccccctccctgccatagctgaagcttgcgacgacgttagtggctggccctatcaggcctcgtcctcctcacagcaaacacactgccgcggtgctgcttgcccacacagaaggagccccgatagcatcctacgtaccgtctcgtcgaggtgtaggccgaggaagagaagcgtgacagcggctgcctccttgagtttgagatctgcaggctccttgcggcggaggccgaggaggagatgagatttgcggctttctcaagagcgagatgccagcacgagtgcgagatgcgacaacgacagtctaggctgagaaggtggtggcggcttcttcgcagctgttgtccgtgtgtcatgctaggagacgacgacgagctcatcaccgccttcatgcaagctccagctccgccaccattgccccctccttcgtgcgagctccggctccgtcaccactgtcgtcaccttcacgtgagatctagctctctcgcctccacgctccctgaggcaagagacaatgtggtgttacactaaatatttgctaataacggattaataaggcttaataaattcgtctcgcagtttacagacatattttgtaattagttttttaatagactatatttaatactttaaatgtgtttctgtatatccgatgtgacatgacaagaaaatttcacccctagatttaaatgcagccaaaatacatcctttttaagctgaactagatattttgcgtgtgccatcacccatggtcctccgtactatcttttttgtccttttcttttggtacggcggttataaatgaatattgcacctttcttatccacactcatactatatcggcatgttttatatacgattccttatatcaggatggcttagctattggtatttgtaaaatagtgaaatatgatttaaataagccggcatgatgtgaaattgttgtattattttttacccgctgcaacacactggcacctaactattatttttaaacacaaaaaactatttatatttgtagagcgatgaactataagataatgccagcgagcaattaacaagaacaagacagaaatcaactaacaagtagcaacttctcattggttgtaataactagcgtggcatacaaagagtttcagatgcctcttcagagtgaaggcaacgcttcccacgcatcccagtcatagaaagtttcagacgcctccgaagattgaagttgaaggcaccgcatcgcagccatagaaagtttgagccgcctccgaagactgaaggcaccgcatcccagcaagagaaacggagtgtcagcacaagttttaattgaccacatatgctcacggcaaaaactaaaagcgattctcattgtgggtggaatgccttctgcaccgttgatcctttggatccagggtcccaaaaaaatagctaatatcctcgtcatcccagatgcaagtctgatgttggcctgcagcttttccccggctcctgcgacatctaatagcctgtcatttacagatatctgaatgtcattaaaaacaatcatgtttgccctgcatatttcaagaaaactcctgtaagctgacagggcaccatatgcagctctctcattagagacggctaagaagacaaccacgctatgtacacaagccttatcagcagccttgtccacttgtttagattcaagacgatctctatttgcggcgtcaattgcggcagcagcaattgcagcaagcgatgcaaccttgtccgcttgtttggtttcaagacgatggaaggtacgctccattagagagagcgattgccatgcaatgtcaaggttattttgtaacttgaggagatagttcctggtccagaatgatttggtaggaggggcagcacccaatctctccaaggattttgagacgctgcgaaacacggatgccaggcgctggacaaagggaatttgcccctggatagccattgtaggtaatttccaagatgtaattaaattgcaatccggcggctctgacacgaagaagaggacgggcagatcgacctgaaaacaactatcctatctctgcagatcgatttgttgcgatgagctgagattgacggttgggacttgggagttatatggagccaggcggccggcggaagtagaattgaatccgactacgagtccgagtcaggtacgctaatagtggagtaatacggagactaaaccggggtcggccagagtaatggactgtttgtaaaccaaatttgaaaaatcaagtttccttcttatgtctggctggaagatcaaagaacagcaaatcatcaattgattcatttgccagctagtactccagttgaaccatcagttatcctaattcattcccttttttctaatgttcagagtacaaaaattcatttctggtaatgagatgggatcgctgtctcccctctccgctatggcatctcatctactccgatcctcaccgagcataactttgactaattaatcagagtatcatccgcaaccgaaagtaaacatgaggaagagagtcttcctcccctttctctaatttgacagaaaaaaaaagaagagaaagaagcaattagtcactaacagaatttgagcatcagtcttgtcgatcgatcagcattatctgctggtgtcgccgccgggcgccggtgatggtgacgatgaggaggaatactcccatggcgtcatgtccatggggtagctgccgagcacccggaggaaggaggtgaactcctgtatctccgacagcgcgttctgcgccctgacctccgccatggacgcctggaagtcgatgtagaacatgtactcgaagtgcttggccgtgcccacgttggcgtcgtcgacgagccggatggggcggtggcggtgtgggcggctctcgatcttggtgaggctgatgtcccggaacgcgaaggccgacagcaccttgaagagcaccgacgtgccctccctgtcgtgcgcgaacacgatgctcgtcttgaatggccggtccgttcgcgggatgatgggctcccgcgccagcatcacgaaccgcgtcacgttcccggcgtcgtcctggatgccgtccgcgagcacctggagcccgtacagctcggcggcgcgggaggacgcgatggcggcggtgtcgcggagccccgcggcggcgacgtgctcggcggcggccgcggtgtcgtcgaaggcctcgcgggcgacgttgaggcccatggcgttgagggtgagctcgcactgggcgagcgcctgcgggtgggagatgacgcgggtgaggaggtccctgcggacgcccgggagcgcgaggaggcagtggtggacggggagctggacctcgccgacgatgtggaggcggtggcggaggaggaggtcgtagttgcggtggatgctgccgccgagggagttctcgacggggaggacggcgcggtcggcgatccagagctcgacggcctggaaggccacctcgaactggtcgcaggggatggcgtcgcaggaggggtaggccttcgccgccgccgcctcgctgtatgcccccgggacaccctggtaggcgacgcgcagctggctgccgtgcatgggcgcgggggagaggtcggtgatggtgagcgggcgagggaggttggagacggggagcagatccaggtcgagcggcggcgcggcgtggtcggcgagggcgggcttgatgctactgttgctgtcgccgttcacccgcgggactcggcggatggcggcgcaggtggcgtgccagtgggcgcgggagaaaggggtggcgcacggcgggcggacggccgtggatctggggatgtgggcggggcgcagcgcgggcgaggtttccatcctccggcggtctccggaggcgaggcgggcgcggcgaggggttggtggcgggaaagggccgcgtcgcgcggcgaggcgcggcgaggggtagtgtaagtgaaagctaagcaaaagaagaaaggttgcggtgggaggagacgagacgccgcggcgccggcgtgagaagagaatgaggtgttcccggtggttgggtaggtgggcactaaactatgaactatcccattcccaacgatgaagatgatgacgttgcatcttttactagtcttgctacacgccacggagattttttatgtttttccagtttactttcagtggtacaccgaccaaagtcaaatttgtttttgcaagtgcaatcctacgtttcttttctttcctctttcacagtttcaacacacacaaaatatagtacagatgtacacaaatcacctcttgtaactacaaccttctcttttcgtcttaaaaaaaataaattaacctatattgaaatgagacgtaccataaaacaataaatttggatagttctccctttagatttgtctttagatttggtgtcctacattttattctatctaaatctaggttgtgttttctttttacggatgaagtactactcacttagaacctaatcctttaaaatatctcaatttacatcagaaagatgttttggcatcgttggctcgtccattccacattaaatggaaccgaacaatcgcaacggccaaacgagcttgccattagatcacacacccttagatcatgtataataaatttccattagatcacacacctttagagagaacagccggtgtgatctccattggcctccggcgtcatggtatcaagggccagctaccgacgcgataggaggaggtacagctagcggtggtgagtggcatgaaactataataataataataaaaagaaaatcctacaacctacatgaaactaatttttttcctcttcctctccttaatcctagaaattaatcattttaaattgctaactaagatgctacatggcaccacatcatctcagaaaacatcttagtttgacatcaaggatcaaaattaacgactttaagagttggggaaaaaataaatggtttcataatcaacggaccaaagttggactagagctatagtcaattaagggttcttatatatgatacgcagtactcccttcgtctctaaatataagtgaagagaggataaaacaaacggcagagctgctgcctctgtcttttcccagcaataaaaaaactctctaagaacacaaaagctctgaattctatgatgctattaacttttcataaacgtttgatcatttattttattaaaaaaatatataaatataaaaaatatatttaaataaaactttaatgataaattaaatctcagtaaaattaataataactatataagtatattttgaataacagaatgatcaaccggagatttctgaatccgtcgtacggttccggagatgtaaaaaacaagcacttttttccaaaccaacgtgaatattacagtcgccgccattgcctcagctctttgcaggttcactcaccgccctcaatgcggtcagtattcaccagctagactggtagggaaaaagaaagatcaaactagctagcaagacatagttcctttctttttcaacaaaatctatgttaattgatattcaacacggatgtcagctacaaataaacaacaggaatcttggtgaattttacatgttcaaatagcacaacaacgctcttggttctacaacgatgcaactgctaggcaaaatatttggatttaatacacgtaaggaaagatcctccaaggcacaagcttgcaatattctacccagatctccttgtacttctctgagcaccttgcttcgtcccttcgttccctccatatcagcaaaatgaacaggtatgttgggtagaagtatgggatcaccgaactgcaccaaaagggtttatgatttagggtttatgagaatcaaattgaataagagagttgtgtcgaacgatcatcatcac

SEQ ID NO: 39938 - DNA, 841 bp, Oryza sativa
ccctgatgatatggtatctctaaaaaaggttcaccatgggcctttacctgatgactcaaaagttgcagagcttgagaagctggtggatttattggctccgttctttttgaagaagggctctcccttattcttcaaacaattgaaggacgatgtgacccttacatctagaacattggtcagtgctagtgattgggaatggttctgggattatcttggctcacatgtgttctatatgcctccagtcgctcgactgcatcttatcaaagacctctttgtggctatcaaaacattcaaattgacttgggtgaaacctttctccactgtacttctagattttactgaatttggtgattggacaattggccccatgagtaagacagatgggcaggagtccatctattacaaggttttttggcacaaggttaagccggaggatattgatccaaaaaacccaaagtactggcccaattacggtgacctgctaagttttatccgtaatctgattgaacatttggatgaacacaaacacgtatgctctctctctctccctccctctctctctctctctctctatttgacagttgacactgttgtgtttcgacatctgtaggaggagaatattactgatattgttgacgctgagctctttgcatccaacagttaccaagattttctcccacaatttctgcagcgtgtttcttcagcctgtctaatgcagggcaagtaagttctgtttttgtgtgtgtaccagtattcatctgaacttgtttatcaacaagttatatgtaatttttgtaggtttaaatcatcttgggatgccttcaagggttccggtgagact

SEQ ID NO: 39939 - DNA, 3481 bp, Oryza sativa
atatgctagccaaatatttcagttgactgcagacactaacctgaaagcataggtcatttaggtataattaactaaagagattgcagctaggatcagggcatctgcagtcacacagcttgggcatcattatctacatcaagcaaatctccaagcaaattcaggtaaggccgtgtttagttcaccccaactaccccaaactttcaactttccatcacatcacatcacatcaaaaactttcttacacatataaacttccaagtttttttctaaacttataactttctccaaacttttaacttttttcaggaactaaacacaccctaaaggagaacaactttacacaaaatggacatcaaaatcatactaaacaggcaggggccgggtgtctgttcgaagttactgatgtccccctcatgcagaaagctgaaaaataaatctttgcttggtaacaaaccggctaccactggcattctagtaacatctaatctaacatgattaaagtacgaagtcatgataatactataatcagtatttcttattggaaaccaacccacaaacaacgagtaattcatacatgaagcaagaaccaaacataccaggttagtcgagatggaggcggcctgtcaccgggatggtcttgacaaggacgaggtggtggccagagtcagagtaggcagtagaggtccagccgacgagcgtcgtcgtatccaggagttttctcaaagccgacgaaacagagccggtgatgcaatatgtatgttgagctacacagatttagcatgttacagcacaccttgctatttccagtatttcatatgatctaaggtttgttcacataacataaaaatattttccatctttacattcttacatacaaatgaaagcacggttatatcttattttgcgctaaactaaactacagtatcatggttaaatcagcaaaaatctatgtgttgatagctcgttccaaaaagacaccatcctgaatacgaaaaaaagcagcaccatcagaacaatccacatgaaacaattgcatttttttttaattcattagcccttgtgtacgctgtgcatgacaaagaaatatgtggtcatgcactcatgcgttcgtaggttagtcaatgcatttatgtaacattagattctattgttgactttctagatcttttatatttccttctaaaatgaaatgtaaatgcatctttcatataatattgattatttagaaacccaactattacaaagtattagttttgcttgaagaagcttacattagtaagcatgttgaagttctccaaagcttgaacctacaaaacctggcctcgaacattcgtatactcagagttccactttctgtggaaaagatgtcagttaacgaccatataaatcataacggtcctagttataccctcaatacaaaatcaatgcttagtgaggttgaataacgaggttgttactacaagataatacacctgaagtgctgtcagatagttatggattgaaaacatttagatagtgcatgaaccgagttacctgaataattgacaaagcaattaaggacatatcacataagatttgttctacaatgatttctcttaattccaaatagcacatgcacataatgtagagttagcttgatccattcaagaagatctaaataacccaatttcacataaatcatataagcaacagcactgactatttgtgttcatatgaaaaaactataattgatttgaagacatggaccagctgctggtcataggatgatcactctgtatccttgcctaacatgtgctgaaaatgattaggatagcaaaatctgcataataaaaaaattacttaaggggaaattagtatgttgtgtagccagaagcaaagattatctattaaacaacgctaaaattcaagctagctagagtggcgtgccttgagaaaccattgcatcaataacgataacaatggcatgcaagaaatggttagattgcatcagaataggcagatgtaccataattagaccgataaatttgagaaaataattccgtagatgataactatagatgggagaaaccatggtaacgtgcaggctaaaatatattgagtaggaaatctagcatccatatacaaataatattggcatatcggatagaacctattgcaaataccggaattgcgacatcaaacgtcgacagagctgataaagcaccagaaccagatggcttcactggggcattctttaaagtttgttgggaaatcatcaaggaggacatcccactggtgttcaactccatcttcaatcttaggtgtgcgcacctcaacctaatcaactcagcgaacattgtcctaatcccaaaaaaggatggggccgagagtgtttcgaactacagaccgattagcctgatccatagcattgccaagatcttctcaaagttgcttgcgttgcgtcttaggccccacatgcatgccttgatctcggtcaaccaaagtgctttcataaaagggagaagtatccatgacaacttccttttcgtgcggaacatggccagaagatatcatcgcttgagacgggcaatgttgcttttcaagcttgacataacgaaggctttcgactcggtgtgttgggattacctcctggccttgctgcagcaaaggggcttcccgacgaggtgggtggattggctaggggctctgctatccacttccacctcccaagtcctcctcaatggctcgccggggcaacgaatcaagcatggaagaggacttcggcaaggggaccccctctcgccgcttctcttcattttggctctacagcgtattctctccaaggcaatagagctaggctcaatctcaaaacttcggggaagaacgactcgagtgcggatctcgatgtatgcagatgatgctgtcatcttcattaatcccacctgaggcgatgtcacggctttcgcggacatcctacatcgtttcggcacagccactggacttgtcaccaaccttcaaaaatcacaggtcgtggccatcagatgtgacagcatagacctgaccgaggtcctccagggcatcccagtaatgagggcaaattttcccctaaaatacttgcgcctccccctagttctgggaaggatgcggaaaacggacttacaaccggtcttcgacaagatatcaaggagggttgcaagctggaggggcaagaacatgggagctgccgggagtaccacactcgtcaaatctgtgctctcagcgcagccaatttacctcctgactgccttgaaggtgacaaaggagtctttggagcaactagacaagcagcgacgacgattcctctgggcaggcacgggtgatatcaccaggggaaaatgtaaagtcaattggataaagacgtgtttgccgaccagccaggggggcttgggagtcctaaatctggacaagttcacaagggccttgagattgcgatggctttggcatgaatggaaggatcctacca

SEQ ID NO: 39940 - DNA, 6999 bp, Oryza sativa
aggaaaagagggtgacgcctaggtgaatgatctgaccttcaatgcggcctcgcctatcacaatcagccttgtcgagcaactggttcgcttgtgggaagcggttcggaatgtgcacctaaacagtgaagagccggaccagattgcttggaaattcacagctaatgggcactacacagcctcctcggcctatcatgcgcagtgcttaggggcgccaaactcaaatctaaactccctgatttggaaagtctgggcaccggggaaatgcaaattccattcttgccttatcatccaaaatagagtttggacatctgaccgccttgcgacaagaggctggcaaaataatggacattgccctctctgtcgttctgaacttgagacaggaatacaccttgtcggcaggtgcagatacacgaagagaatctggagcctagttgcttcttggacgggttatcagcaattggagcccactgagtgggaggaagcacggtcagtccaacattggtgggggagtttagcaaatacacccggcgtcccaaaaaagggccttcgatccctcattctgctagtcgtttgggaaatctggaaggagaggaacagatagatcttcgaccacaaagagatggcaaaaggcttcctcctatcaagaatcaaggatgaggctagtctttgggctctagcgggagctaaaagattgtgcgatctagtcccacattttgtatagtgtatagctcatagttctctttctttacccttaggggttgtattttctcctgctctattcaatgaaaaggcacacctgtgctgttttctgttaaaaaaaacaaatataataatgcaaagacccatggtatattaatataacttgctcaaaatgcaataaacaacacataaaattcttctagtgtcgtcgatctaactaacgagcttaagaagcatggtatatcagtatatatagttctttgtgcaaatgatccatgaattttaaagactaaacaagagcaaattggtttaagagtataaatatcaaaggtcaaaatcactatacaacatgctttagtggactttggctttggaggagagggaagcaaacagagaaagacagacacaaccttacctcacgtcatagaattttatgtctcatgcgaactacccgatgatctactgcaccctcataagtaatgccttgggtcctccctgtttgcctctttggaggatccatagatatagaaaacatttactcagtggataaaggcaaattgtgagtttcatagtagaagacttacttctataagctgaccgtggatggtaagacagagttagtgcacccaaaggtacatatctgatagcagctgaaatgtagcaccataaccatcctgaggtgtcctgctcagaggatatctgacatgttcatcctggttccgatggatttcaggtggtaacaaatactccaaacaatagaatatatgcctaatacagagaccattcaaagataatatactattggatgcagccgtcagtggcaattgtttttttaggggaaaacggcaggagctctgcctattcattaagaggaggaaaaagagtttgatacagattctgggcacctccaagagatgtcacaacaaaacatgaaaagcaagacagaaaaatacagaatttttaggaagtgcatcgccaccagcatcagacgtcttcgtgttatcatctatccattttgagcatcaacaaaagccttgcacatatttatcacggaagcaattgtattttggagcaaagttacctttggagttgcgcggttaacaactattattgtgccatcaagttcatgtgaatctttcatgttattgtctacagattctgtaataacatcacagtgcattagaataaggtaattacaaaatgcatatcaagcttattgatcaaactggggaaaagcaatcatgcattaaaaatacagacatgaagtaaaaagattgaggacacaatgccatttttatataaataaagattcatttatgttaagattgttcttcgccgacaacaaagtaaaattaaagcctaaagaatgatgcaggatttctgcaaatgtacatccactctgaaaagcgatgaacacaatatcacgggtccagatcccctagagttagactacaactctaccaggtggagttgtcatgatccatgacattccgtatacttcaagggttgggattaagccgccttaatttttactacataaaaatcagtaactaaacattcaataaatagacttgcatcaacattgtcaccagataatttctgtagaattatagaattaatacataaatttcatgcttcatctattgtataaaaatcatacattggtatcgttcacttttgcatgtatgggaaagcactatattggcatacaatgccgcataggattgatcgactgtatgtgttgcttaaaaacaaaaagttgttgtgttaatttgtttagaacttaatcaaatcactattacaaaggaaaaccttaaaaataaaattctccgaacacttaaccattaatttaaggataatttattaagtgaaattgacgaggcatgatctcaaccgtatagaaataacggatggcatagatttagccaactccactcgatacatttgtacccaactctaggggatccagaccccaatatcacgatgacccctttgaatcatgttctacacattgtagttccatttactgctgattgcgacaaataagcagaatcctatattttaaatacttcttctgtgctaacttagattcaatatgcaccttccatatcaagtctcttataagatgcatatgcctaagttagaaaaggccaaaggagtccagagaatcctagctagcgttaggattagtttagacaactgtccttatcagaaccaaatgtaattaactacacaagaagagtgtctatacttgtattggtacttaattttgatatcacagagaatacataaatactgttttcagctaatcaaacatcatgtacctgtcaataaaataattccaaatttggtcacctttggcatgtaaagatgagtgatttctcctaagacttcaaaatacctgtgaataaattactctagccgttggttttggagaagccgtcgtctacgtacgtctgctcctgctcgtatgccgccaccgacgtggggggcgaggcgagcgccagcggcggtgccgacttgggtgacctgggaggggagttgtgactgctgcggattcacggaggattgcaaggccccatatatcgctggcatgcgggcgccgtacgagaggatcgaggtgggtctgcgggctctgcacggacgccatcgacgacgagcttggctgcacctcttcgcccatttcgccggcggaggcgctcgaccgcgcgccgcgccttcatctgcggcgtcggatgagtctccaccgcgccactgttggcggccaagagcgcggacgggattgatattcgtcgtctttcttctcttgctccgccgtaggctcgctggccccgttaccgggaggcgtcgagaagggatcgattggaaggggaagatatgaggcatgaggtcaaccctttgggatccataccgccaaccatcgctctacgtcgcgccttccccatcacctcgtcaatcggtgacccccgtccccttcgcgctctccccgtcgcccattcagatcccactcgcgcgcttcgccatcgatcgctgaatcctccccggcccgacgacaggaagcatcgccgcgtctagcccgaagaccggccgtcgaccactcaacagccggcccgtgtctgcatgcagccgtgcaccgagcccacgcagttcccaattgccaccaccacatctcaggccacttggacaacaacatcgagcgccacctcctcggttcacggtaaaatccattttccccatcctcctttctattcctcctatctaatgatattttgaggtttttttttctcctcatctccattatgggtacatctctgtgaagctataaaatacagagagattagcaacactaatatgcatgcctttgtcttttgtaaactgtcaggattaataaatagtatatgtcttagtatagttctgaatttatacctgagactgtcaaaaacagggcacggctatgccctatgtggttaacttatatggatcagtccatgtatgtgcccaattgtataacatatagcttgttatatttgtcagttgataaatatatgaatatatgtatcatatataccatttaatgtcatttttcacttaaatccattgttaactatcaacaccagtattttcttttaatcctctacatgcctatgattttccatctaattccttctccatatgtaacaacagtcattatatagaatatactcatgaatgatttgttgcactctgttgatgtaggaaactgtaataatgatacctggaatcatggttattgacaatataaatctcacttaacttaaatttgaagtcccataaaatacacattaagatttagacaaaatttgcattgtaccgaatgagtctattaaaaatcgcaacataccagaaatgtctacttgaatgttgtgcagaatatgtggttcagattgaaaaatggatgtttctttggtaggccatacagcatccatgatgagcaattgggtggtacctgggtaattcaaatgtcagttctatcctaactttttttcgcacaaagataaattgctatacaagcttgttgacaatcaatattgctacatctcaccattagggcagatattcataatttctgcagcgcagaactggtgacaatttggttattagttatctttatctcgcatttcagttttccatagaattacaaaactggtgatttctcattggtgctttaaaagttgcggcactggtttatcacagagaaggtgtgattgttgctctcaagaggagtaagttcgctgggttgatggttcttttttttgttgttttgagtttccctagtctttatacgagtgtacattccagttttcaatgctgaggtgggctatccctagagtttggtttattagaatatccgtgagctgtctcggtttactctcttgttttgaagcggagattgaaacctttcgttatcaaaactgagatatgtgttgtctatagaacatcagggctatatagtacaagttttctaactatggatgcactaaaatgttggatcaactgattatttttgtttctgttcatccataagtcccatagaaactgacattgtttcactttatattttcaaatgtgctttgtaaaagttttgacccatgtgcagcaaaattcagggacattacctccgcaacgctagacaagcccctgtggttgctcatgaagatggtctcctcgttcggtgtttcccgtcactccatcccccgtctctcctaggctccaacgtgcggtgaagcaccctgtgcccctgtcctacctcacgacatagaaacaacgggtgctccaccccaccgctcatcccttcctccatgaatggcagcggattacaaggatacagtacagaggatggagttgccatggacagcgaccaacacgggagagatggtagtgacaatggctggtggtaagtaattgttgtttcaatttgggattttaatttgttattcaggctttgcaaatctattcacgtcttgacagcccttgcgcaccagcgcacgcctgtgcagttgctgctgtttgtctgccaaaacgagttgaatgctcctgttgcgctaggtagagaacgatcggatacagggcatccagagcagtggacagtggaggtaaacacaatatcttggtcagggccggctctacaattttgagggccctagggcaaacttgacaacatgatccttaacgctctctcccctatagagagacgtgttatatgtatattcatattttttgggttgttcagattaatgtcattttaaaccatatcaatttttgataaagttgttaaagatgtgcatccatttagtttttttaccaaactttagtaaatacataagaaatcctgctaaaactaggcaatatcactaaattgtaaaaattttggtattgccaaaatttggtaagatttattttggctacgatatgaacagccccttcattttcaaagtgtgttttcaaatctaatcatagagagaaatgaacattgataatatttcatatatatgtttttagaaatagaaaaatatcaacacttaaactgatcttgtttatttttcccatttacttagcaccataaaaatgcttcttgagtaaaattacaacttatcagcacctaaaattataaaggaaatatatattatcaacaagaatctatctatacatacaattttgattttgattgttgaatatagaatctttattaatttactaatcagtattatgtagatactagtagataaccaggagtggtagatagtatgtaattattcactaatcttaaaataatactttggctatcatacaattttaggcatgggcccctagctaggacgggccctaggccgtcgccctcgttgccatgccccagagccgggcctgatcttggttcactaacgtactcttgttgcatgtatcaaatgttttcagtgtgcttttgaacttttagaagtaaaaattaaaggttcagaacaaatgaagttgggctattggcttaagaagtacaatctgaattctgaactttcaaacctatcctttgttcaattaatctgttttttagacaaaaacttctttctttagatatttttttgtgaaacataattctacacacagtatcttcaatcatcgcacaattgaaatgatatttattttctatgggcctaggtggttaatccattgtagttgatagtggtaaacacaacagtgatttctctgtctcacccaagaggtaatcacaggggtaatctgaacttagcggtcaccaggtaacctaagtaa

SEQ ID NO: 39941 - DNA, 19685 bp, Oryza sativa
  unsure (1)..(19685): unsure at all n locations
tttatttcccacacgacgcagccgcgctcactcagccaatctacgcattcgcttacagacatacgcatgcccagctgaccatctgccccttacggcttgtttggcaacttaagggaaggggattgggagtttacacgagggaattgatggtgagattaagatgggaatttgatttttcatcccagtctcttgtttggaagaggtggtggaaattgatatggagtttaattggagattaggtcattaatgaaaacggatggctgagatttgtttaggcgaagtaaaggaggaattccctgccaattaccaacccctacccaggtattgaaaaggagggagttcattcctcaattcctcatctctatcccactaaaattcccatgtctcccaaccaaacaaaagagttaatagcctcatccctctaaactcccaatccctcctaaaaactctccccaaccaaacgggccattaggctcttagctgccgcagctggccaatggccatgcctcacctgagccaaatggtctaatgggtttttcttttttttcttttattctctgttttcacctactcactttgatatatcttagtataaataaattggatgagatattatacaatatgtatggtagtatggtaaatcccataactttatcaagccatgcatttttcatgtgacgtttgtgttgtgtatttttttttttccactaaaccacttttagttactccctccgtctcaaaatataagcatttttagcatagtgccaagtcaaccatttttaactttgactattgaaaggaaaaaataaaaaaaagatcaataatgtaaaattgatgttactagatttatcactaatcaaactattataatatgcaactctttttatttaaaacattttatttttatagatattattggtcaaagtagcatctcgaagactgtgtcgagatccaaaaatgcttatattttgggatggagggagtattgtttaattttcttatatagtcatattgtatatataggtgatggactcaataaatatatttgggtcagatcttcatgggccaagcctaaaggtttttcaacacttttgtccggttgagtgatacttatcggcctcaataaatatattgtttcctagtgaagctactttctagaatttctctatagtggaggtgaattttcatcccacgaggggacatccccctcgttgtttgcatgtcatcttggcattcgccgccgccgccgctttcttttgccgacggagtggccatggacaggaggaaacagggtggcgtacatgatgcccatttgcgccatgatctgatcgcctcctggttttcaagcagcagacgactggatttatctcgaaaatgctttacaacggacgttcgatacgacgcaaaaaaatcggacataccaccgagtggaggcgtcaaccactcattcttctctctttctatcccctcaataccgtagcactgtatctcactcgtgtcttcccccttcttcgccggacgcacgcctcccctcctcctcctcctcctccacatccggccatcgccgcctcccatcatcctcctcctctagccgccgcacctcccccctccccctctccttcggccgacgccgccttccctcctcctcctcctccggacgccgcgccacccctcctcctactccggctgccactcctcttttcccattggcggcggcgctcccttcggctgggcgtggccggcgagcttccgtcctcttcgctggatggggtggcacgtgtagggcgacgagcttggggggcgtatctcgcggcgttggctctccccccaccggcgtcccctccctgcaaatcgaggcgcagggcgacgtgatcccctgcggcggcgcaaatcggctgcagccggcgcggggcctatctcgctctccagatccggccagacgcagagcggtggtggtggcagcgggggtgttcgctcgccgaagccatgccgcgcgaggacggcggccggagttgagggtggtggccggagttgaagacacgaaggtgggtttagttttgtgattcactttgttgtatttaaggtgttttattttgttttgattcgatattgcatatattgattttacatgttgcaatcgatatgttttgattgaatttggttgaaacactttcgtctatgcgatgaaacatttttctctggttgatgaaacatgtgaacatttttcaatgaaacattttgcaacaaccgtatgatgtttcagctttttatattttttgttgcactttattgtattaaggtgtttcattccattttgactttgatgtttgcatgaatttgatttcttggtgttacaatgcgccagtccatattgttgaatattgcatttagttgaaacaatcttcctcaaacgctgaaacatttttctctgggagtgaaacatctgaaacattttcattgaaacatttttttctgagggatgaaacatgtgaaacattcctcgataacatggtgcaacatcgtccggcgatttgcaccagatcggacatccgatccatagcagcctccggtttatctgctatctatctgcacatgtacaataaatagaagagaagagcttcaatcgcaatcggaatcggaatcgagtccgagccttacggcgtaccggagtgaggaagagaaaggggaagtggcggcttctatctctactgcggtcttaattgattgatgcatgggcctctgttccagcccatacacccgacctgctgagatacaaaggaataagctcatttgaagtacctggatgtggattttcttccctcgatgggacgtcccctcgttgtttgcatgtcatctaaatagttattaaaaaatttgaaaaaaattgatatatttcaaattaatctatgttaccaaattgtttttcatattttttttatgtctatttaggtgacatgcacgaaatgagaggatatcccatatattccctcgagtgatgatttcactttccggaagtaccttaacttctacagtgagaggaggaaaaagaacaaaatcgaacaaagctgcaaagtttgacagattaattaaagaatcatcattactgcgatgcgaccattagcgttgagtattacatctctctagccagcgtcgccgatcatcaccggcggtagcactggacgtgcaggaagaatcctccgggaggatggcccttgctggccatcacctcgtgtgctacaagtgctacagtaatctacatttactaatgacggattgattataatcttttgtgtatgtttttctattataaactcttctattataaaattttaatgtgtttctgtaaaaaaaaatccgtatttttttccatcgtcgtgtcggtttatttcccacacgacgcaaccgcgctcactcagccaatctacgcattcgcttacagatacacgcgcgcccagctgaccatctgccccttaggctcttggctgccgcagctggacaatggccatgcctcacctgagccaaatggtctaatgggtttttcttttttttattattctctgttttcacctactcactttgatatatcttggtataaataaactggatgagatattatacaatatgtatggtaaatcccataactttatcaagccatgcatttttcatgtgacgtttgtggtgtgtattttttttccactgaaccacttttagctactccctccgtctcaaaatataagcatttttagcatagtgccaagtcaaccatttttaattttgactattgaaaggaaaaaaataaaaaaatatcaataatgtaaaattgatgttactagatttataattaatcaaactatataatatgcaactctttttatttataacattttatttttatagatattattggtcaaaataacatctcaaagaccgtgtcgagatccaaaaaatgcttatattttgggatagatgggatggaaggagtattgtttaattttctttcactgattcacctattgcatatgtaatacttctttttaagaaaatagctggcacatatttttcttaattatttttcttttttgttttccttaatttttggtgcatcttacgtttgtcgtcggcacatcccctcttatcatcgtaatattttctctcttttctcgctctgtccataagtcttgtatcagttttcttccagagttcttgtggacaacacatgaaaagagatgtcctgtacataaaaattacaactatgcctataaaagcccaagcattatgggcaagaatatgtagtacattttgattttctatactcactgtgatgatgcaaaaattgatttccctttggacttaattttggaattcaggagagagtgccatgtccccgcaaaaaaaaaaagaaaggagagagtgccatggaaatggtgtccagtgttgctcaatgctgatagtgttctttcaacggcaaaatgtattgtgtctttttgccagaggtcgacgaaaaccatgaggccaggagattggtgagtgaggttgatgacgttggttgtgcgatggtcgaagtaggagagacctagcaatggtggcactgttgccccaaggttgaagtgggtggtggtccattgctaggtgtgggagttgtagaggtggagctcgtattcccctggtggcctaaacctgttgacagaaagcgcggtgacgatgtagcgttgtttgttgctgatgaggggttcgttaatgtcctgaggttcagggatgtagtgcaggatggagacctcgtggttagtgaaggtgatcatagggccgggatgggtgatgcgcgtgagagacggcgggatatcatcagcaatggaggccgcctatttattgtatgtgtagcagatagatagcagataaatccagtaggctgctagctacttgaaagccaggaggcgatcagatcatggcgcaaatgggcatcatgtacacctccctgtatcctcctgtccacggccgctccctcggcaagagaaagcggcggcggcggcggatgccaagatgggtactcctcgacaagctcgcctacttctctgacgccgacgtccgcaacgccaccaccgacctccaaaacaagggagggccatgaaatccaggtcaccttgtgcaccgccgcttgcccgccgctcgtctcctacgtgtgcgtccactctcccaccctcaaccctaaaaccaattacttcgccatggagccccagatcatcgccgcacacgatgacctcctcctcatccgcctcatcctcggcataggtaacaggttcaccgatccctcgccgactacttcgtcgaagtaacagagcttcaatcgcaatcggaatcggaatcgagtcggacggcgtccgaaaggggaagtggcgggcttctctctaccgcggccttaattgatgcatgggcctctattccagcccatacatccggcctgctaagatacaaaggaaataagttcatctcaagtcccttaacaaagttgcaaagtttgatactagattaattaaagaatcatcattactgcgatgcgaatgcgaccatcacacaccattgacatctctctaaccagcgccgccgatcatcaccggcggtagcattggacgtgcaggaagaatcctccgggaggatggcccttgctggccatcacctcgtccatccacaccctcccgccgtctccgtctccgtctccgtcgcgcgccttcaccatgaactgcgccccgccgccgccgccgccggcgaaccaccagtcgtgcacgtcccacatcacctccaccaccgcgccgtccccgagcaccgccgtcctgttcccccggaagttccacttcacccgccgcgcctccaccaccttcttcccgtcgatgctcaccgccacctccccgtcccgagtcccccactcctccccgcggcacaccaccgccacctcgtgctccgccccgtcagcccggaacctgcacctctttctttgctccacctcctcctcctccatctcctcctgttaatccttctcctctcgtatctgctccctcctgcttatcaactctctcctcggctcatcttctaatcttcgttctatctccctctcctcctcgccccctcccattatgacctctatctccccgtcggcgacgacggcgaggtagtagtcgcgcgtcggctccggggacgacgacccggcggcggggtgcttggcgtccgtggtgtcccagtagatggccaccaccgtgccggcctcggtgacgaacgaccgggtcccgcgcttcttgtgcaggaactgcggcgagctcgccagcgcgacggccgaccggcgaggcgtcgctgctgaagctgaaccagcagcgggcgagggggacgaccgggaggcctcgtcgacggcgacggcgaggccagtagcaccgccgggcgcggcaccggcgacggtcctggtccacatgaccctgacgaggatctccttgcgcgaagacaaggcggccttgtagacggtcgccgtggccgcctgcagcgagcggtcgagcgcggcgcccgccccggccgcggcagctgaggccgcgaggctgacggcgccgtcgccgaagcaggagaagtctcgcattgctgccagctcgacggcgacagcgagctcaattcggagagatcgatggatggatggtcacaatgggaagggagtctgcagcagcatgtgcagcgcaagaatgttgatcctagtacttgctactagtaaagaagaagaagaagagaagaaaagagggcaaatttaatggcaaaggctcatcttttgggcggatttgtgtgacttggtgattttggatgtttctgccatgattatgcccatgcatcagcatcaccgtgtttcttctctttatttttacctttctttttcaggtgaagttgcaattgcaaatgcaaatgcaattgaagtcgatcggggtagaagagcagatacaaggtatggttggttgggggagaaggcatttaaggtgagcatgtgtgtgcaatttgaccagataaccactactaccatccgacccgctgttgctagtcatctgcgtcgtggcagccaggaacctctttttcttccttgcaaaaaaaaaaacaaaaaacaaaaggatggctttccacttgattaatcaagataattgtttgcatcaaaacgtttattaagttttgcaataaacagaagaacaagtacaacaagggaaactcgactgtcatgtcatgatgattatcttaggatcaaatggccacgatcgatcgtgtgaatggaccacgcaatgcaaggaatggaacagattgaactggagcaagtactcctgctatctgaaaactgaaggggcatccatccatccatcatgggcatcacgaagtgagccaggtgtcgatgggtacagttgcaggtcacaggtgtaggcaggctgatggatgctgcattcggacacgcatgtcgcattggcaaaggagagcccccggaccnccctttgggttttttcccccttttaaaaattttttttaaaactgcattttatatggatgttacatcatactcttatcatggttgagtatatgcttgcttgcctgatcaattcttatcatggatgtttcatcatacattttatccatgtatgtaagatcacactactctttgtaaatggatgtagtagtagtagtatttggttgaccgggtctgaccgggatgaaaatggaaattgaccgaagagagaagtaattactggtcgagggaggagagagtcaagcacgaagcagacgtcgatatggtcattagtgatcgtcgacgacgatgatcctttagtccactgcagttttaattgttttggcctaacacaaataaatggtgataggagagtccaggtctgacgtgttcatgcacgcgatacaatgccggtggtattgcagccccgtagactacttcacacttggacatactcgtgcctactcctacacaaacatggtcgtcattgcagtgccgcggttatctcctcgtcgtcgtcctccattaatatttaatcatagtaatcagtgacgtgaataaagtataagtgatgtgatcaatagtccagagaaatatacagtatttgtcaagaaaaaagaggaccaagagtaaagtattaagctaaattaagcataactaagtatgtaatgtgttgtttttacgaatttttgggtggggaacccctatgtctactagtgatagtaactaacttttaaatttaaagaagtgcttgtttaaatttgtagtttaaaattattatatttcgtgactggtggtggagtataaagcagcatatgcatgcgttctgatgcaaagttgagtcctcccttgaaagactgaatgaagccaatggcatttacttggactgaagaagcatcagagcacccgcaatggtaaagtaaggtgctctctataaaacatgtacatctcagcaatagactcgattaatagtaaaccaccttaatagtatgtctacattggtatctatagctctctcatacattgcctcgtttttctctatagactatctctaaattagtagatagctttgctctctctcttcatttaatacctttcaagtagaaaaatatactgacatagatctcttgtagagagcctatagataaccattgtgggtgccctcagagatttcagtactaactctacagtagtacagtggagtcaatgaatggtcatctccgttcccttggaagtgatcaatcaattcaattattcgatgcagatatataaatgtttacatagagtcatagacgtagagacacgggatggactatgacactgttacgctgtaatgctaaacaatctctatctttgacactgatgaccattattgaacaattattatggatcgagtactagcttaattacctgacagttaattagctaggggaagaggagtatacactacagttagaatggaatggaagttaattaggagtagtagcttgatcatttgggcaacataattaacttgatggcaacggttggctcgattcgtaatactcaagttgcgacggccggaaacgtggaatagtggaaagagatggtagcaaagcagccatggcggcggtggcggtagcgcgcatctgatcttatcaagatgcaaacaaagagcagtgcccgcgaaacagcttgcatatatctctcccaaaaacatcagatatatcagaatcagcagctgccgctgcatgccggcttccaaaacacctgctacaattcttcatacctcttcttcatctctccaccaaaacccttttttaccctacacagttccgaagtgcctcagtcagaaaatgaaaggaattagtttttttttctatggaccaaaggaactagcttcttttaagcatagttacgttcttatttttttctagttgattgtccatgcttttcacttgtactagtactccaatactacttactccgttttatattataagactttttaatattgtttatattcatatatatgttaatgaatttagacatctataaagtcttataattttaaacggagggagtactgtacattcatgaaggttcttgtgttaattactggctggcttgcatctgcacgctcgtatgataagatcgagtaacctgatcgatctttgacagcatacaagaacgtttagttatgtgatgtcggtgtccgtgtggtgccagatgtgaatcggtgaacagattagggagaggaattacaaaactacagtgattcttccaaaaataaaaattaggaaaaaaaatctactagtactactggactgcaataccattaattaggtgtctatctccttcgtctaactagtccatgagtttgttctagctcctccgcacggcaacaagccagtagcagctcagctggcctctagcagccccatcgcttggctgataacggaaaattgcgaaatgagatatttacaaataaaaaataatccatgaatgaactattatatactgttcgtaatgatctaaaagaaaaaaactaaaaaataagctacgatgaactaaaatcaactctaaatatatatttcttttaaaaaaaaaataaattttggctaataagtataagtataaatgaaaagataagcatatggaaatttggctgattggagtgagccccatcgattagcctaataagctaaagcaaaagccaaaatttaaattttcgaatttaattttaagatattcaatgtaatttctttttagcgaataaacatataaaaattttgtctataaattaatttttatttcctaataaaccgtgttgacttattgtgaatacgtataaccgatgagtgtcagtactactatctttgagcggctgtatatgtgatcgattgttcattcgattgactctaaagcagggagagtggtaagtggtaacacgagtatgtgtatgcatgcgtccagattgttctagaacacttttataaaaatccatatttcagaggacaggactgcactggttagtacctgctcttccgattccaaaaccaaaagctggaactgaaacctctggatccatccatccatcggacgacgtcgcctcctcatccatcacaagtccggacggccagcagcgcgccacgtgtaaggccacgccagagaccagccaataggcaggctccaccgagtcagccgtcgttcccttaaatgtgcagtcaccgacgggtgggacccgctcgctcgtgctggcccacatatcagtgtatgcacatagagtgggtgggaatctccatccgtttgggaacacacaacacaacaactaccacccccactccgctccttccttccttcccgcatttggatttacccccaaatcttctccaagtccaatcgacctcatttcattcgattcatcgatcgctcggcgcggcttagggtttttggcggcagcgatggcgtcggagaagcacttcaagtacgtcatcctcggcggcggcgtcgcagcggtctgtgccctctctcttttttcgcttgcgcctcccaaatttgcaaatcaccttccttccgtccttctcgccctgccgccctgggaggggagtaggctgcgggagttcactgcaagatcgatgtgggattcattcgcttggatccttttatttgatcttggtctgttccggatctcgtcgaaagtacggtttttcctgttcctaatttctctctgaatattttgcagggatatgcggcacgggagttcgccaagcagggtgttaagccaggggagctcgccatcatctccaaggaggccgtatgctctctttctctctcacacacatacgcgcgcgcgcgggttgacacacaaaatgctctcttctgctctctctctttcaataggttgttcaggtgctccatatccataactgtagtacaccttcaatcgagttaagatgtctagtatgccagttttttgttatccacaaagcataacaatggcaaatgagttgtgcttatgcaatagttgcatacatcagtatgttagtggcaggcctcaactattatttgtttgctaattactgaatccacatgtttgtactaaatcttctgttgcctaggtacttttacttactggaaccatacctgttcttgttgtaagccacttgtttaagcatgtcgcaattaaccaaccttcaatctattgctggaattttgcctacaacaatgctttgctaaaaagaaaaactttgtattatggaagttgcttctgagggccaaaagaaacaattcttgtaaagccattttggcacagcaagaaatagtcctaatttgccctttgcaagttctgtcattctgtcaatttttacttgcttgttcaccaacacagcattgtgtttcttatcaaaagttctctttcaggtggctccttatgagcgccctgctctcagcaagggatacctctttcctcagagtaagtccttaacttaccgtgttctgccttttcgtgtctgacctgtgccagctctatgtcacatgtggattgatcaatttgtacgatcaaagtaacaccatttgcattctctgcgaatagatgctgcaagactcccaggatttcatgtgtgtgtcggcagtggaggagagaggcttttgcccgaatggtactcagagaaaggtattgactgccattttgctttctgcaccatatcatcttttaatgatttatttgtcattgttgaggttaattaccatcaatttgaaattcttatttttgctcaccttagtggaaatacgtcatgtaatgatttttttttattctaagcatactcctgaatcatgattgcatctgttggcaggcattgagttgatcctgagcactgaaattgtcaaagctgatcttgcctccaagactttgactagtgcagttggagcaacctttacatatgagattttgatcattgcaactggctcctcagtatgttgtgaactgtgaaatttgtttaatatcggctcattgctgtcattactatcacttgttatttacatgctctttttttatccgcttgtcaggtcatcaagctatcagattttggtactcaaggagctgattccaacaacattttatatctaagggaagtagatgatgctgacaagctggttgcagctatccaagcaaagaagggtggaaaggcagttattgtaggaggaggttacattggtctagaacttagtgctgcattgaagatcaatgattttgatgtcacgatggtgtttcctgaaccttggtgcagtaagtgtcaccactcatattttcgctaaccactgttcaactacctactacgcatcagatgaaaagaatcagttttgcccatacgattgacatgcagttatgatgtgaaacgaacttatagtggaaactttcgtgatgatgggaatctgacattgtaaaatatcttcttgtagtgcctcgtctcttcactgctgatatcgcggctttctatgagagttactacactaacaaaggagttaagatcgtgaagggtacagtagctgttggttttgatgctgatgctaatggtgatgtatgtacatcttccaaatccaaaatagctctgtagctctcagtgtgaatgcaaatgactgtctgctttccatcggttccctatttactaggtcacagcagttaacctgaagaatggcagtgtgcttgaagctgatattgttgttgttggtgttgggggcagaccgctgactactctctttaaaggtcaagttgctgaggagaaaggtggaattaaggttagtttgcttttaacctgtaggcttgaccacagaaggtgctagggatgtttctatcaaagaaacagtgtgtaaacaactggacgtttctttatcaaaaaacagcagctgtgcatttgctatttttcttttttgtgcaagcaactcgtttatagcatttggcccatcttgattgcattccttgaaacaattgagcatgtgcattattgtttataccttaatatctggcacgcccaaaattgtatgcagaccgatgctttctttgaaacaagtgttcctggagtctatgctgtcggtgatgtggccaccttccccatgaagatgtacaatgagttgaggagagtggaacatgttgaccatgctaggaagtctgcagagcaggctgtaaaggtgaggccattccacttgtgtttctctgaaatacagtagttgtgacgactaacaccacatagtggcctgcacttggatctgacttgatagtgatctgagttaagcaattattgaattgctcggaaaaccaccaaatgcttggtgttcatgagtatccctgattagcatggtagaatttgatcactgaaaaattctttgcactgtcattcaataatgatttgaatatattgcatgcaagaataacgttaaactggacgatgtaatgtattgtcacatggaatagaatgatctaatgcatagtcatctgataatgtattatgaaatattgaaattgcactaaagaatagtgcaaactttgtgttaatttctttgagttgtctttgcgagcagtgaaatgtcaaaaccttggagttaccaaaccacttggaatccaaaaacttcgcttgtgttgattctgattaccaacaggcaacagttgtggctacttaactcggaatagggttatcatatcttagcttgaaccctgcatctttgtttcaggcaatcaagggaaaagagtccggcgagtccgttgtggagtatgactatctgccatacttctactcccggtcattcgacctgggatggcaattctacggcgacaacgttggcgacaccatcctgttcggagacagtgacccgacctctgccaagcccaagttcgggtcctactggatcaaggacggcaaggtgttgggtgccttcctggagggtgggtcacctgatgagaacaaggccattgccaaggtcgcgaaaactcagccgcccgttgccaacatagaggagctcaagaaggaaggcctccagttcgccagcaaaatatgagatttttgtagttttgatgtacatttccacatggtactccccctattggttttctgattgtgatgcgtctgtactctgtactcctcttaaatatgggcacttgctatagctgctgagatttgaataaagaagttttctactacagcctttgcctttcacggttcaaagctactggtattgttttgtggaatggcggcggctgctgggctctcgcccaggcttgttgttacgccggggaggagaagccacagccatggacggcggcggatgtgctgcgccgcggcggcggcggcgcagggggagaggaagacgacggtgaggagcaaggagggagacgcggtggagttgtgccgggtggtgaacggcatgtggcaggtgagtggcccgtcgtggggccgctacgagacgcccgccgccgtggacgccatgctccggtacgccgacggcggcctctccaccttcgacatggctgacatttgtaagcctctcctcccgccgcattctggatacctcgcaggaaactgacacgtggggcccactcgtagtgacacgtactgtagctgcgtgaaatttaccccgtccgtgccgcgacgaatcgaggccagtagcgccttatctccctccctctctctctctctctctctctgtgtcatgtcgtcgtcgtcgtcggcagctcgcaccctcctctcgccggcggcgcctcctgtcccgcgccgcggcgtggtgcgtcccgcgaggtgctccgggggcggcggcgcggcggcggtggagacggccgcgtcgggggcgaaggtttgtacggtgagcaaccgcggggactccctggcgatatgccgggtgctcaacggcatgtggcagaccagcggcgggtggggccgcatcgaccgcgacgccgcggtggacgccatgctcgcctacgctgacgccggcctctccaccttcgacatggccgaccactgtatcaatctgcccctctttacctctaatcactctaaaccctatcgtcggcatttgtgcgaacacgtagcgtgcgtaacattgttgctggtactatgcatctactaggtgctatgcatctgttggtggcacttagttgttgctcaattgatgcccataagctgtacacctgtcccacggttatgagttgatgctattcgattgaaatcgggaaatggttttgtttcactttgaaaaaaagtttgcttcaaaaaaaaaaagttcatgtctctagctatgttcagttcagaaaaggttcatgtttcattgacgtatttagctgcacggcgtagcaagtgtaaatatatgagagttgacactaataagaataaatcaatctttctcctaatatttaatctaggagcactgagcatggtatcaacttgattttaaggcatggttactgttttggcagatggaccagcagaggatttgtatggccttttcatcaatagagttcggcgtgagcggccacctgagttgcttgaagaaatcaaggggtgagagcgatttaccatggtctttatgccactcggaggtgtgtatagctgtttttccgctgcttctaattgttattttattaatctccgcaggctaacaaagtgggtaccacctccggttaaaatgaccagaagttatgttgaggataatattaacagatctcgaaagagaatggatgtttctgccttggacatgctgcagttccattggtatgtttctgtggatttgtgtgctacttattagttatagtaacatttggatgccatttggtttattgctcagttttattacatttactgctaatcgcaaattaactacattcttagaatgttgaactgttttgttgctaaacaataaggaacctcctgtctcaagtgacttttatatcacagtttcttgtacgtttgcacaatcaagtttctggtgatctatcatccagaaaagattgtgtccttccattgaccattgctcttagcttcgtagttatgctgcagtagagaccagtttagagtactacagatttttagttttgagtgtactgtggaaagtcctaaacttgagaggtgttatgataaaaacctgcggtatgtgtaatcagtcgaggaaatgcagcaatgttttatactataactactgccataatttgtaattcagctgaccttttatcataatataggtgggattatgcaaaccctggatatctggatgcactaaaacacatcacagacctaaaggaggaaggtagtattttgaacttggatcagatttttagtctacttatgtgtttcctttcgcatgtcatggtttttcagtactgacggattctcgcttcatgccttgttttgttatgtacaatgtgaaggtaagataaagacagtagctctgacaaacttcgatacagacaggctgcagataattctagaaaatggtatcccaattgtcagcaaccaggtatattttcacctaacccttatggtatatttgccttttatttgtgttaactatcatatggtccactcaatgaagtgagggatgttgtaattgccaggttcaacattctattgttgacatgcgtccgcagcgaagaatggcagaactttgccagcttactggagtaaaacttataacgtctactcctaaccccatgtcccctctccctgttttggcataacacatagttttaatgcagtattactgatgcaggtatggcacagttatgggtggtctgctgtctgagaagtttcttgacaccaatgtatctataccttttgctggacctcctctgaataccccatctttgcagaagtataagcgggtgagcattttgtatatcctatgtttgaacgagttacctccttcccaattcttgctattctcattgttgaagctgtgacagatggtggatgcctggggtggctggagcctgttccaggctttgcttcagacgttgaagaaagtatcattgaagcatggtgtttctatatcaactgttgctgtgagatacatactgaaccaggtatacatccattcaatttatcttgagatttgtctttttcttatatatatataaaatagtatcagtgaagcatttgccataactaacatgtgacctttgtcattttggttgtttatgggaatagacatctgttgcgggttcaatggtgggtgtgagactgggactctctgaacacataaaagacaccaacgccatcttctcgcttgaattagatgaagaggacatgaacagcatcactgaagcatcgaataagggaagaaatcttatggatataataggcgattgtggagacgaatacagagcataattgtgcagagagataaagagagagagaggcagagggggtagaccaatgaggcgtgtgcctgccagttttctggagttctgaaatctgatctgttttgtcatgaacgtagtgtgcagcagctatctgatcttccagtatactactactccagatcagtgtgtaaaccaacctcccaaaagaaagtggcattttataagaactgtacatacacaagacagattataatttgatatgcccattaatacggattcgatttgcgcagttagccaattaaggagtgtcgcatatgctttggttggtcatgtccagggggaggcactgcactatttcatcagcaatcatccacggaaagtggtggtgacagaccgactggcagaatcgtgccctcaccgaaagccacaatataatgcggtttgcggccaggaacagaatcttcgttcccagcataccatatcccgatcatgtaggcaaggtaccctccttgccttgcctagctgctcccatccaccatgatttgtacttttccttcatccttaccgtttatataaataataaaaaaaacggcatatattaatcagataaccaccaaatttcatgccaaataggctcctctaagatgtcacgtaaaactgccatggactgatgggcgcatacaaaatccatatcctttttctcccatattataactcaatctcatccttattagtctttgctccataaacagtcatactgaaaaaaaagggcgcataatatgatcgttcccggtaagattatacaatgtttcacaatataacaccagactgccagcatatatagtcttccaaacgtaatatcttcttgctccaaagctttctgaatattgtattgtaatacatcttgtattcccacaacaaaatcaatattgcaatacattttgtattgggaagttatttatgttttgccttgcattatgataggatctttttttttaaaaaaaaacttatggatggtaactaatttgttcgtctgtatcactgtatggtacaaatgattaagaactaaacattgccaaccagagctttatgacctgaataacttcttgccccaaaaggcttttcaatgttgtaatacattttgtattggaagtaaattttgtttcatctggcatgcaatgaaatcactcaattttccctactaaattagtgatgatttattaggctacattggtaaaatcatagaaaattagtatctattatatagccgcataacaaatttacaatgtcacatcgtgatgccatcacaatggctttacagtcataataacttcttgcgccaaaaggcttctcaattgtaatacattttgtattggaaaagtgatttacattttgtgtgcactatgatggaatcgcttttttttactacttatggacaatattttattcggctaccttgagaaaataccgctgaaattagtaaacatttcataaccgcatcactgccgttagagagctttacgaccggaataacttcttgcccaaaagctttttcatattgttatgttttatcatcgggatataattatgttccaagtggcattacgatggttcttttctacctatagacaacttttttttttcatttgcattggcaaaatcctattaaagttagcaaataatactcactctgtttcatattagtataggatgttttgaatctttttctagttaaactttttaaagtataagtttgaccaactttacagaaaagcataagaacattttcaacgcaaattaaatgtaatatcaaaatacatatatttaatattaaagtttgccttatagaaaaaa

SEQ ID NO: 39942 - DNA, 2705 bp, Oryza sativa
  unsure (1)..(2705): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttcttttctttctttcaccatgccccctttgcctcgccttacctgctttatcaaattaatgagattactcaactgaaaattgttcatgtacagtgcgacagagcaggccgtcctgaggtgccggtagcagagggcagcgctgagcctctcaaggtaaggtatttacatgttgtactccatttcacttactactactccactctaattgctaattatttcttcattctatcatttcgcacatatgtatatgcatcagtggttaattaattgccatattatatcatcaacgcttttactgactgaatcattctagtcaagctcgaacctttcctgcacttttacatctcctgcagcttctatatttgtgcctgttttacatgcaaaagtgcacttctcttttttttcttttgacaaattaagttagttagtgctgtgcaaatcttcagagcatttgctgaaaaagctctggtataccacttcgcgaatattcacaatccatcgccttttcctcaagttgccttgtttattcagctatgcagtggatttctgtataaataaagccaacctttgtgtgttgcagggagggaaacctcacgttgctgattttgttcatggatcggatggacttggtaacacgtcctttcctgatcctaccaccaccaacaaagttgagcagtcagctgcagagtttctggttgataaggtatcagaatctccaggagagatctctgtactcgccttgggccctctcactaatatcgcattggtatgtaatatgtgctttctctaacgcctcttaattaatactctacttactaggaccaaaaccttatttctggcagtaacacttttgctttatttctttctcaggccatgaagaaagactcctcctttgcaagcaaggttaagaggatagttgtgctgggtggagctttctttgcagctgggaatgccaccccttcagctgaagcaaatgtaattttgttactactacacttgtctgcttctgcaaatcaacttcggttttgtctataatgttgctctgtttctgcattttttccccctcttgcattgcctaaagtttatccattagcttcaaatagtttcttatagccaacagcacaattacaaaaagatttccttgcaattaagatggttgcctttacatctgttcttatactcgagaatctgtactaaaagtctgaaaggacactatcgtttaattttactattaattaccaaactctgaatttcggtgagaagaaagccgtcataaaactgacgaaatatttacttcctctgttatccacagatccatagcgacccagaagcagctgacatagttttcacttctggggcagatatctacgtagttggccttaacataacaacccaagtctacttcacaggttcatgatcagcctatcatttcaactttgcaccttcagtgtgaactttgacagtagtgctggataaccaactcaccaggtgacatgcattaaacatgtacaaaaaattgcagacaaggatatgttggagctaaggaactcgaaagggaagcacgcacaattcctttgtgacatctgcaagttctacagagactggcatgtccactcctacggcgtcgatggtccgcacatgaaacatctctcctttccttcttacaagttcaggctttgggaaattaacgttccagctcacatttgtgtgatttcttcagctctttttctccatgatcctgtgagtttcaccgcgctagttcaccccgagtacttcacgttcaagaagggcgtggtgagggttgagacccagggcatctgcaaggggcatacttccatggacatgggactgaagaagtaagaagatgcagagattgttactgtctatttattcagagaggctggatatatatgcatttgcaattgatcatctgcttaactgttgcattggtgtatgcaggtggaattcagacaacccgtggactggttactctccgatctcggttgcttggactgttgatgttcctaaggttctggcatatgccaaggagctactcttcaacgcacaatgaaaatgtaaccggatcagtgtcatctctctctctctctctctctgaactctgatgtgattgtgtcagaattggcatgcaaatatatctttttttttgggcacaagcagagatatcttggcattgttgtgtactgcagaaattgtatcatatcatttattctgatgaattgcaaattattgataaatgttcagcagcatctgctagtagtacttgctggtgacatgatgatatccttgctgaatcaccatgctgattaattgtgttcctcgtgggtcgagctgtgcctgtcttggtagataaataacttcggtggtgccaaaactttggtattgccgttacttatttcagtcttgtcgattaagtacagtaagcacttccatctcatta

SEQ ID NO: 39943 - DNA, 2580 bp, Oryza sativa
ccaagtgacagatgccacaagattacacgccacgacttttgctgaaaaaatctggcgtgtaataaaccaagaaccgtatctccatcgaacaaaaaacggccataatgagactgctacgctaaaaatattagctacaataagataaaataaaataaattaaatagatgcagagaaaaaaaataaaagggagaccggttaataatattgtaagcatgcatattaatcgccataaaagcaataactagtacacgagactagacatgacttaatttgaaaacaatcaaatagagcagaagagaaatgaatgcatatcatatcttcctatatagttgatacccactaagaagcatttactcataaaaatcaagatatgcaaaaagccacattatcaacaattttaagccattggatcgcatttgtatagagttatcagccgttggatcaagaagctagctattcatctatctaatttaatcattgctcatccattcacctccctttagttcataatcacgtgtgatattgttatccattctacacatctaaatcctcaaagataatactaatctttatttttctaaatacaactccaattattacataagatgtgagttttgttttgttataaacaattagataacgtataataattaggtgtcattaattcaaacttatttttgaaacatgcttgagatgaagcagagaaatgctacactatctaattgtgacaatatctagattgtacatgaaaaaactttcatatatcataacaatacacaacgacgtataaaaaaacatgaattgtattgtaataatagaaattatatataaagccacattatcatctattttttatataaaaaagtgcatctaatcattcaaaacattgattttaccaattgacagaaccacccgatttcttataatgatgacagcattgacagctggtgaaattggaggaggtgatgccaacacttcagccttggacaccgtccttgcaaatccagccgcctgaatatatatacacaacactacgagttaattaattagcaatgtgtgagttaattagcaagcgtgggacgaacaatttataattaaggactagctagatctctccgattgatagggaagggaatgagaagacgtactgttgaatcgcgattggctccgacggccatcatcaggaccagcaaaaggaacatgagaacacggcctcttgtgctccttggacccatacctgtgcaaacgaaacggcaagcaaagaaacaatcaaatacggtacgataatttcaagagaaaaacacacattatatatttaaataaatgcgcaaatttcttgattgctgtatctagctagctctttccgaatctatactaagattgaaatgatgaggaccagtatttataaggacgtatatataaagaatcaaaatttgcatatttgcaaggaaaggaggaccggccgattagtttatacagtatatgttcatcttaggatgatacactaattaattaccgatcgagatcctagctagggcgcctaggagtgagaatgtgagataaaaatatgcgctcagatcgagtgatagatactccagatcgtttgcattgctctcccaatatactgtcccattcgacagggtcgacgacgaaattaaattaattaaaagacaccttttttttcacaagagaaatatattgaaggcccaatgaaccccaacgcatgcacacgtcaaagccaactcgctggctcgcatactgttggtctggatcgatgagatgcagctacctagccgatggaatctcgccgcgcgcgccatttccctagccatggacacaggcaacatcgatctatcagctccttttgatgatgaatatggtggcctctcacaccatccaaaaactatatagaggagctggcattcgtatgtgcaccaaaaccccggttggcatcggaccgaaaatttgtactaaccacaagcccacaagacaagaaaaaagatgctctttttattgaaacattttaaaaactagttattttggaaccatggctgtccaatcgatctcaatggaaaaacatatataagcatgcagcatgagcgagatgtagaaaaagcgacatctctttatccaaattattttctttaagaaaagaagctagcacacaatagatcgagaaacagattgtaaagaagagggaggcggatagaacatgaaaaacattgcaagatgtgagatgcaagaacatgatgcgtatacagaacaagaagcactggggagtagggagtgtaccgctccgctcaccacgctaccagtgtgcgcgccgccgagagaggtctcgatcagaggaagaagagcagtgtggccgcgccgccagagagagtagagcgaggtctcatagaagaagaagagggagaagaagaagagcgagacaagaggagaggaggccaaaaagaaagaatcgcgctgcctctgtcgtctctgcctctgcctctatactgagaagtgagcagctctgtgctagctttttcttttttgctctacagagagagagagaggttttgaatcctatctatggta

SEQ ID NO: 39944 - DNA, 1072 bp, Oryza sativa
cgaaagatagctttcaaattaagttccgaattatatataaatatgtagcatcacacactgatcgatttagctagacatcatttatttgctggagatgctatctacaagtagctcaagaatgaagcatgggcgcctgataacaacactagctagaagcagcaaggttagtaggagcaaagatggggaattaagccgctttattatgagtggaacgcatgagcaaatgcatatggcgagcatgcattcctgaaaggcaagattctgcgaccaaagtgtacattctgaattttgtttaggtggatgaaacacatagtatatttcatgggaaggagggaaactggaaaacggtgtgctgctgctaggcctgactctttgggcttggacgcttcttctctctcgcttctgcaaccagagcatataccccaatctgccacgcgtgccggccgttactaatccctcatcactaattgtatgcatgatctactgatgcattgcatctctgttctgttcttgaccagaccgtactctcgttttggagaatgagaggtcaggaattgaagcagctagctagagaaagaggctgcaggggagagtccaaattaaaccaaccaccacgttgttatgtgttgcttgcttggtgctagagtgctagtaatgcactagtccaaattaaattcttcatgtattttaggatgtagtatatgatattattaagtttattgatggtgattttctggatggttgaatgcatctgcaaactgaaagagtggccggtgtgaatgcagtgcttaattggaatccgacagtgggtaatggaggagatgggccagtagggttggtgactgttagacgctagcacatccaggcgattaatacgactactgtcatacgtactgtacatgtcatgctacattatatcgatctgtacattctcttggtcatgcatattacagcgccatatcctatatatcgtacctacgaccaaaattaaactaaacgctctctgaaaaaccaatcaacaaaatacatacaacctcatgttcatgtaggggtataaactataattaatgtt

SEQ ID NO: 39945 - DNA, 6201 bp, Oryza sativa
cgcccgggttcgttgggccagtggctgctaaccgaatttaattccatcctccgctgctgctgcgccagcccggtcagcctcccaagaccaaagtgaacatatggccctgtctagttccttaaaaaacttttcgcaaaaacatcatatcaaatctttggacataggtatagaatattaaatatagataaaaagaaaaactaagaacccattcccagcaagacggggaaatgggggcagcgatcgattttgttttctttgcgctttgggtgcagagtgacagtgacattgacatcccgagctggcggctgggctgcctatatttacacctccacaccaacgcaaatcgatcgcgccaccaccccctctcctctcacactatcaattgctcttgtcatctctgatctgcctgccgctgcgccagctgcctcctccgatctctctctcactctcacacacacgtactagctagcaagtgcacacagacaatgtgactctgtgagagatctatcgggcatggaggaggagagcagcacgctcatacggcgccggactagtttgccggcgaccacggtgatgatggtggtcctcctcctcctcctctgctgtaactgtaagctgcatgctctgccctccatatctgctcccccacttttactagtattaaattctagctatctactactcaaattcatttactgctgaaacctcaactcccataatgtgacgtataggtggtgtcgaggtggtggtggctacggctgatgagtcgtctccggcgccggtcggcaaaggaggaagtgatcatggcagttgccccggcggcgacggcgacggcgaagggtacaggaagcagctgtgggtgtttggcgactcgtacgcggacacgggaaacctgggtaaccttgggagggagctgacccacgcctggtactacccctacggcatcaccttcccgcgacaccccaccggccgcttctccgacggccgcgtcctcaccgacttcgttggtacgcccacgcctccgccatctctctctatatatcttcatgctatgctaattaattactcctactgtcatacgtactgtacatgtcatgctacattatatcgatctgtacattctcttggtcatgcatattacagcgccatatcccatatatcgtacctacgaccaaaattaaactaaacgctctctgaaaaaccaatcaacaaaatacatacaacctcatgttcatgtaggggtataaactataattaatgttcatacaaggagtatcactatcgatcaagctgctgctatgctaggtggaggatggcaatattgcattgatgtcgcccgggttcgttgggccagtggctgctaaccgaatttaattccatcctccgctgctgctgcgccagcccggccagcctcccaagaccaaagtgaacatatggccctgtctagttccttaaaaaacttttcgcaaaaacattatatcaaatctctgtacataggtatagaatattaaatatagataaaaagaaaaactaattgcacagtttatatgtaaatcacgaaatgaatcttttaaacctaattaatccatgattagtcataagtgctacaacaacccacatgtgctaataacggcttaattaggctcaaaagattcttctcgcggtttccatacgagttatgaaattagtttttttcattcgtgtccgaaaaccctttccgacatatgatcaaacatccgatgtgacatctaaaattttcatttcatcaactaaacaggcccatatatgtactggagtacgtgccttttatacagacagactactactagtcactcattttacaacctgcacaatggaaatttaccactcaaaatttttcataggcagactgtacatcattttcgtttctaaccaaaatatatataggtgatcacaaaaatcacaatgataggcaaataggagtaactaactaaaagaagaatctttgcattatattggctctttttcgcggatggaaattgactcagttcatcgcatctggataattcattcatcattcattcattctttgtttgttttttcatgccgacttaactgaccgcacatgcataaaagcctcaggctgcagctagtccatgcctgcactgcatagtgacgacgtctgtattattctctttctttttacctaccctataataggtctccaaattagcacgccctgtcctattgttactgttattgctctcactcctcgcttaattaggcttgacatgtacatgtccaaaacataaaacacatttatcaatcgaaccgacattttggttgcaaatctagtgaacaactaagcaagttatggtgaggcgtcacaatcaactgtaccctgcccttcaaaacaataactaaggctgtgtttttcagcgcaaagtttggattttggttgaaattgaagatgatgtgattgaaaagttgtgtgtgtatgacaggttgatgtgatggaaaaggactgaagtttggatccaaactttagatctaaacacagcctaactgtatatcagtaacagtcctgtcgcgcgccgtttctgaagagatgatatatagatcctctgtgtttaatttgcattcagcatttatcagttttatctaattaattgttgtcttaaaagatgtactaaaattaaactggctagtatttgatgaactctctctttttctatacaagtagcacttgtttttagaggtaagttccttcctagtgttcttcagactagtttaagaggttgagcagcattcatgtttagttgcagcctagctattggaggcaaactaaactaaaagctgaattcgctctcacctgctctactgacgtgcgtatgttccataccgcatctcatgtgccggcagtattttatttatttttaatcactctctcaacaactagtaaaagctaatgtatcctgcacatttgtagagagtaattaaacagcacgcgcgcgtgcgtgcatctatcatgtcagataatgtgccatacaattatctggctgaaagctaaccttaaccattaaagtattttgcagtgtttatttgtttgtttttataacagagataatagtaataaggttttaactggtacgtagtatggttgaatttaaaatattggcgggtgcagcttcggccgttggcatcgcgacgccggtggcgtacaagctgcggcggcgcggcgggcacggcggcgaggtggcgtcgcgcgggatgaacttcgcggtgggcgggtcgggcgtgctggacacgggctacttccagcgcaacatcagctcgcagatcgacctgttccagaagcagctgcgcggctgcggccccaccggcgtcgcgctcgtcgtcgtctccggcaacgactactccgccgtcgtagacaagaacaacggcacaagcgtaagctgcaattgcaatacaaccacaccggccatctcgatctatatatcatatctcctctctgaacatgcatgtatgaacaggaggcggcgatcgcgtacatcccgacggtggtgagggggctgcgggagcaactccggcggctgcgcgacgaggtagggatgaagaaggtggtggtgaccaacctccaccccatgggctgcaccccgtacttcacgcggctgctcaactactccggctgcgacacgctggccaacgccgggtccgaccagcacaacgccgccctccgctccgtcctccacgacctcgaccccgccaacaccaccttcctcctcctcgacctccacacccccttcctcaacctcatcaccgccgccgccgacgacaagttcccggtgcggctgcggccgtgctgcgagacgttcacggcggacggccactgcgggcaggaggacgaagccggcaacaagcagtacacggtgtgcgacgacccggagcggcacttctactgggacgacgtgcaccccacgcaggccgcctgggccgccgtcgcccaagccttcacccccgccatccaccgcttcctctccacctgaacgaacgaatgaatactcaccaaccagctttctcatttccgacgaaattccgcgaaatttcgacgtttctatatggctcggaattaagtttcgattcgaatttcgaaggttaaacagtagatttgatcgaaattcagtagatttgctccttgcacttcttcttcttcttcttcttcgtcttcttgaacaactttttttggggcctatctaatttattattacctttggatgatgatttgttgcaactggatagcagtattactgatttttttttttgagcaaagggcgagagccctccatttccattaatagaaatgaaaaagtatctaccagtctacagaaagcagtaatactgatgccggaatacttcaaccaattaaagaaccctataaaaaaaccccaaaaacattgccttttggaacccataagcaaaaaggacattaagttaatcgtctgaccttctacagatttactgttacacaatcgatcaccaggaggcctccctcgctcgctttctttctactgttacactctgctcgcgttacaactaacgggttgtttggctgaggtctcaccctttgctattaagaagaagatgaacacaaaggctctagcagctacataaatttaatcaaccatgggcaattctcaaaacacatgatagttctatgttgtatgcacttgattgtcctatgcttacccaagggggtgtcagtaataattctccagcaatcccaactgctatgaggcaccattattgttgccttctgttgctgctgctggtggtggtggtggtggtgttggtgtcacgtccatttgctcgacgtttgtctcagcagcctcgtactccgaaaggaggtccatgaattcgtttaacagccgttggaccttgcggttcgtagccatggaaggtagtatatcttcccttaggagtttgtgtttcttcattccctgcagatttaccatacttgagttcacaggctcaaagtggtaaataaacatcacgtccaagaaaacatagaattatcaggccatctatcagacagagagccttacaagaacatcaggatcccatgatggatttttcaaatcagcagatgatgcagcgtcaaccatgcccatcggaggaccaagaaagctctcacaaacttcacgtagacgagattcatctgcctctctgaacgaaacaaagaacaagcaatataatcatttccgcacagcatcatagactgttctcatcagatataaaagaatcacaaactttctcagccaattaaacatatagagctgaggttgcaaaaaagaaatgttgctaagcctcagaaaaggagactctgtagccattgtattgaattgataaacaaactaaccttgccagaaatcttatgtaggataagaggcattggcgatattcctgtggagacttcaaagccaatgaagctgccagctgggtctctaaatgggagcgtgtctgcaccccatcatcggtaaccctgtagtgccaacagtcaaacaagtatacatttagagcaaattctgctatgttagtacactagcatgtcatgattctagtttcaaacgctcataagacaagagcaacaatggaagtgtgcaaacctgctccaaataggctttctagccatgaattttcctatatcgatctgcaacttgcctagctctccaccttgagtagaactaaatgagctagcaaaatttgatgctggaaagcaatcatcagctatccttagccagcatttcaggctggtgtcataaagaaaagcatggcgactggcaagcacaactaagggcgagccacatcttgaaaatttagcagatataacctttactgtacctgtcatataacaaagcaagatcaacttgcaagaacaagccattttggtcaacatcaatttagaggcacaaaagttcagattaacactacatatgaaatatttaccggtatcttttccagctgcctcatctggagatgttaccaaagaagccaaagaatcatgcaaaacgcaagtcctggtatagaggtcccatatgtacatcaaacccctccttgttacaagaagcaatttccaacactcatcacagtctataaaaacagctgctgatcccatcatcatcgctggcattgctcgccttccacattttgtgtaaacctgaacaa

SEQ ID NO: 39946 - DNA, 1262 bp, Oryza sativa
cttgtagacgggttaggtgcatctgtagaaactttggggggtgattgaaattgctggacactggaaacctttttgcttgcagattgtttggccgatgcttcttctagcagtaactgagcagggctttcagctatatttgattgcctccctctaacatcgccatatctattcttcttcaattcatccagttcagcatcccttaacctgtatccaagctcctttgcttcaaagtgaaaggtagcaactgaaccatccaaagagcaggcaaaaagtgaatagccatcaggactcctgtcagggaaaaagagcagttgctattgagcttgcacatacacgggatactaattatagaatatgttatatggtcaaattcacataccaagataaatcaaccacactttgagtgaagaaatgcttggcaacaaacaatggccgggcactcgctgtcgtccagacagtaatagttcggtcctgactcccaatagcaataacattatatggttgatgttctttagatgatgcttttgatgctccattggcccatccagctggtgcagcctttgcgtcttggccagaagataaatgcttacggaacattgagtggttaaacttaaccactacaacaggtgcgttatgccccagaaaatcaaaggttgctgaccattcaccccgttcaagcacaggggctgagtgcctaggtttctgaaaaccatgagttgtggttatgaagtggccacagggagaccaagcaagtcgcctaaaaaatgtcgaaccaagctgcaaacacacacacacacatagaaaatatttttcagtaaggaggctttctgcaaacaagatatgtgaaccacagaaatgtaatgaccaagtccaaatacacaacaatataacaaaaacataccgattttgaccaatggccttctgtcctgtgagcaagactccagtcactcgtacgccatatgataacagtcttgtcatctgattggcttgcgatgaaagaaccgataggatcccatgtaacgcctttaactaaactggaatgccctcgcaagacagcagtgcatatgccattggccatgctccatatgtgaacagtattatccaaactgccgctagccaatgtcgagtcatcaggggaccaattaaggtcaacctactttacacataagaaatataactgtgttcaacaatgaatcgataaggatcatgacagttttagtaagagatctaagtaacaggtgacagattaaaatctaattatg

SEQ ID NO: 39947 - DNA, 1534 bp, Oryza sativa
cagtcctgcacctttgttgccacttgaaacaatttgagttcaaaattctgaaacttgcttgtcagctttatgaaatcaagcgtacaggcagcctagcagagtggtcacagcgtttacgtgcgattcatagagtgctggaagaagaagagccagcagcaagcaattggtttgtttgtttcttactcatccaactggaagagacacattatccactcatccaacttcgtttgaacctggagtagcattcagaattctcaggtctcaaactgacgactcttcaaatcaaccgcaaatattttagattttgagatagtagttgcagcagtagtagtagtagaaaacaaaaattcagtagagatttgttgggacttaggaggaaggagtgaaactgtgggcggcgaaactgataaacagtcggcaacagagtcagagagacaagtcagaaaggcgtttcttttcatttcgttttctttagcgggagaagcactcacagcttgggcctcattatcatatgggctcaaattttacatttcggcccatgtttgcgtgggccaaattatgcaccagcccaattccaagtaagtaaccaaattgggtaaacgaggtttgcgttattctgataagtgacaaaattgttcttcggatgctcaactgaagcatttttcactcaataaccaatcaaggaaatccaggattatgctgtgacaaacgtatatacgtgtacttacgacagaagaaataacacagatcatacaggcagcaacaagagtatggatcgatgttatcgaccaagagcaatcttaattaataataagagaaatgtttaacaagatgacttgatttgtttcaacaataaataaaatacctcaccaccactagcagcagaagcttataaatcgattctgtgatgaattataagcataacttaacacgtacgtacggtacggtgatcaatcaataatgttggatggatggatggatcgagtatacaatcagctagctagctagcttcttcattgtaagcagcagcagccaggtagaagaagaacaataatcttacgtatgatggatggatggaatggatcacttgttgaggacgtacttcatgacgccggggatgtggatcctgtagaagtagtcgtcccagtcgatgttcttggggtcgaggttgaagagggcggcggcggcggacgacggcggcgtggccatggacagccgaagcttctccatgttgaggtcgtcgaagcaggccttgaagagggcgaaggggccgtagaggtcgacgagctgcatgacgaaggagtacttgcgggagaggtcggcgtagcggcgggcgaagaggaggccgaagcagaggagggagaggaggcggaggagctggagggggagcgcgtaggccaccgccatgaacgccctgaaggaggcgatggtgcggaagaagtagacgggccgcgtgcgcaccgccaccccgtccttccccaccctagggttctccaggaagtagcgccaccccgtccggtacagcaccgcgtac

SEQ ID NO: 39948 - DNA, 1986 bp, Oryza sativa
tcctgcagccccgtagccgatgatgatggcgtcgatggtgcgggtgccctcgatccagccggggagagggtccctgtggacgctggtgatgatgctggggcgggcgatcaccacggggatcccgtggcggcggccgcgccggcgaccagctgctcctgaagcatcatctcccccatggccttggtgaacacgtaggtgttgggccacccgaagtggcgcgccctggctaaacccagatccttcatcgccttcctctccgccttggcgtcgccggcgtcctccagctgctgcctctgctcgcccaccagccgcagctccgtctcgatgtccaggtacgtcccctcccgcagcgtctccccctccctcaacgccctctcctgcaccaccccggacctctcgccacacacgtacgctgcaatttcatatatttttctcactagcttagcttaacttgcatgttaatttgtcgagtgtccgttctaatctcatcgatctcagcttacctgtggagacatggaggaacacctcgagattggcacacttcttggcaagctggcacaggtacttcacccccatcacgttcacatccagagccacgtcgtacctgaacatcacatatatatggattgatcgatcgatcgaccattcatgttcatgtctgaataattttcagatcaaacaacgaccgacctttcgtagaagttggtggtggcagctccattgacgatgatgttaaggtccttggcgagctcttgcaaggtggattcctcgaggcccaggttctgatgcatcatgtctgcagccaatggaactaccttttcatcgatgaaagactgaaaccccttgccatgctgctccttcagaagcccaaacagctccttccctatcacctgcaaccagtactccatcactatgcatatgcatgcctgtagtatacttataactacactagttttcttcagctaattatattactcttcaggcatatatatgattaattacacacacaagcaagaaagcaatcaaattaattagagaggcaaagcaattaagaggatatcacttgatgctctcatatgggccaagctgcctgcagaggtttaataacgatggaggcatgcatgtctcttggatttctcataggattcatttggtacaagtatcaaacatgcatcctcctaaggacacaaaatgaatatgacactactctggacaaaactactacaagtaaaaacctgcagtaatataatgcaattttacagcatttcactggaggacctaccgagtaaacatactgccctggccttctttttggggggtggggttggggggtctaaaatttgtagtacaaatgtactgaaaagaataataatgaatttatatttctgtccatcacattcagaaaagagtcctgctgctacggcggcaccatgttttcttctgaccacaatatagccttttggttctgtattacctgtaggctacagtagactgaattaactgcatgcatgatttcagccacaaatactacacccttcgttcgggaaaaaaaaaactactactacattgggcaggtgttccaattactatccagtaaattgtagtggaagttcagaacacagcaaattagacacatgtatcagcaaattaggctcaatttttttcttctagtcaacaattaataattcggtaatactaccatagatcaatcctttagttaacaacgtctacataacacttgattatacttcaagtacgtactccacttaaatttttagacttatatagcttgctcttattaatcttgtagcaagctccggtgagcatatgcactggtacatgtctgaaccgtgtttcccagccagaattacagatgcctgcatctgctccacattgaatttgggtctgcactgcacatcgcaagaggaggccggaggaggcaggcaattactcctgaccaaacctacgtcacacaataactactca

SEQ ID NO: 39949 - DNA, 708 bp, Oryza sativa
tgagctgatgaacgtaggcgtcgaccttatcgaagttgacgacgggttgctccctgcacaaatgttaaaaaaaaaaaatcaaaccgatcaaacacatgggtggaagctggaggggggaaaaactcaatcccatggtaacagcacggcagcacgagggagaaatcgaattaggcaagaaagaacaggggggggggcacgcacagcagggtggcgatctcgttgatgatcctgtcggcgtcgtcgcagaagagggtgacgacctcggagacgaagcccggggtgcccccctcgtcctgcagcatctgcagctgctggaactgctcgtccaccaaaccctagatcgcgacgagagcaccgattaattagagctagaattggaagcaagcaaccgtaagcagtaggtctggcgaagaggagaggagaggagagggagaaggtaggtggtcacctgggagaacatggaggagaggagagcggtgagctggtcgcggagagcggcggccgccatgggcgagcgcaatcggaatcggaatcggcggcgagggtgggggtggcgtgggaagtaggcagaagagaagagaagagtttggctgaggctgacagcgaaaggcaaggccccaagaggggaatctatttatacgcggaggaagaggaagaggaagaggccacggcgaggcgacgccggtggtggagcggattcacgccact

SEQ ID NO: 39950 - DNA, 713 bp, Oryza sativa
taagaagcatgattaatctaaagcgagaaagggacgtgaaaagttcaaatagccgaacataattattcaagcttttatagaactacaaaattgttgattaatatcgatataggtacgccgtacactacccaaacttggtgcagctgtgataaacatcatttagatacactgaattctaacttgtgtgttagctgcctacctactcacccacactttctttactagtatttttccttttctgtcccaactcaccagcaccagctaaatctttaggcaatgggtatgcagactagagcagaaggttagtatgttaggctattggaacattcaacaacacacacttcagaactcagtattatggaccaagcagttaataaaggagaaaacatgcacgcgctccataagatgcatatccatcttaccagtagccagatacaagtagcttccccccgacaagtttgggaggtttaccccaaataagagctttagggttcttcttgaagatatgtttttgtttgttggctcctctgaacacaagatagctgtgggcccaatggaataaaccattgttaaagagattagaatgcaataaacaggccatatattatataatcgaaagcaggttctggtaacataggaagagtacccaataacgaaaatgaagcagttaactacagcagccaaaagggacagctccactttgtttctcaaaa

SEQ ID NO: 39951 - DNA, 1568 bp, Oryza sativa
aatatgatttgtttgtgtcatttgtgagagggaggaggccacacatgagtctgccacaccaaatctggttggaaaggagccaaatgattggaaaagtatatttattgtcaatctaacccttccatccaaacatctctagggctagagttagttcagggttagttgagagctggaaactaactctaacctctaactctaacccttagatccaaacagggccaatattaccatgccagtcaaattggtgtgacatcgttgttttgtcacatcagttgtgctggtgtggctaaaatgttcaattcttcaaaataagatttgaaaggtttatttttaatattaaaatttttaaaaagttaaaaaaaatcgatggcataggagtatatgtaaaagcagctactcaagtctgatctgatgagagtttttaatactgtagtggatatgttgagtactccagatgagattaaggccgagtttagttctaaactttttcttcaaatttttaactttttcatcacattaaaactttcctacacatcagggtatcccaaaccgttggggccggggttaccgcgccccggtggtaaagcacggttaccgcgcggtaaccgtgaaaaaccgtacaaaatttatcaaaaattcaaattattttttaaatttatttgaatttaaggatgttaccacgatatttatattaccgtacccctcacggtaagcccggtaaccgcgcggttaccggcggtaagagaaaccctgcacgcataaactttcaattttcccgtcacatcgttccaatttcaaccaaacttttaactttagcgtgaactaaacacaccgtaatacaggtgagagaggggggggggggggagggtgaatgacgtggcatgtcgacgatagacaagggaaggaggggtgtgggaccaggttagcatagggtggtctggctggaacgcctctctgtgctgtgctccactcccctcgtcttcttccttcctcggcccggcctcgctcgctgcctgccagctgcagctgcaactctccatccatcgatcgatctcctcctactcccccgccgccgccccgtccaagacaagccaaggtatgccaatccattcctacctactactacctcctcctcagcttcactcactagtctatctaatctcccctagtgagactgagactcgcttgccatttctgttcctgtgctaaattgctaagctacgggtagtgtcttgtgcagccagccaccactccctgcatgccatggcctcacggaggccaacgcaccgccaccataccgaggctccagatcctggtggaagagggagagggagaggccgtgccgcccgatatgctcagcctcagcctcagcctcagcagcagcagcagcagcaaggacgaggatgccgtgctagaggtgcctcgccgccgccgccgccgcagcagcagcagcagcaacagccaaggtctactcctactcgtgctaccactgtcaccgtggcttcctcttcatctaccacggccaccgcatcatcaagccctctagctcccgagctgcgccaagcaat

SEQ ID NO: 39952 - DNA, 1716 bp, Oryza sativa
cgtacaatacaaacctcaattcagcttcattcattttattcgttgcatgtcaacacccacacatgtcaaaatgctgtttctgcatctcctagctacgcctcgccaggtgatgctgcaaccactagcttattgcaattcaattgccggcacgaatcagtttgctactacatcacacaattcacaacccaactgactgacaatcgttctggtcagcccaggaattacaaaacacaccaatccccccttcttctcctcccactagtgtccatgtgagccattccaaatttgacctaccggagcagtcctcccagatctgcaacacataatacatggcataagcatgactgccctctctgttttttttttaatctcattaacacaaaatccatttaaaagtcagcatgcctataatattcaccataatgcaagcaacgtcttaagacaatacagataaaccttttctatccccagttactaccaacacctggatctaagcaaagaaatttacaaagggaaagtttcaactaaaccacacacgtagtaagaggtttcacccacagcaaatctgcgcctggaaggagtttttcacaagtaagaaagcatatctctttttgtgattggaatgagtttttcattaacataaacaaaggaaagcagcagttattgccagcacattttggaaaacagagatcgatagcaaaaggtcatatatcaaatatcgagagcataaccgccaaagtctcggtgcaaaattaattagccatgcatttcccacattcatattattgttaatgaatctagatatctagattcatttacatcaatatgaatgtggaaaatgctagaatgacttatattgttaaacggagggagtaattaatttatgatgcctacttctccttatgattcatgccatccaaaaaccgaaaaaatgttgcctgtggactaaacagatcttgcaacaactcaacataacctcaaacatggctaacatgtatgtatcgaaatgccttctaagatactgaaaagtccagatatttaggcctattaaagtttgaatcttttcattcagagtaacacaattactagaaatcatcctgagctacaaatgttactctgaaactgctgtccaaaaacatactgtactacctatagcagttgccttaaaaaaagccaacttatttatgccaatgtatcagcggagaaattggatgtggtattaacagtaaatcgatgtccaaaacccctcactctcccagcattttccattgtccaagaatattagtgacccagtagaaattagtgaaattggtgcttgggattgaagcgatgtgaggaaatgcatacatgttgtgatcaatactaggagaatatctgaggcaccgtaaggaacacataaaaaaaaaagtaccttcctactccaaagtggaggtagagataaccctggcaccaactctatcgagctgagcaacagtagctgttgctttgagattgccggcattggcgaatgcctccaccatcctccggccaacctcctcgcccttctcctccccgtcaatgacagccacagcagttggccctgctccactgatggtgcagcccaatgccccagcttccaacgccgcggccttgaccgcagccatgccaggaatcagcggcgccctggttggctccacgatgccgtcggaggacattgcggagccgatgagggtggcg

SEQ ID NO: 39953 - DNA, 1251 bp, Oryza sativa
ctttgaaccctaggactgtaagttcatcatttgatcattgagtaacataagtgcttagatgtatttactttgttatatatataatgcatatgttattatttgactttgatatgcagaatgtacagcgggcacaaagggacccttttagcaatcctattcatgaaaagcaagatagagatatgagggtccttggattctccaacatttcgcagcaggctgttgtgggaactggtcttgttcgtgcaaaacctaaaggccaagatggaagtggcggaccatattatactgctggagttggttcttctgaagaacagtttgacaggcgcagcaatttttatgcaaacaaggatgttagaccatcaggatctgtacgtttagatggtgcacttttgccaactcctgttagtaattctgataggattggtagccgtcatccaacaaaagctggaagaattctgaggaagaagagtacatgtgggatgatgtacgttctcaaggagcagattatggaggtaccagttcaacaagaaaaagagaatggatacctgatgatggaaatgttggaagctttcaaagggttaaatgggcagaggcgggaggacctttggaccctgaccaacacaaattagatagcttccaaagatttggaaatgcgacgggtcaagatagaagaattacaccatatatggtatgtgaaaagaagacagtactataaaatcatattcaatacttgatagatacagcaagttaatttcttgtacctaatgttgttagatagtttgaactgctggttcgctctcaaatttgcaatttataatattgcctcaaaatcttaggttttacctgtataccatgctaaattttgatgacatatatacacatattccatctttgcactacttttggacaagattataatctgattgttttttcaattgttcaggatcatgaagagtaccttcatggtaagcacgaagtggaaccaagaattgatagggaaatgctcccggaaggacagccgttctcgtcatctcgtggttcctctctctggttatcccatgaaaaacctctcccagacattgtgtcagatcctaggatatcagcgttttccaatcagccagcggacaggcctaccatttatgctggtaccttgtcaacaagtatcacttcatctgtacctgttgggttgtcagcagcctatgctggacgatcaagcctagaaagtgcagcaacaagatcaactgagactat

SEQ ID NO: 39954 - DNA, 2424 bp, Oryza sativa
tgctgcagtcaaagccacatctcaggacacttgatcaaccgcaggcaaacttttcacctgaaaattcatcttcagtatttaaatcttcaatccagctgcctatttctgttggcgtggggcatcggcagcctgaagaagtatctctgtctagtgattccactcttatgagctcagatcatttaagtgctagcagtttgttggctggccttataaagagtggattcaaaccgaatgaccccaacgatcttgccagtttgagggcacaacctcctcttccaagtgggccacctcctcatgtttcgacatctttttcagctgcttcctcatccctgcaccttccagctagtgatactctgaagtctcaggcgccaaactctctgcgcccacctttgccccctgggttgccactttcgtcgccgtttgtgtgcccgacaacacagacctcggagaaagctgcaccactctctagtcttctcagttccctggttgcaaagggattgatttcttcgccttctgcagattcaactgtagcgatcccacaacagccctgtaaatcagaactgaacacaccagatgacactgcttcagctccatctctgccttttgtccagccttcagttaaaaaggaaacatccaatcaaaactcatctgccccatctaaggtgctggtgcatcaacctgttgaaatcaagaaggaacctgcagaaatcaagatggtagaccttattggctttgacttcaagcctgagatgctccgcaagtaccatgcacatgtgatcagcaccctctttgatgaccaaagtcatcaatgtaatacatgtggtctaagattcagtcttgaagaagagctctctgtgcacactgcgtgccatggatcgaagcaaagtgagactagaaagactggtatcgcacctgaaaaatggtaccctagcaaaaataattgggtcgatagatcacatgaagtgcagaacagcgccctggagtctgcttcttctgttgcagatttgagctctgaagaggaagtttgtgaattcatggttcctgcagatgagagtcagattatctgtgcactctgtggagagtcatttgatgacatttattccattgagaaggataactggatgtacaaggatgcggtctattttgattcttcgaagacagaaggcagcagtggcgacagtgctgagagtaaagagcgtgtacccatagtgcatgcaagatgtatgtcgataagctcaaatgatggcatggaggttgattagcatttgtgccaaacacaggggcagaagcagtagcaacagaaacagctcgaatgatgagattgaggtggattagctggaaatctggtgcttaacagaagctcaaatgaaatgatgccacaaaagtgggtcagcgtgaggggtgatccgcagcagcaactgcaatgatgctgtcgcggccatgacatgtaggtggattagtgtgaagttgacaacctgacgcgctgcacaagtaaattttggtcaaatgtttgtgttcatccctcagtcaccattaatcgtggataaggtgcttacacagaataaattccaagtccagctctggccttgtcaaccgatcatcctcgcaatcgagatcttcgggggtctgatatttgtatttttggttcaatcgaagggaaatgatctttctgttcatagaaggccagcttgtatgttaaaaaggagtgtattgtttcattacgagggaaagcaataggtgacgctgccattgagttactgttgttttttggcaaacttgtttcatcttccgaggactagagattttgtacctaaaaagaactgataatagaacatcatggaggcagaattaaactagttacttatggcttgcttgcttgatgtgggagttcttcattgtagttcgatgttccttcctccttgccattgtgatgcgtaaaattgttttgtcgtcggaagttgttaattcggcagatgatagatctgagtattatataattctgtaattaattgtgaaactgtaggcatcagtaataagcgattccattcccacctgatagatcctggtgaatagctcaatgatttgcctctcatggattcctggtacaagtcaatgttacgaaagaggccatttggattaataaatgtcccttcagtcatgacttatgttactaatcacttgatgaaacaatgcggtcaagtcgagttgcttgttaatgtggtagcttgatgcacgttactccattgtaatactagtacattttagcatgtctgatgcttccgttttgcgtaacagcaatggttgggcttaactaagctaatgcccagtgggagaagacagcagccgaccgccccaccctggtctagagtattagcggaatactaacttgattatataaataaattcaatttctttttcaaaaaa

SEQ ID NO: 39955 - DNA, 1222 bp, Oryza sativa
gccatagaacttttttttaaagagtgaagtaaataagctgtttcaacaagccgataaataacctgaaaagaaaatggctcatttcaacagtcgaacgccacctaccgcttatggagtttgtggttgcagatggttccccttgctacctctgtcggtcagccccaaccaccaaaccaaccacagccatattcccatcctatcaacatcaaccttacggagtacgtgctgccatggatgcatgtttgtttctcccagtactcaccaaactgtcttctatgttctatctgtaccatctacagtactatgtgtgtactcaaagtaatggcatgccatatcgatcagtgaattcattcattttttttttctcagcaacaagagagccaaacatttgtgagcagacaagatcacaggacagcagaaatgtggtggttgttttgattgttttaggcagctcttccattccaagatgtaaaattcgacttactgagaacatcatcatgatgtaaatccgcacccgcgaccgcaatcaaacattaggaggtcttcctcccctctctccaattttggtcacaaaaatttcaaaggaaaacaagaagaagaaagaagcaaattaaccaacaaaaatttgagcatttcttgagataactgtattcaactaccaataacagcagcagcatcagtcttgttgatcaatcagctgctgctggtgtcgccggcggtttggccggaggaggaatactcccagggcgtcatgtccatggggtagctgccgagcacccggaggaaggaggtgaactcctgtatctccgacagcgcgttctgcgccctgacctccgccatggacgcctggaagtcgatgtagaacatgtactcgaagtgcttggccgtgcccacgttggcgtcgtcgacgagccggatggggcggtggcggtgtgggcggctctcgatcttggtgaggctgatgtcccggaacgcgaaggccgacagcaccttgaagagcaccgacgtgccctccctgtcgtgcgcgaacacgatgctcgtcttgaatggccggtccgttcgcgggatgatgggctcccgcgccagcatcacgaaccgcgtcacgttcccggcgtcgtcctggatgccgtccgcgagcacctggagcccgtacagctcggcggcgcgggaggacgcgatggcggcggtgtcgcggagccccgcggcggcgacgtgctcggcg

SEQ ID NO: 39956 - DNA, 1954 bp, Oryza sativa
tgctgtcgccgttcacccgcggggcgccataggctttggcgttggtggtagtggtggtggcgaggatggcggcgcaggtggtctgccagtgggcgcgggagaagggggtggcgcacggcgggcggatggccgtggatctggggatctgggtggggcgcggcgcgggcagagtttccatcatccggcggacggcgacggcgaggggtgggtggcgggaaagggcggcctccctccctccctgtagctgcaagggaagggaagctaaagctttgtgtctctcggtggtgttgcgtttgtcgagaagatggagtgagggactgcctccacctcaacgagacgccgcgggaccaactatttgtttttcttaataatcacgattcttaaatattatttatatttttttaatacattgctattccattttggtaagcgcaccaactccatttgtcagcatgagtgtgaatgcctattttaccatattacgaaccctacatgttcatcctccttcctatctccatctctcaaatcactctcctctcattgacgcatgcctcattttttactcctccaagcctcctgaccttcccttgatgtttccccttctaccaacatctagctatccacgcccccttcctctcttcctccttattgcgctagctcttgagcccttgcgtgatgagcctatagatcaccgaggtctcacattctctctcgacctccttgtctcgttagttttccctactttttttcgtcattggtagtcatgctcgttgctcccaccgttgacaagcctagatctagcgagatcccactgtcgagctccaccattccttgttgcggttggttctatcacactaaagagcccttctcgtcacacgagacccatcggtggcagtgatggaggaggagatgcgtagcaatggagtgagaggaaggtgatgcgctgacctactttctcatcatcgatgccgcctcactttcatcaaccatcgtatatttttaaagtaattttcgtatatttttttttaaaaaataacacattgttttagcatttcgaaaagcgtgcacgtaaaatattgagaaaagtgagtttggacctaaggaaacgaactcatgctcggcgctgcatgaatttatatttatgtattctatgtattcagcggtagatgtacacatcaaagtcaatttttgttttgcaatccacgccgctcaggatgcttccttcgaacacagaaagaaagaaagaaatgcgaggcattgagtcgttatgttaactaggagcagctgtctagatgctggactttttacacatggccctttctgcagaacttattttacgaattaaactttttagaaaactaattctagaaacaaatccctatgctcagcgcaaaaaagaatggcgttaagctttaaatagacacgcaagagatattggtattgattttgaccctagcatgcgctcgcggcagctgaaccacactggtgaagcggctcggcgcatgctttaagagagagagcttggagacagtgcgagcaatgtctaaggatcgcgcttgcaaaggccaagtcaagctcagggacggcatgcggcgagctaggccgaggctgttattgggctggtggggtataggaaggtaaaatggacatggtgaccggcctgtgagggggattgggccgccgggaagaaggagaataagtgggccggtctatgaaggggaggaagatggaaaaagtacaccgaaggtccctcaacttgtcatcgggataaaaaacgctctcaaaccacaaaaccagatatgtggatcccttaactatacatcatcaccctctgccctcctttccctttccctttctcctctctttctcactcttctcttaccttccctgggcgactgggcaagccggcagaaggcgacggcgcatggcgggggggagggggaggggggggggg

SEQ ID NO: 39957 - DNA, 3632 bp, Oryza sativa
aggcggggcgatcctgctctacaaggccatcgcccgccgcatcttcccgcgcgagtcgagctaggagtacctcttcctctccgacgagcactacgcctaccgtgtctgcaactggctccggcgcaaggggctcatgccgctgctcaaggtcctcgagctcccggaggtgtacatgaccacgggcaaatgggagcagatgccctacacgcgcgtggtgtccgtggcgatgcggcagtacaagactacaagggggcgttcgagaagcacgacaagtcgggcgtcgccgaattcctagacgaggtgcgcaccgggaacgcgcgggtgcatgtcggcgcggccatgccgcacgagctggtggccgcggcactcaagcacgagcacgactaggccgcgagctccagtggcgctgggcggtggcggcgacagtgacaccaccagttcgaccgaccgtccccatcttctcgacgacggtgcacggggagaagggctgacaggctggggcgtgcgcggcagcatcaccaagcaggaagtggacaagcgacgacggcagcgatggggatgacacgacggagggggcggtggcgacggacgtcgtctgcgtgtggatttgcagcgcgatggctatcctcggtttcgccctggataggtgggcagcgagttggtggtggtggtgccgcccggactcgagttatatcgaaggtcgccgctcatctcttcccccgtcggcagccgccggcgcccacgcccgccgcacagacctgccatgcccagctgcttccccggcggccaacgtttcgatccaatccggcgagagagaaagggagaggatgttgctggggtcggcggcgcttcttttctttcttctattctcttctcttctggccgcctgcagcagatggggagaggtggccgtcgatgcctccgcgcctctcggccttgtcggcagcggcggcgttgtcctccaccgtcgttgctctccccacgaaggcctcggtggctgatgccgcggctgttgcccgccgccgctccaccgcccatcgccctttctccgcccggcctcgtgcacgtgtgtcgtcgtcatcatcgtcgggtgcggcgacgtaggtggaggcggaggctgacgctgcggctggtgcccgccgccccttctccggccaggctcgcacctgtgcgttgtcgtcatcgtcgggtgcggcggtggagctcggtcgtcgacatgccccgcctcacccacacagagaagacagagaggagtaaagagagaaaggggaaatagaggtgacgacgtgtcacctggcatgtgggtctcacgcttactcaactgccatgtcgaatgaaaccggggtaaaaaccgcccgaggaccaagagtgaacagctgccatatcgaacgaaaccagggtaaaaaccacccgaggaccaagagtgaatggtttttgtaagttggaggatgtcaaatatctagtttttgtggttagggacaattttataactcgatgataagctgaggaaccttaagtccttttaagtgtactttttccggaggaagataggacggaagaaggatgggctgggctgggctgggctgggctgggctggagaaagcatgagtcacactcacggcccggccccctctcccgtggctcgtcatcgtgctttcaccccgtgcatgagacgagctaacaacctttaattggatgtttctccggtagggaacataagacaatgaatgacttgtgcagtggtgaagatagtgataaacaaaatatatattttttaaacttcgttaaacatattatgaatgcaaaaaaaattaccattaataaatcatggtaaataatttgttgtcataaaaatatactccctccagtattttaatgtatgacaccgttgattttttcgaacaacgtttgaccattcattttatttaaaaattttatgcaaatataaaaatatttgtgccatgcttaaagaatatttgatgatagatcaagtcataataaaataaatgataattatataattttttgaataagacaaatggtcaaatgttggttaaaaagtcaacggaattaaaatatggaggtagtattaattattttcaatcattatacttgcattctaactatacgcttcttaatagtttcatgggccgattctagaatgaaaaaacgaaccccgtgctggccgggtttttgtttttgttttgcggaatgactttttactctgacagtgtgaatttgggtaaggggagcactattgcaatgaactatcctctctacgccgccgattctatagaatagaccgcaggagagtgaattatattcgcttttcagaaaattaactagctagtcaaagccgcccggtcagttgttctccatcttgtcagcctcagtcaaaaattaagatttacacattagcttttgagttaattttgatgtttttaactgtagtttgttttttagtgttgacttttagtgatcggctgtacaagtcatgtgcattgtgcaatatgtgcatcatcgcgatcttctaattaattcctgtaagggagggaggatccgagtaagtattcctatatgggggattcgggtcatatataatcagtactccacgaaacgatctactacttcacaatcagtgttgtcttggagaatggagtatctaaaagaaatactagcaggactgtacgtaggagtagtctgtactagtactccatagtgtactccgtttctttcttatagttcttcggaatctaactgctaacattgacctcttccgagtctaactgcattgaccagtgacacggcgaaaacaatcactgaccagtgatcgatacaacaatacgtttcccatctctacggtctacgcccacgtttcacatcttgtgctaatattagctccgtttctaaatatttaataccgttgattttttaagcacatatttaaccgtttatctattcaaaatattttatgacatatgtaaaactatatgtatatatataagtatatttaacaatgaattaaatgataaaaaaaattaataattacttaatttttttaataagacgaacaatcaaacatatttaaaaaagtcaacgacgtcgaatatttaagaaaacgaagggagtactagctagctttagagcaagtataatagtaggctataagctggctaaatgctgaggtgtaagagagaagagaggagaagcgagcttgacggagcgcggcgctcctcaccgggagaccgcacaggcccccctttgccggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacga

SEQ ID NO: 39958 - DNA, 3486 bp, Oryza sativa
ccccccccctcggggagaccaagaggtgggcgcacacatcaccctcgggcccgacgtcccccgagggtgccaggccacgtgggcgatggtgtctgcctcaagcctctagtcatgatactcccggtcccatgtcaccgacagagctgtaaacttacagtcagcttggacacaataaccaagaaactctatgagagatacaagtaggcactgtattaactataaagagctaactattatatgggtaggctgagagaagactataaaaaaccttatagccaacctgttggctgtattattagccttgctcttattgcatgggctcttcctgcaccgtctccatcaccgtgaactactccttgctccgttcttcttcttcttccatttttttactttgggtagtgcaattcaaacattaagtgatgggtgtagtatatatgatcgatttaattcagtgggacgacacgtgtgtttgctttcttgcttttcgagttttcggtcaaacctagctaggagttacttcctccgttccaaaaaaaaaacaatctaagtgtggatagaacattacctagaacaacaaatctggacatcacaacgaatatggatattctgatgtccagatttgttatcctaggtggtgttctatcctcaccaatgtttttttttggacggagggagtaacccctacgtatggaattagtcttagcttttattgaggacaagaattagtctttgtgtttgaatctcctgaaaatgaagatgaagataaatattaagtgtttcacgtaaaatgaggtggtaataacatgtgattaattaagttttaattattacaaacttcaaaaatggattaatatgatattttagaacaactttcatatagaaagttttcgcacgaaacacatcgtttagcagtttaaaaagcgtgtcacgataatccaaattttatcctctcttagtaggagaaacgatcagggctacatgtcccctaaaattacttgtagcaaggtcctatttgattaaagcaatgtcagaggaattttaaggatttcattcctatgaaactatttttctagacaaccctttaaataaaggaatggacacaattaaatcctatgaaatttttatataatatgcctcatgccatataagtttaggagaaaatctaacatgaggtagaatgtcatggaaatttttctttaatgttttttatcctcctatagttctcacgtttttcccgcggtttaatcaaaatattatttctatgcttcgtaattatttattctaaacttgtatttatgttagtatcgtactttttcttattcataagtcttctcaatctcgtgtttaaagggggcctaagtagttatcgtgtatctaaattatattaccatggtaatcatgcattcatgcatgcatgatccatggctgctttattttgctttgcatctccacaatgtttgtttaatttgtgtgagatgtcatgaagaatggagctagccgaggcttgcaaatgaacatgcatgcatgcaacttttttttttaaggcatacatacatcatatagtactatatagtatagtagtaagccagcacagactgctcctactctatatatttacagcagctggatgcgacttccatattctggttgcggaagagcttttatttgcccttcacacaaacccatccttgggtgcatgccttcggcaaaattcaaaagtactagtattaacctagggcccaaacccaattacgtatgactaatactcaagctaaaattttcatgattattaatatagacctaattataaatgcttgaattttagcttttcaccaaaacttggtgagcattaataaccagcctatgccatatatctttctcgaacccttgaggagatgtatttcctacctcaaatgtgtgtgacattatattgaagatcctttgtcttttaaataatttgtacacgtgaaaggttaaaaatatatttacatgtaattatttttcattaaaaaaatctaattaacaatattttgatatgtcttgttttagaacgaatgatttcttttaatacttgattttacgcttatcgcttgcagccaaaaattggccttttaatttgacttgttttcgatgttttcaagtgtatttatttttcagcattagctttcatgtcataagaacacatatataaaaaatttacctataaatatttttcggtgaaaatgttactgctcataattaattaatgagccttcaaaagaaaacggtgtgcttacatttcatagaaacattttcttgtcaaatattgtcacaagtatagttagctttttaacaccacagaaactatggaaccatacttatggcatcgaagtttgacaagttcacggagccaaccaaacatgctccgttccggctgtaaaaccaagatagcgagaaaccgcgaggagcagacgagcagtctacacgctttgtcctctctgttttttttttttggcctggatcttctacgccctttcaggatctcgtgctccacttcttcttcctactgaactaactgctcttcttgtactctctctctctcgcctccaattcaccgacgtctctttggcttttgctgttgaactttatgcagcacatacatacatgcatactggtcgcctactagctagtatggttgcggagccacagtctctgccatgcctgcaaatttgtggtgttcaaagatcacaaagggatcaaaagattcaatacaattgtacccaaagaaggatcccgagacccctaccaacggaaaagctgcattaatctgcataccagtatgaaagtttaggtccattctttttcccctagctttgccggtgtacaaacagggagatgaacgtactgtccaaccatctttcatgttccaagcttaaggtgatatttgattcaggaactaacttttcacattggatgtttggacactaattagaaatattaaacgtagactaataataaaactaattacataaatgagagctaattcgcgagataaatttttaagcctaattttagcacatgtttactgtatcatcacataggctaataatggattaattaggcttaatagatttgtctcgtgaattagtctagggttatggatatgttttatcattagtatacatttaatatttccaattagtgtcaaactaaattacgagatgtatacatactttgagagaaaatataaaatatggagcgcccaactatgtgtgctttttgtacaaattttttttctttggtccataatatttgtttgttttagagttggacacaagaactaataaggtagataaaatggctgttttgttcagttaatcattccaaaaatgcgcatgtatacatggataaacaacttagttatgagttaattaaggaaggggtacggtacgtcagaccaaaaaaaagaccaaattaagctgtctatcgaaattgtaggtcaacaaa

SEQ ID NO: 39959 - DNA, 758 bp, Oryza sativa
tgtttcttcatctcgtcagtacacagccagcagcaagatcaatggcgagagcagcatagagagaaaaaaaaaattctctgctccaatggcattgcaggttggagatcgcagcgatgatgatgatgatgatgatggcgatggcgtgcagtggatggagctgagttcttgcagagataatccgattccaagaccgtgtttggcacgacgagaattttgcgtgtagaactggacaccatgggagaaaactttgagatgtcattagtatctgaatagtgaatactatagtaagcatcagttttagttttgactgacgacagagcgtgtgatgaagatggtgccatgagcagaagggagttcgtagcaaccaggtgcttcgtcagagattcagaggaggatcacacacgaacgtggcgttgctgagatgatgccttaagcagcagcttcaggattcagacaattacccccatcgcaaacgaatgtcgcggtttgtattctcagcgcaaagagccaacccagttaccgaaagaaagtactccccggtttcaaaacataggacgtattttatttcattagaatacaatttgatcgataattagtccattatgatattatttgtgtgataaaaaaacataattacaagtatttatgtgatacaaaagcataatataagtaagtacttttgaatacgaatataataattttaattttatgttaaaaaatatatccagacagagtattgttgattgaagcttgatctg

SEQ ID NO: 39960 - DNA, 10241 bp, Oryza sativa
aagaagaccaaccttgtttagcaaaaatattgcatatgctgatcttgttgtctcctggctttcaaaaaacagagggaattccattgttcgcatggttgtactcagaggagcagaacttatagcagaagctaaggacgatgactcaactgaaggcgcgcgatcaagacatatgaccgtgaacctcccaaccgcagcggatatcgaagaggaacatcaagatatgatgcaataagggacactgcctatgatccaaaaatgaatgaataaaaaaacagcagtaagtaaaaagaattgcatagcgtagtgccacgtctatcactgtaaaattctaaaatgtgtatgaccagcaatattgggttatatatatgtcaaattggtctaaatgtctcttcatcctatcaatctataacagaatataacctacaaaattcagagaacttatagaaagaaactggaatcaaatttgaatgcctaaatcaatctccaatggacatatatttcagtttcaattatacatacatgtgcaacataacccaatgcggtggcagaattctgaatctcagtcttgtcactaaagtagccagtctttttcatcgtaagcttcgatagttggagacccaaaattgccaaaggtgcctgtccattttgagaaccattcggagccattgattccgcatctcctgcaaaattctgatgcattcaaatttttgacaatagtttcaagattaccatctcataccgaagaatctaaacattttgctatgggagaaaaaagtaagtgatcactccaagtcttcagcttgtttggctaaggctcatccattgtagagttgtagactagtatagttgccagaaactggaagctaaaaagtgcaaatgacttcatgtttgatgttatcaacaggtgatatctcaacaaaggtaaaattggttttctatagttatcttcacatcagagatacagccagtagcctagcaacgaaaatctaaggactacttcatgactaaccaccaatgatacttatttctaacatataatggcatgcattacaatagttcatggcagaccttaattctggttcttactactgaaaatgaaaaggggcatctcaattgttttaaaaaaaataatttaaaaatgtgtgacgacgggcctgtgtgtgcaatattgtttggacaaaattagtaatcagacaaatattctcaaagtgcttcaatgctattcaacgatagaagaaatatgaatctaatgttgcagcatcaggtgatgaagaacattgtcatcatacagagcatgtccaaataaatctgatttacatcaactacaagtgaatgttctggatagcaagattctgatgttatcaagcataggcagcattggatataaagcaggtataccaacttgacagagcttggaagttgtaacaggaaaaggtaacatactggttttgagaatactggagttcaagaagctaggcttgttagctggagatcgctcaatcaagggtctcacaggatataaatgtgctacttgtgctgtcatatattgctgtcttgtgcgcaacatcctttccacagttttaagacggacatggagaccattttcccctgacagcaatttatcagcttcctacaaaaataggttcaagaaaaattagttaaatagaaaaaggcacatcatatacagtttaaaagcacatcgtatctttcttgttctataaaccacacatttagatgtgataattcttatatcataaggaacagtcattactactaaagggcactgggacaatatggatgaagaggaggaattaagagaaaaaggagatgatacagcatttgaggagaaggattaattcattgttcttctagcttaatcataatgaatacaagagttatacctatatagaggatgaactaggatgcctaacaggaaaccaaccttaacagttgatattcaaaatgcatgtcaccaatctagccactgatccatctcctatgtggaaagtaattgtaccttaagtttatttcgcgctgtgctaagagtattgcttgttgttgacaaggttcggatcttgatgcggagttcctctcttcgatcatccacatcctcggtcattttcttagtgtgcattttcaaatcccacatgaaatcagcacgtgcttgcactctttccctgatttccgccaactcattatcctgctgaacggaagccttccttgcctgctcaaaaacacatagcaggtcatacatccatgcaaggactagtaaccgcaatacaatccatgcatccatagcatctcatgagacatgtagcatccagaatttaaccctgaactcctgattaacaataatcgtaacacgacaccaacattaagaaaagagcaccacgcagcagcacagctaacaaattatcccccagagactactactcgagaacattaaggtaaatcatcgatcgttccggttccagatcaaagttagaagacacctagggttcctactatccgcatagaatgtgaattcggaagctatagaacgcgcccagtgatccgcccattccatcaggagttataaacccaaattaatcgagcaaatacctcgagcgcggactggaggcgcgcggcgagcagcgccttgcgttccctggcggtggcgagcgcggcggagaggctccagacgcgtgcgagctcctgctgcaggtcctcccagtcgatgaccttgggcgcgtcggctcccgggacctcgctcgccggcacgaccacccaccccctccccccctcctcgtcctcctccggcgccggcgtggggtgatccgcgcacgcggacgacggcgacggcgacgaaggccccggctccatcggcggccgctgcggtcatgccagcgggcggggatccgcgcgtgagctcgccatgggcggctgctgctgctgctgcggctagggtttggtggccgcgtcgtctccgacagcggagagggagatcggcggcgactgcggatgcggggaaggtggagatggttgggaagaatggaggaatggtggatgacgtggcgtgacgtcacgtggatccatgcgtgtgaagaggccggcccagcccgggagcaccgggcccgttgaattcaaattgggccgaattttgtagcgatgcgtgtccggcccattagcaggagaaggcctaattgccatccggagatgtagacttgtccttccccggcaagcgcctcaggggtagagaccaaagtgggtcaacccacataggtcaaataaatagtaaccggtggactttcgtttcaaagtctggtttgccataccgagttgacctgaactcacttatatcaatctattttttttaaaaaaaattagctaataattaattaatcacgtattaattcatagttttgttcttcgtgtggagggtacgggtttcttttggagaacataacctaaatatattagggaaaaatggaagctgaacagataggaggaaaatattatgaagaaaaaaattgaaaggtgagccgatatggaggggaaaaaagaaaggtgaaacgattcgatgcacatatcatataaaaatatttttttctaacattaaatttaaaaagttattagagataatgaaattgcacgtaatgttcaacatgggcatattactagttagtagttaactcacccgtcaattcgtgggttacccattatttttttttaaaccccgggttacccactaaatatgtctgtaagtagattggcgggttagttcccatgcatcccagctcaagccgcaggcgtggtggtggccggcagagccatcgcggaagctgccagagtccggggggacgaccaaggcggcggccggaaatggcgtgtcaacatttcacccgtcgctgcaacgtcttctccggcaagcgtatccatcggtgacggttgagtttcaaggttctatcgttgaatcattgtatctgaagagagaattaggaaaggataatacaagaagaaattggcgatggatcgagctctgaagatgacgagagaattgtcagagttgtcaccaaactcaccacgctttgccgccgggttctacatgaaatgagtagcacaaatggcgaccgacgacagctcagggggatggtcctcgttgcaatctccacggcgaatattcttctttggttaattagtggcttattattcgccgtcttagaattaataatcacatcctgtaattaaatggccaaagacagtacagtacactagttctactgctcatgacacaagtctcaacaagtcggcaaatcttgtttgcatcgtccactccaccgtcgtctggaacgaagaccatatgccatcttctcctttgactactttcttcagcttcaattagcatcttactcactacactaatcccatcagaagaaggttctaatgcacattaaggaaaaaaaatattggatcaccaagttgttgtaggggaagaaatctagagcactgatttttaatctggttcggtggagatgtggctgtaaagtaagttcagcaggtcatggcttgatggtgacttgtctgaaaaaaatctgtttttcaggagggtttacttgtctgcttctgtaactgcaagcacttgaggttcagacgattggatcaggttgaggttccaactgattttcagatcatgtgggacttttggttgcaccatgaccatactacaaggtagactagtgagtgctattactttcgatgatattaagatgatgatgatgcggcaagtgccggctactgcaactgaactctgaacactgaaagatgaagatgtgccctgcgattacacaggagttttataggatttttcacgtgaaatcattctactttccagtgttccaaaggacccctaaggtagtacaactatgattcagacatcttttgaacaatattaggccccaaaatggtcacaatttacttagtcagatacaaataccatgtttcatttgttatccttcagcttcagctataagggttttgttttgagcttcctttacctattgttagccaaatcgaattgcataattgatttcagaaaaaaaatgaaaaagaaggtgcagaattagtgcgacgtgtggcctcgaattcttgagcgcgccaaggactgtgatgatgtgaatgaacgaaacaagcacaagactgtccacataaacaagtcaagctgccaagttgttttcgtccccgatcgacaggagaagatgacgacgatggcgagagtggcaaaaaggtcagacaaaaaaaattcaattctgctggaaggatcatcagctacatctcctaccgtttcacacctcgcgtccttggttgccgcttgttgaatcaaatccaattttccattttgtcccaagcctggtcaaaaatcagttttgcaggtaaaagatcaacatgcaccttccctttcctgtaaagaggcatgagcatattttgcacactcagcatttagattgatggcccctttgtttctcaggtagaagaaaaagcttttggtttgaccatttcaaccaccaacaaacactttgaattttgacccaaacagttattactactactgccgagtttagttccaaaatttttctttaaactttcaacttttttatcacatcaaaacttttctacacacaaacttacaacttttccgtcacatcgtttcaatttcaatcaaactttcaattttgacgtgaacacgttgaagaaagaaagatgctgatatgcagatatggagcaatgaatcaggtgaggtaagtatattcattcctccatgctatgttgattgtaacaataaatttccttattattttatgattttatcctaagaaaaaaacaattaagaacagtacactctctcttcattgatcttgttgactggtgtacagttagtgtgatggtacaagtgggagacgcggcgtgtgcgttgggatcgccgcgaacgaacgacgcggaagcgaggcgaggcgaggcgacggtacgtgtcctcttttctctctcgattgattccacgcgagtcgtcttcttcttcttcttcttcttcttctcgccccccacttgttcatggattccaaccacatgatccatatgacgtcgtcgtcttcctagttcctcctcgtgttaatttttccatgcaattttagctgtctttatcaaagctaatttgagctctctctctctctctctctctctctattctatttgtttccttgctctgctctctgaatttcttctcttcttccttctaccttcttaatttgcctctctgaatcataccatctcgtttctactccatgaacagctttagcatcttgtcactgctcactgggattaaaagtgtctccaattagtagagttcttggtcttttttttcggatgctactctccaaagatttggttcttggtgtttttaatcagcaaggaggcctcctctcaggtttaatttgctagcccatcagatatggggtgcttcgcgttcaagagcaaggccaagaaccagcgggcggcggcgtcgggggccaggtcgccggcgccgacgtcggacgggcagaagagcaaggcatcatcggcgtcgacgccgacgaggagcatccaggagctgtcggacgagaggggcgcgcagcggctgcgggtgttcgacctcgacgagctcagcagcgccaccaacggcttcagccgcgcgctcaagatcggcgagggcggcttcggctccgtctaccgcgccttcttccgctccgccgccggcggcggcggcggccgggtcgtcctcgccgtcaagcgcctcaaccagcgcagcctgcaggtcagtacagtatcagttagctgtactcccatctctcctccctctgatttgcatttgctcctctcgaaaattcgccatggtgcatttgattttggctagatttgtcaaaacgtaccgaatttgttcatcaggacgattgaatggcaaaagaagaacttgaagattttgtcttttcagcttgggcactgaccacatggctgcatgttttttcagagtttcaaaaaagaacttcgcttttactttctctagactacattcaagactcgtagcgtacaatcttcacagaagattcagaaagacggcatgcacttaaatatatatttttcggattcacacattttggtatgctaacactacagatttactactgctgaaaatgttcttcaaccagcaatagttaccaacaagcgatcctgatttggatttggatcgagacctaaaatcaaactcaggatattgttcttttgcaccgaaatcatatgaaattcttagcctcgtgacaattccaacaaatagataaacacatcccgtaggacaaggacacccacacatgtcaacttcaaccacagatcacacaccaaaccacgtgaacaatggtccggacagcatcccaagtcaacctactaaattccagaattcagaatcacgttataaacaacgtaccaagcttaatcacgccaaaacttgatgccagattgccagtgcataggacaaaatccatgcaattttcaattgttaaatcaaagattgcatttttttttaaatatcaacagattgaaagttatgtttttctttttttttctgatttcaggggcacaagcaatggctggctgaggtccaattcctaggtgttcttgagcacccgaatctagtgaggcttgttggctattgtgcagtggattcagaaacaagcaagcacaggctgctggtctacgagttcatgcccaacaagagcctagatgatcatctgttcaaccgagctcatcctcccctctcgtggagattgaggctgcagatcatgatcggcgccgcgcggggcctagactacctccatgaaggcctgcaagaagttcaggtgccctccaaagcattgtcctcctctctgaatccataaaactcaaaatatagatgcctcacaggatacattgtctgaattctgaaactctgaactgaaccattagtttagcacctgcggtagctagtagtaagccttgtcctatctgaattctttaatgttcaagtatgatatgatcaatctggcatcttcccaatatctgaattttgaactctgaaactctgagctggaccattagtttagcacctgtagcagctagtagtaagcattgtcctatctgaattctttattgttcaagaatgatatgatcaatctggtatctgtcccaatatctgaattctgaactctgaaactcttaactgaaccattagtttagcatctgtagtattgctactagtaagcattgtcctatctgaattctgttaggttcaagaacgatatgatcaatctgaaatctgtgccaaatatctgaattctgatccgtagtttcttagtctggcaggtgatatacagggatttcaaggcagccaatgttcttcttgatgccgatttcaagccaaaactttcagactttgggctagcaagagaggggccaactgaaggaaagacacacgtctccaccgcggtaagtgtaaaatccattgcgaacaatcaattcatcccatccgatccatgagcccgagtgatgatgatgatgatggcgatctcgccggcggcgatcaggtggtggggacgcacgggtacgcggcgccggactacatcgagacggggcacctgacgaccaagagcgacgtgtggagcttcggcgtggtgctgtacgagatcctgacggggcggcggtcgctggagcggagccggccggcggaggagcagaagctgctggggtgggtgcgccgccacccgccggagagccagagcttccggtcgatcatggacccgcggctgggcggccggtacccggcggcggcggcgcggcaggtggcgcggctggccgaccgctgcctcgtcaagaaccccaaggagcggccggcgatgagggaggtcgtcgaggagctcgagagggtgctccagatggagccaccgacgacgacggcggccgacaaggacggcgaccgccgcctgccgccggcgaagaggtgacgtcagatcagtcaccggaggaggctgcggtcaacgacggtcaaccagtgcgtgaggaacaaattgtggagagatcgatcattgattcatttgtattgtagagagagatgatgatcaatgcgaataatttggagcatgcaaagtgtttcgattgcacaagatttcccagtttgctgcaagatataatcttacagttctgtagagttcttatgaaaaacctataaatctacgtaaaccgtgtgaaattcgtgcaaaccatgtgaaattcatgcgaacttgaggggaagtgggaacattcgtttctacgcacacttttgaactttagggaaagtaggaacatataatgcatagtaattcgtttctaggacacttttgaacttcagggtgttttttagaaagcttttctcaaaaacttgaataaaaaaatttccccgaaaaaaaaagaaaaaaaaggtaatcccaatcctgtggagaggttgggccggccgacggcccaaatcgcaatggcaaaccgatcggcccaacacatggtctccccgtgggccttaaccccaaaagcaagcaaacccccctcgccggcgaccgcctccctgggaaaccgacgcatccgccgccgccgccgcccggctccctcccgcgcttcgccgcttcagctcctctcgtgccagcgatgccgccggcgaagaagatcacgctcctgcagacggtggcgttcgccggagtcttctccgccgtctcctgctggtaccgtgattgatctgtatactatcccgtcgtcgccaaaatctgcgtcccgtaggttagcagcgtcttagatttcattccacccctctttcgccgctgcaggtatggattcatgtttgggagggagtctgcgcggcgtgagcttggtggaatcattgaagacctccgcagcagcggcggcagtggctgctccaccaactccgcggcttcccccgattctgacgctcattccaaaccctagctcggtatgctgctttttttcttttgagtaaatttcataaaactacatgttttatgattcaagtcgcagaaaaccacgcatattttgacacttggcacttaagtacatatattttggtagtttagtttcacaaaactacactatcgatgaatagattcacccgtgagatgacgtggttgttccatctagaatgaggacgtggcatctcattaatttcg

SEQ ID NO: 39961 - DNA, 18573 bp, Oryza sativa
ctcctggtaacatgcatggatgaaacagtctctatgatctgcacacatatcgatcagaccacgtccaagattacaagttgttcatacaacatgtccagttattcatctgataatctctcaccgtagctgttgctgcaattaagtggtaatttcatatccctgcagatctctcttccatctatctgaatatctcttgtgtagaagagaaattaacaaaccctgcatatgtatatgcaactatgcaagatctgatcccaaaatctaattaacaatttaccaatccatggccgtagctagcctcaactgatcacacatggaaccgtgtgaaaaccacaaaacaaacaaaatgaagatggcaaaaaaacacggatctatgtaatattccatggatctacaactacctaggctacatacatatatatatgccaatccacactgtttaatttaactttggcgtttgatgatgatgagcgatgcgtgcatgcatgcagttgatcatgaacgcagcggcagattcatctctcgaccatgttagtataggagtacacaacactagctggtggcggccactggagtgcgtgccgcgaagttggcgatggtcggccggcggtgcatcatcggagacctcgccggcgccgccgctgctgcctcggcggaagccggcgccgccgacgaacggaggcgatggcggcgcgccaccgcctgcagcgcctcgtccatgtccatctgctcctgcctgcagtcgtcgctgcagaacgctgcatcccctctacacatgcaaattaatcaagatcaattccttgttgaactttgaacacacaaaatttctgtgaaatttattaaggatatatatcaattgatttgcgaactgaattacctgtacatgaagatgtcgcggtcgccggcgatgctgctcttgcagaggaagcacgactcgaggaagtggagacggcggccgccgccgccgccgccggcaccgggcttcacgcggtagaacctcgacgccacctccacatacctctcctcctcctccatcgccggcggcgagccaccaccggcgatctcttccatctctaatcaactgcacgtcgtagctaatcaaccatgcaaccagctctagctagcttattaatttagctagctagacatggtgatctcttcctgtcttgtatcgatcgaacttgcacatatgtgtgtgtgtgtcagtgtattaaatcgttaatggtcctctcctggtagctagcgagtttgttggcagatggaggccaaatgcaatgaaagatgtgtgcatatatatgggtatatatgagcattttgtttggcacatagctgattcgagggccgaaggtttgagagaaaaccgtgggtggagtagcaaatgggcccttggaacctattggctggggctggatgtgtgcgagtgaccttggcctaggggggactaacctactctgcaactgcacccaacttgcagaaatatcatttatatatgtattcatataaatatcacaacatcaattaataatgcaaaagtaatcactctcctgtgcgtggaaaatggaaccagattactgattagcagtgttattaaagtattttctgggtcagtcatgcgagctctgcaggtgcttaacgacaaattaagcttttataaactctgcctttgatccttgcgatagaaaaatgttttgtaccacatcggccagcgaggcggcatgggcacggcatatagccgttctcatgcggcatccgtttgtacgaccagggcccatcaccatctctcgctgcatttacagtttttttgggccaaatgtagtgatccatcttttggcccatataattcaacaaagagaggcccatgtgattccactgccccatgagaagcgctgcgcgatgcattcgcagatttgggccgtaagttgggccacggctatcattttgggccaaatttggatcgcagaccagaccattggtagcgatcgcattttgggccagatttgggttagtatgttttgggctccaatttcaatttcgatttgaattgcaatttcgattttactatagttaaaacttcgtcatatgtaaatatatatagcatcattgtaattacacggtaactttcatataatttaatccgttaaatcgtagattcattttaagattcgtgcaagcgagaaaggaaaaaaaaatcatagtgtccgtacgtacgggtgagggctgctcgcttcatgaaaatagtgggtttgccgtacaatttttaaaagctacatataagtacgttatatgcaatttataatacaattacattataattatagactatattttacatctataaaatttttaaagaaaattttgtccacacatatacaggtagcgtgtgacgtgtgcgtctccgactcctccggccggtccatcgcatcacagccacacatcacgccgtagtaggattagccaagccaagcgataagccactcatttcgtcgccgtgtcccgcgtggctcgccgccatggacgccgccgtctccctccacctccacggggcgctcccgctccccgcctcgcgcgcgctccaccatctcaacccggcctcctccgccgccgccgccgcctcggccaagcagcatcagcagccgcgcgcgcgcctagctgtcacgaccgcgcggcccagcagcaggacacgcgcgcgcgccgcggcggcgtcggcgccgccagttccccctgtcgttcatcagcagcaccgcctgtcgtccagccgcgcggcgacggggtacgcggcggcgctggccgacgcgtcgctccgagccgggacgctggccagtgccgcccgccacgcgcgcgcgctgctcgtctcggacgccgccgccgccgtcgacgttgctgaggattcgcgggtggtcgcgctggtgaggatgctcgtcggcaagggcaaggccgccatggtcgccgacgtcatggccgagttcgtcgccatctgcgaccgcctcctcctcctccccgcgcgcccccacgccgccacctcttactaaagaattacattactctgtcagactctgctacgctgcaattaaacctcgcatgttcagaattgctgcttgttcattgcaacacttgcatattgccaattcatttctcagtaaaatatcagcttaaatctctactcttttttttttgtcgggccatacatgctacgtcccaaaatatagtaatctaggatcggattggatatatctcaatgctacgaattctagattgatgtattttagaacgaatggagtaatttacataatgttattcctgaatcatcatacatcatgtaccatgaccttcaattctaaatactacctccgttccaaaataaatacagccgtggatatttgtgcccaacgtttgaccgtccgtcttatttgaaaaatttgtgaaaaaattgaaaatatttagtcacacgtaaaatattattcacgttttatcatctaatagcaataaaaatactaattataaaaaattttcaaataagacgaacggtcaaatgttgaatgtgaatagtgcataactgcacttattttgggacggagagagtatgttgtactgtggttctgcagttcttctgctgcaaaaccgctgccaacctctaaataattcagggaccttgatctttattgcacagaaaaaatttgaagctagcaagctgtttcatctgtcacagccttggggtttataaatgagttcacataataaaaaggacaatcatatattggtttggatgatgcactagccacattatgcataatgccaaactcataattctcaatagaataattgagtcataaagttgtggttgtgcaaccaactgaaacaggaaagcagaggaacgtgagacgccatgggagattgacactgccgcagcgtgatggaaggtacgtagtagcagttgagaacctgtactgtatattaattgagcagttgaatgatgttaacgcacacgtaatccatctctgcaatgtactacatattgattgagcagttgagctataagaatatatatatacagtagcgtagcatgagctgcatatccctgatttcattggattaacttttgtgcttctgtaagacttgacaaatggagtatcttttagttgtatacatacgctgctcatacactattgatcctatgaaaactgacataaggcatgattcatgaagcacattacaagcactaattgatggatatatgtatgtacgcgagtgcaagttcatgaaaggaacgatcaatcttgaaagagtaacagcagtgctccctttgcttgtgacacactactagcttagctattagcacgtactcaggtactctacaaatgaatgatgaaagggagagtacatatatacaggagcaagagagccacaacctgtctaccattagtaattagtaattaacccccatgactgacagccaacaggaactgatcttttcaatcttgttaagttaattgatttgccgcctccgatcgaatccattaagaaattaatggaaagacaatatacatccacagtaggagcaagatcaaccactctcctctacatctccaatctccatacgccagcatcttaattactctacaataatcaatcaatatcaacgcatgcataccgcatacgtgatctcagaagaaaggtacagctccatataagcacacaatacctcgctcagctgtgcatagtttgcatattttgatcaatcaatcaagctaagcaagctagtgattagtccattgatagatatcgatggaggaggaggattatgtgttcaaggtggtggtgatcggggactcggcggtggggaagacgcagctgctggggcggttcacaaaggacgagttcttcatcgactccaagtcgaccatcggcatcgagttccagacgcggacggtggagatcggcgggaagcgggtgaaggcccagatctgggacaccgcggggcaggagaggtaccgcgccgtcaccagcgcctactaccgcggcgccctcggcgccatgctcgtctacgacgtcaccagccgccggagcttccaccacgccgcccgctggctccacgacctccgcgcccacgccgacaactccatcgtcgtcatgctcatcggcaacaaggccgacctctcccacgcccgcgccgtcgccgccgacgaggccgccgccttcgccgaggaccagggcctcttcttctccgaggcgtcggcgctcagcggggacaacgtcgaggaggccttcctcggcctcctccgggagatccatgccatcgtctcgcggaggtcgctgctggagatggacggcatcaacggcgacgccgccgccaacgccaacgccgcgctcatgctcaggggcaccaagctctcgctctccgacgagctctccatcatggagaccagcgccatcaagagagtgagcaggtgctcatgctcttaattacttactttagacgtcatcggctcatcgccatcgagagagtactcatgctcttgacatcatcatcatcatcgcaagttcataatatacatggatgacagatcttactgcagaagctgagacatcttggtttccaagacacataattgaagggaaaagtatatattaattcagctcttgggtgacaagcaagcgttagtttcatctcatcgtgtatctatttcaagtcacagcagagtgctccgacaaaaaaacaagattgtttgtaaaccatgcaagcgggcctttcttttcttcgttatgtatagagtctaccctaaagtagtttaattaaattaaaatacaaggtgatgataacaaatttcacagaaccatagaatcctgactcgggccatataattctgaatttaacttataacatcagtgcaaagcattgccagctgccattaacttcaaaaaccagcgcagcctcgcgacgctaaatgaatccatacaaaccctgaatcttgcaagctgcattagaaaacctaacgatatcgaggtaatgcctgcgcttactcctttggattttcatgagatctagcaaaaggattagattaaggtgaagatggctcttgcggttccgactgactgttctgaactattcgagacatcagcttagatatctcaaaaattgcgctctgtacctgatcgtcttctgaatcagagggccgaatccacaccggtgactgcaaccccgtagatgttccattcgcggcccttttcccctttctagacgttgataaagctttctccagatccgattgcctcaagggtcttggtttctgaaccagcaatcaggaggcaagatagtcagaaccaacatgtaatgggcaataatcaatctgatgttgtttcagttattactgtatcattaaagtccaactagaaactgtaaatgaaatttgaccatgaaatccaattaaacagaatcagcggctatgctggcacaagtggattcatgcatgaggtttgccgttcgcaaggtcaactggtgtagacaaacattacccaaaggaagtaataatgaactaattaatggtggtagtaatactaaaaaaaatcagcagtgaacacagtaagcaacaagaaggaatgaatactcacatctgcttttcgcccatctttctcattgttcaacagctccctgatagggtagaatgctgcttgcttgcacagttctagaatgtctgatccagtaaatccctcgcatagaccggcgatgtaatcgtaattaatgttaggctcgacattttctcccttcaatacaaccctaagtatcttgcttctttcactctgaacaggaatcccaatttcaaatatctgagtaaagcgcctgaggatagcctcatctagctcagagggtctgttagtagcagcaaggaccataacacgggcattttctgcaaagccatataaataaatcataagatgttgcacaggagtaaccaggaaacttgtttgctagttacaaaataagttgctccctatgtttgaagagactatgtctggcaccctaaataataagacatgatcaaaacaaattacgacagttgatacatcgatttctatttcttgagagagaagccatgtgacggtccgtgtattgtaaaaaaaaaatcgttttctcatgtccagcttagacataattagttatttcaagaaaaaaacaaaagctaaaaagattggaaaaaggtccaactcaattaatttcgttgaagtttatatgtgttgatttcaccaatttgacattatattcagattgcatggtaactctatacactaacggtctgccactttgggtgcatggttatcacaagcaattgatcagattacaacaatgcccataatagcagggatatgtggtaactggaataattattagtactaacttccagttcgaaattctaaattgtaacaattgtttccccttatgaaccactgccacctgtgcctgcaggcagcgattttcaaactttcttataaaaaatcaccccaattaacaatattgtgcacaatacatcattgtatgtttgtaagataacctatctaacaattaacttacataacttacatatgtttgaactaatgtgcaaggtttaagaagaatattctgtgctgaatgccaacaatgaaatatgaatttgttcagacttcaacgtaacaaagcattaagcatgttgatattctaacataagaaaacttgagcataaaattgaaggttatgagagataaatttatatataggttggaaatgggctcaagtttgatacaacacggaagtaaagctttggacagcactgtttagcaagaatccatatgcgatgcaagaaacccgaactaaatagcatatcgatgtcacaatgcacagtggaatgtcatgcggcatcataagcgagctgcatagtgcacttgtgtgttgcaacatactttttctcttaggtaatggagcacactgaacagtattccagactatacatggtctttttgatatatcttatatctactaatataaaaatcgaatgtagatataagtccgcgttgtggggaatcaggggcatattgagagaacgagtaacatggaattctagaaccaaccctcgtggccgccaacccaaatattcaaagtggcaaaggtatatcattacataataaagagaataggatatttgcatagttactagcaatttggacatggaatatgttcatgtataagtttgaagcagagtgtgtacttacgatcagtggtgaagccatcccagagggacatgaactcagtcttcatattagtcatagcttcgtggtccgttgtccgtcgctggcccaagaaactatcgacctcgtcgataaagataatagccggctgcagcttgtgtgcgagactaaatacagcagacactgcaagatgtttcataaatcagcagcgataacaacaaacaaatgaaaaggagcggcagttaaaccgaaggatttgcgcgcggagctgaccgagcttctgggcgtcgccgaaccacttgctcatgaggttggaaatcctgacattgatgaagacggcgcctgactccttggcgatggccttggcgagcatggtcttgccggtgccgggggggccgtagaggaggacgcccttctgcgggctgaggagcttgccgaaggtgaagagctcggggcggcggagggggaggatgacgagctcgtagagcgcctgcttgacgtggtcgaggccgccgatggaatcgaactcgacgtcgatgtggtcggggttgatgacatcgcaagcaatcacatcctagggtagagtgagattgcataggtgagagaggagaaccctagaatcgaatcgatggattggggattgggggtggaaacaatcgaacctcgtagggggtggtggagacgagggggcggccgaggcgcttggcgatctccttcttgtgctggagggccttctgggaggcggcgcggttggggtcgagctggcggaggccggcgaagaggacgaggcagctgagggcggcgctggcggcgtagagcaccagctcctgcacgaaccgcgacgactccgacgacctcatccaatccaatccaacccaatccaatccaatctgcgggcggcggccggcggcgagggagggaggagggagaggttctccccccacacaccggatggatctgcggccgccggagccggagcgggaggaggggaatcgatgggatgggaaaagaggaaaaggaagaggaagagacgaagggggattagtcggtttatcgggaaggcgtcttggggaaggggtttgtgttgcctttgcctctcctccgatgcttctggtctctcgtctgtttgccgcccctcaaccttcacggaaacgagtcgccttgggccattggattggattacgattacacctgtccttttttttctcgaaggaagatcacacttggtctcttattccgtggtagattaatagttaattaattgtatgtatccttttttttatcagaaatacaacaaaatggtagtactccctccatccacaaaagttacacctatttcacatttgatttttttttcaaataagttgttcctatttgtagtctttatgcattcaagacttaaatgaagagataaattaaatgttttattagaacccaaggagtcatctaaatacttattagttgcatgcttgtattcactccttaattttgtaacattcaaggtgatttaatttctccttagtcttggtgttaaaagtaatatgtgtaacttttgtggatggaaggagtattacaattcaacgagacaacttacatcatattgaatctgatatctatatggtatcatatttggtatcgaatgtattagatcggtatctacgatatcgtgctgacatcaactattccgttacaaaccgttctgaagtctttctcttattttatacttctattttatgaataggacagtcaaaagtttagactcgtagtattatatgcatatataatagtctattcaagtatttttgtacatttactatatattttaggagaatagagtattatgtccttactaatactactctcatgtaacataatagaggtgtgcagagtatattttgtttgtggtcttataaaaatttggcaaggataaaacttgaaaattatgctcccaagttcagattttctacaggaataacatcagttcgagcgattttgaagggagaaaaaaaaatacagtgtcagagatgacactgggccggccgacgacaaagatgcagatgtgctccacgtcggcccaatatggccgtacaaccgaataaacagaggcccatgtccgctcacgccatctccaggacatcccgatgggctgattgggccgtttgatctccaactgcaccggcctagccagcaacggcccattaaacgccaagcataatcagccgtacagcatatgctgcatctgtgtggcgtgtaacattggagaactaggaacataaagctcatgctactgccatagcaataagtagcatgatagagcagcatatacattttctggacaggaacgaaaagaacaacaaaaacagaatcctaagttagttaggactcccttcgtcccattttaagtttatccataattattttccgtgtataactttgaccgtccgtcttatttattttttttaaaaaaaatttagaaaaacataagtcacatataaagtactattcatattttattatctcataacaacaaaaatactaactataatttttttaaaataagatggatgattaaagttgggcacggaaagttgcacttaaaatgtgacgaagggagtagtacaaatttcccatatatatatatatctagctactgcctagctagtagcttattcgatatgcgattattggtctacttaattaattggtccagtacaatgctgatcgaattgaattgaacttttaaccacaaaccgttatggaatcatataatcattcaagctagctatagctagagtacatatgacattactgatcgcgtactgcattcgatactcgcgaagacgaagaagaagaaaagagaggaaatcatcatcttgccaattggtcgatcgagaataaaaacggacagacgcccagacaggccatgcaatgcgacatgcactctccaaaaaagcagttcgatgtcatgtatgtaaggacaaacagctagcagaccaggggaagaaccccatcatttgcgtccatctagctagctaaccctttgattgccagccagccaattaactgcctagctcttgatttcttgagaaaataaacaccatcaattaatattaattgttgctttctgaaaacaggttttgctgctttctgaaaacatgttttgttttgcatgcatgtatgtaatgatcattaattgcaatattaattccacgctctctcttctgaaagaaagaaaaacaagaatgtcacattttcagtaaaggaattcgctatacacgatatatagactgaaagtctctgaaacccaactcctgctgagaactgaagaattaaactactgtttaattaatttatcgcggattttaatagggcgtaggattgcaacctctctgatatagtacacgtctgtgatcgatctatttcagggtctttgcattccttttgagacgaagctagcgcatgcagctgaaacattgctaaactgaaaaggaattgtcaagtcagccagcagagcatatataatgcccgtttttttttcctgaggtactagtatcaagcgatgcatgcgttcgtgatgcggcgaaagcaagaatctggtgccgaatggagtacagattctactccattatgatcatacacagcctcctgcatgcaagaaattcacctgtaaccatccatgcactgagtctgatcgatgcatacatttcaggcaaattaaagtgtggcagcagcagcagcagcacgtagcagcatgcatggcatccagtgcaagggaagaaggagatcgatggacgagtgactcgtgagagcagctggcctagctctgaatgaatatactactggatatatctgcagcatgctgccatgagaggagatagctagctctgaaacgaatatatttttttgcacacatatcagtatatatatatgctcgtgtgtgagcagtgcaaggtatggcagtttggcatcagagcgagcttggcatctgcatcaggggggctgcgtcgcatgcgttgaagtggcaatggcgccgcggccagctcgccggccggccagccggcgcagcagcgcaggcatggggcttcgtcctgcgtcgtggtcacatccatcaacttatcgatcgatcagtctctctgacggaaaaacaaatttgctttgcatttgccattgcgtattcccgtttctctgcatctgcatgcctcgtccgagaagaaagcgatagagattgcgctttactactccatgtgtgtgtcttctctccttttggtccacgaaaccacgaatatatttctggagtacaaaagaaaaaacatgagaaaaattggcagtaagatcatgcaatacccggccaggccaggccatggccatggcgtcctgcccctcctcgtcctgtcttttactgcttcgtcttctttccaaccaggcacaggcccagccggcccccccccccccccccccaaacacacccaaatactcttctctttctctctctctctctctctctctctctctctctctctctctctcaatcatgtccttcatcataaactctgcatttaaacttgtgtctcaactctgaagaaacagtagagggatggatgaaaagctagagaaatggatgaaaagaaaaggctgcactaactttctcaagtgtatagtatgtgagtcatgggtgcatgttccctctctcttgctagctgctgccatggatggacctcatggtgatcttttttcctctgaaacctttttcttggcctgtctgacagggtgggggtcaggcatggggttagagcttgaaaatgtgcactgattacatatagcctttttctctaggattaggaaaggtttatatgtgtagactgtagagtagagatgccttttttgaatcttgaccatcgattgcgtggcggtcagcaatcatccatcccccaaacaaatgaccacaagcttctaagctagctaatcctatggttgatgcaaacaggcgatagtgataacatttctttcttggcttttcttaattacaagtggtatacatactcaagattagtctcaagtaagtgctccattcatggagttttataagacatatatattttaatcgtagaaagtcattctttattgattttcaccaataattcgtcgaattgtaaagtacatttactttataaaaactatgctggtagattcatatttcaaaatactttcacaaatttggctctaaagctattaggagaacattttatgaaaaattaaaaccaaatcttgatgttgaagactttttaaaaataaaatgtttcttatagttaaaaatcaagaaaccaccattgatcatgtgggcaaaggtatatatccatgcatcatatatctcgtgtatgtttgaaagtgatgatggatgatgaactatagatgaaattaagtgtttcacaattattcgagggctcaaacgaacgaatggaagattagaaagccaacaagttatttttttaaaaaaaatctaagaaatattgttaaagaaaaaaattgcaaaaaaaaatcacactgtttaattatttggagctaggaagcatgcacatgataatctagtggtataatcagaaaagaatagggtcatatatagtgttgacaaatctctttaattgtgttattgagggagttctagttcctacaaaatccatatgagaaatccaatttcagacatgcctaattaataattccatcagttgtaaatttcaacacattaggtttgtaaataatggaatagtagacaagagaagagaaagtagaatggaaaatgcatggatggtaggccggcttgggggtgggtaggtgaagatagcaattcttgtgggcagaggtccactctaactgccccaattaaaagaccattgatcccctcctccccaagcagccacagacacagccaccacactagctttggacacctctacctagctccatctgcaaccatatgcatctccaccctctccatttggaaccagaaaaccatggcttctcctgcatgctcactactcatccctacacagaaagctctagctgctgctagtttcattctagtaatgatacaaatatcaagagaaaaagtgagagtcaaatagaggtgtgaggtgaggaagatgctgcaggtagaagaagctgagagaaagatatgatcaagcaagcaagcaagcaagcaaaagttatctagctaaagagggagccttttcattttgaggggaatgttgtctggctcggggctacttttaatttctctctcttttgatatcttcttttctcgatctcctagcttgatcttttgatctctcaaatcgatcttaagaaaaagatcagtcaaagagatgagagtagatgtctgtagatctcggaccaggctctgatgaatcccctaatgatttttatcaaaatcataagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcaggaccaggcttcattccccccaaacagaagggctcccatgcatatcgatcatgagctagcttattaccccctgcttttgcctcttccaaatctgatgaactgggtaagttaactgaatattgcttaactaatcagctttttgtttcatctgatggatagataggaggagtagatcttggtggcatgaactgcatgagatgcagattggtgtaatgatggggggaaagactgcatgactgtacaattgcacacttatcagagctacttgggatctcttctcttctcttctctctctgcaataattagcctttgatgagatgaagggtgatgaggaaaaggctgtcatcattaaaggcctttgttccatgcagatcctatccttcatggttggaactagctagtctgtattcatcaggtacaaataccttgcttaatctttcttctttcatatgtatgttcatctgatctttacctttgcttgggtatcacaactcttagctagcttgactgatctaaaaaatgcttttttttttatagtttttggtgatctatttttcatcttcgtttttcttcatgttctaccttgcctggtaggataatgaaacatgaagtacatatatcatgctctgtagtacactccgggagaaatatatggatatttacttcctgttaatttgttgcttggagtagatctagagagaaaaaccaactctttgcactgtgcgtggattctttacctttttctccttcaatttttgtctctctccaaataatgttgcattgggacatattaatttgattccagtttaagggaattaataggtagctagcagatttccatttatactttggtcactgaggttaattaattaattgcctataaattgttccgataactgattcacactgttcaagagaaaaggcaagctagattcatattcttcagagtaatgctccggtgcaatctacttgcagtattctactccaagtagaataatcttgaccgtttattttaaagagcaggtaagtaatctcctaatatcgtttaggggtaattttggcatgggatgttttcttctgttcgcatcgtatcaggtctgaactccgttgcacgcagtcacctcgctattcctcccccggcctagccgccttgtccgccccctccgtcgccatccgtattccccgccgtcgccgccttgtccgcttcctcagtcgcatcgtccgtctgggagcggacgagtgtggtggcgtccgagcaagtgacgatcttgagcaggagttctggcggtagtaaaaattccagcctaggcttcggcggcagcgtcacgcacgcacgcaatgtcatttgcttggcagcgtcgtctcggctcattcgtcttcttgccgtttccgatcactgtgttgtttcatggattacatggatcgattaagatcttgcacgaccaactccgacgaggatgacatggtgatcgatctatggatcggaaaacaataataccccttcgcgaattatttttcctagacaaaaacacccctccacatttcacttccactaattctggtaggagtaaaactagatcttaaccctacaattaaatatgatcaagggcctagattactttttactccgagtagaaagcaccagagtaggactctattcttcattcatggtcaaatcatgacaagggtttgagatcagcagagcagatatatctttattaatttttggtggtaactatatataatttcagctaaaccggccaagtagttaattactgtgcctttttttttctcttctgtttactttatgatccagtagctaccataaatgctgtagaaagaatatactgcaaagggcacgtagatttttaccttctaataaatgaaatggaactgcgggaaactattctaaactctcgagtggatgtcttctcgttgtgcatatatacgagatcatgatcttaccaaacaataacaagttcatatataagatgtgcatttctatgacaatatatatactacatattgattttttatattaatttgcaagctacattcatgctgatcatgatgatgagatttaattttgttcattcaattcttagaacactaatcaaaagtaaacatcggacttttgattaatctgaaaacttaaatattatcgatatagctacagtatatgtttgtcagggcactagctagctgattctcgatcagctagctgcaggggagtatatttgacaccagtgcattggtgttggtgtaaaccttgttgttatgtatcaactctgagttgtttcctgtttgaagccttgagctctagcttccccatacagtactacacccattattttttgtgtcgagatgctcatacattgagttatgtagtgcgtgctgcatgtacaaaatggtgtttccagtgatcccaaatccctaaagattctcttgttatgttgtacattgtctttgattgctatagtagctcttaagttttaattactccttttttataattctttcaggatctctcatgttcaaatgttttcagaaaaaggaacctcccttttgcctctctgttggcagttttgctctcctttttttcttcagactgttagctgtactagtgaacatgtatata

SEQ ID NO: 39962 - DNA, 2360 bp, Oryza sativa
gggatcgaaatacgaaattttttcatagccaggcagtatggagagcaaagaagaataaaatctccaaactacgggatgcaaatggaactgttcacagttcgacaatgaagttggagagcatggcaactgaatattttcaggatgtgtacactgctgatccaaatcttaatcctgaaaccgttactcgtcttatccaggaaaaggttacggatatcatgaatgagaagctttgtgaggattttacggaggatgaaatttctcaggcaattttccaaattgggcccctgaaatcacctggtccagatggctttccagccaggttctatcagcgcaactggggcacaattaaagctgatataatcggtgcagttcgccgtttcttccaaactggactgatgcctgaaggggtcaatgatacggccattgttcttatccctaagaaggaacaaccagtagatttgcgagactttcggccgataagcttatgtaatgttgtctacaaagtggtatccaaatgcctggttaacagattgagaccgatcctagatgatcttgtttctgtggaacaaagtgcctttgtgcagggaagaatgataactgacaacgctctcttagcctttgaatgtttccatgctatgcaaaagaacaagaaggcaaaccacgcagctgtgcatataaactggatctatcaaaagcctacgacagggtggattggcgtttcttggagatggcaatgaataagttgggttttgctcgccgatgggttaactggattatgaagtgtgttacctcggtgagatacatggtaaaattcaatggaaccctacttcaatcattcgctccaactagaggtttaaggcaaggagatcctctctcgcccttcctatttttgttcgtggcagatggactgtcattgctgctgaaggaaaaggtggcccagaattctttgaccccttttaaagtctgcagagctgcccctggaatttcccacttactctttgctgatgataccctcttattctttaaagcacaccaaagagaggcggaagtggtaaaagaagtgctctcatcctatgccatgggcactggacaattaattaacccagccaaatgttctatcctcatgggaggagcctcgaccccggctgtcagtgaggctatatcagaaattttacaagtggaaagagacaggtttgaagatagatatctgggatttcctaccccggagggacggatgcacaaaggacgttttcagagtctgcaagctaagatttggaaaagagtgatccaatggggtgagaaccatctctccacgggtggaaaagaagtgttgatcaaggctgtgattcaagccatcccagtatatgtgatggggatttttaaattacctgaatctgttattgatgatctaacgaaactaacaaataacttttggtgggattccatgaacggccagagaaaaatgcattggaaagcctgggattcgttaacgaaaccaaaaagcttgggtggccttggtttcagagactatcggcttttcaaccaggcacttctggcccggcaagcatggaggttgataacatacccagatagcctgtgtgctagagttcttaaagcaaaatatttcccccatggttccctgattgacacttcctttgggagtaactcgtccccagcatggagaagcattgagtatggcctagatttgttaaaaaagggcattatttggagagtgggtaatggaaattcaattcggatctggcgggatccatggctgccaagagatcactcaagaagaccaatcactgggaaagcaaactgcagactaaagtgggtgtctgacctaattacagaagatggatcctgggatgtgccgaaaatccatcagtatttccataatttggatgcagaggttatactgaacatctgcatttcttcaagatcggaggaagacttcattgcctggcaccctaataagaacggtatgttctcagttcgaagcgcttacagattggcagctcagttagtgaatatagaagaaagttctagctctgggacaaataatattaacaaagcatgggagatgatttggaaatgcaaggttcctcaaaaggtcaaaatctttgcttggagggtggcctccaactgcctggcgaccatggtaaataaaaagaagagaaaattggaacaatctgatatgtgccaaatctgcgacagggaaaatgaagacgatgctcatgctctctgcaggtgcattcaagctagccagctttggtcatgtatgcataaatcgggaagtgtttcagtagatataaaggcctctgttttaggaaggttttggctgtttgattgccttgaaa

SEQ ID NO: 39963 - DNA, 794 bp, Oryza sativa
aaacactcgaaagcaaggagtgcgttatccgttatcagtcttcctggcacgaaggcactttgattaaccgagatcaactcatccaaaatcgaccgaagtctgtttaccaagcatttagagacgattttatatagaacgttgcataagctgatagggcgaaagtctttcagctccacaggctgatcaatttttgggatcaacacaatagcagtttcatttgccccttctggcatgattcctgaatgaaaaaattccttcactgccgccaccacatcagacttgatagtagcccagttcctttggtagaatctcactgggaatccgtcaggcccaggggccttcaatgggccaatctggaagagggcatcggctatctcttcatctgtaaattccttgcataagttctcattcatcgctgcagtaaccttcttctgaaacaactgggacacacttgcctgatcgagatttgggtctgctttgtaaatctccttgaagtaatcagtagccaacttttccatagttgttgccgtattatgaatagtaccatcactagccctgagcctagagatcctattcttttttgccctccacaccgctttactatgaaagaactttgtgttgcgatccccctctttcaaccaactaatccttgatctttgcagccaaagcatctcctctctatacaacagttcattcatgcggtctaaggcctgacggatctctctactgtcagcatttcattccattaacattgccagatgtttccttgccttttctagctctctaccaatggt

SEQ ID NO: 39964 - DNA, 11759 bp, Oryza sativa
gcaacatactccaccagagggaaaacacacacacactcttcattccatagaagcagaagcagagcgtaccacgatacagacagaaaaccaaaaacaaaaacagcagagcgtgtatatgtatcattccagtattttctgagaaaatcccagagttgacactgcaagtatgcaactaataaaaatttatgtgattcagcatctctcagatcgaacttatgttattcggcatgtcacagatcaaataagatcagagatcacatccatagcatataccttgaacaaaactgtgtttttcaagaaaaaactttcatgtaaaagtacacaacaaggtcgaaatttggtgtcaacaaacatgtgcagcagccacgaaactacggtttaaaacacctccattttctcatctatcgtctgcaaaagttacttgtgaagggctaccctcaactgtctcattctagatcctgaaaatgattaactagagttcaagggcctccaatctatttcttcttcttggatttgcttccctgtgcaaatgcagtgccctgccacatcaatgaactcaaaagttaatcttctgcatggggctcacaataatcgatcaatatgatgttcggtgagcagcgaaacaaacctccagccactcatccatgttggcatcagtagttccagttcccagttccaccttgggggccttctttgttttctacagcacgcagaaatgattgatgagataaacgtacacagctcaaatgtccagctaacctgtatcgcaacaaattagaaacatacctttgagagctgttgtacttgaccatatgcccacaatccgaagagaccaagaagggcaactccaagggtaataaggaacacagactcaacgctgagtaaacctgcagcctcaacaacctctacagtgccattgtaaaagacattctggtatgggttctgatcaatctcatacactatgtaaccaactagatcatatgctccaggctgcaaggagacaggcattaggacgtcatgaatgcaaaatgtacacaacttgatcttatagttaagattgtttcaatggttagcgttgtgaattaacaaacctgcaagaacttgctcacggcgaatgtatacggaaaggttgcttgtacagagacaggaactgatgcattgaagaagttctgcaaaaaaagaaaccacaaaataagcatagttatgaattagaacatagcattccaagaatgtgtgcttgactcaataaattgtgtgattcaacttcacttaaagacaaataacatataatactactgagaagcagaaatacagatatctaatgaaaacataacagaacaagatccgaacagttatttctcggtgttcaaagttaaaacaaaatacattatatctctagagcaggcaggattaaataaattatcaataaataggaaagtttgatggtgcacacatcaataggttaatttcagaagttcagctgttcaggtagtaaaaacaagaacgctcccacatttcctcacctgaacagtaaggttttgtccatacatcttatggtcaaaaggaagatggagagttgaatggatagcaacaacattcaaagttgattcacctgtaaacacaacatatgcaaagggtgtttgactctaagcaaactaagaacaaaacatttgaactagcatggtaaaaagaatattaaactattgaactcagaatctacattgccaaaacaagaaaaatttgctcgtttatgaaaatgtcatgtacggtaaactagtgatctctaacataaggttattccttattggacccacatattcttggcaacaaaagaacacactaatatggctatgcatctgctctgacgcatcaatttacatgatataggaaaatacatgaaagacacatttgcatcaaaggcagctgaaaaactagtgctattaagggacgtgaacatatgcatcttacaactcatattgcccatttggtgatctgttattagttaatcctatatagaaaacatggcagtttcaaccaacctagtacatattgaaacaatctcatgacctggatatgatacttaagccaaatggacatgaacttgcaataacttactacacagaaagcaaataactgagacaaatatgcatggcctgtttagatgaagtgcaaatctactggtcgatttaagataaatagagatagcccaagccaaacactaatcatagctaagtaactgaagtggcaaccgggaatatttcatgaaagaaacagcatgagttaccctcgttttgcaggccaaccagtagttcagtttcttcacctgctagcacaactacaataaaacaagaaaagggaaacattattgcttattgaagtcaacaaggatatgatgctgattttaaacaaaacatgtttccaaacatggcatgcaaatattaagaatagacaagatcctacagatatgcatagaatagaatcctatcagatgaacagaactagcaatttagtttagaatatttcatattaaacattaagggaaatgattgcaaatgaattacagtactagcgagtgaatttcaaataaatgattttgctgagattgtgatttgacactcacttttgccagcgtttttgggaaaaacacatactgtctccacaccaggagccggacttagaggcccatcgctggaaacttgtgtatcatcactgacgattcctagatcagccccatcaacaacttcagctgtagcagcttcttccatggactgagctctggcaactgcaggaaaattcagttcaaaggagcatagcagagaaaacagtaccattttcagccctagaacctcatcggtaaatttagaatatacgtcatcacttggttggctattctaaacagagattctgctaataatacatcccaattttccaattatgaaagagcttgtcggaggcttggagcagcatggtattctcaattttaaccaatcttaaatggcatggttccaaaattttacagtgttaaaaattaccatagaaacctatcctaccaatctaccatcgttaaccatacatgaaaaacccgtctcaatttcagaaagctccagcctcagatggctgcgttactttgataacaaatatgcaaacgcagaaacatttttatcatgaaaattgcacaccaacaaactcttcccaagacgtcgcgtctagaatcccgcccccacacaccgatctattcatataatacccacctaaacttgctccaaacatcaacctcctccggtgcaacaccacagagcccgatcggctcaattaccacacccgcggaggggcaaagcgcgcagatctaccgctgccccgccgcgaattatcgagatcggcgctcatctacgcggccccggatctacgcggcggggcgcggggcagagaagagaaagggagggacgaatcggtgcgcaacgagggtgtttaccttggacgacgggggcggcggcgaggaggaaggcgaggaggagggcggagagccaaaccctagtcgccgccatggctggctctggctcagatcggatcgggtcgaggcggaggaggaaggggtcgcgtgggttttgcgcggtggctgcgtgtggctcgcagtacaagtagtagtagtgaagccgtcgcctactacccttcaccaccacgaggtccacgacttgggtggggcgctgcgccgcgtgcccgcgtaggcttcagggtcgagtcgcagctgggtttgttactgtacatggattgtttgtttggcacattcaattacgatggtctcgtgatccgagctgtaaagcgaaaaaaagcattaatctcttcatccactgatccactgacagtggggtccacaaccgtataattagttgcaagatcacttcagcaaccagatgaaattgtagctggaaagatgcaaaatatacgcgacaactttcaccctgatggaaatgcagcgcaactagagcagattcgatgaattgcagctcatttttcagaggatttatggattcggacaaatgtgccctggtttttttttttacacaaattccaagttacaagaatacaaagatgtcaggtttacagtcccaacacatcacacctacattaaggtaaacaatttgtttgcagcagcagcaatcagagtgcctggaacggactcgccagcagttggcaccatccgttgtttcgccacatctatctggagctcttcttcttgttgcaacaatgcagtgacggtaattcgtaagtggcatcattgaacaagcgtaacagcttgtcatatgtactccctccgttccaaaaaaaaacaaaccctggtttccgtgtccaacgtttgaccgtccatcttatttgaaaaaattatgaaaaaaataaaaaagacaagtcacgcataaaatattaatcatgttttatcatctaacaataatgaaaatatgaattataaaaaaatttcatataagacggaccgttaaagttggacacgaaaacccagggtttgcctttttttttgggacggaggaagtatccagctagttgggacggctcagcgccatgaacttgcactgctcactcatcgcctgaagctgcgcttccttcttatcaatcatcgcacgcagcctcacattctcctccaccaccttctggacttcggcttctttttgtgctttctcactctcaagttggttggttcttgcaactagcctgttcacaagaacacaaaacttaataccaaattgattgtttggaatgaaaggattggataccacttgcttcaccaattcataaatcacccatgagtacgtacttatctaggcgattaacagaaggaacactataagtcaatgctatgttatgtttacgaatatgtagtttcatatgcgactgttagggaacttatttgaggtatcatgggttttacagcagccttctctgcatgattccaagaccatgaaaaatgattatatctgtatcaagtggaaaaaggagacaaaaagatgagcctacacagcatatgattttcccctcagccaagaatgtaattttctatgtttttaatcagtcatgggcatttccttaacattaggatgcgcatcactcaaatcagaaggtgaaggaactggaactacatgtttagaggacagcaagaaaaagtgttttggactaagtgctgaaatgcaaaccagtagaaaacatactgagacttagtcaattctatatccacaaaagcatgcatcattttgacaactgaacatccatacgaaattttggacatgatcaaaacacacaatttttctgcagttaaatgtgaagttggggaccaactcctagacttgatgattcgatttatactacactaacgtaacaccatatcagctgacaatagtctctatgatatcaaaaggtgacaaagtatttaaatactctagatgactcatttcaatgatatttagcatgattaaaagcaactatcaacaaatctgacaaaacactctttaccattgatcaacacagtggggataggtcatagttgttacaaaaaagaaggcttctggagatgcagtgtaaactctaatttataacagaatagatgtagctttgtgccttgaggataaaccatagagctctcctagtcaatgacagcccaacgttattaccaaaagaaaaacacttgaatgcgtgacatagtttatgtcaatcatatatgccagcaaaaaataggtttccatgctgtgttttaatgatactagtgtatatgcagtgtcacaaggaaagttcaaggcctgcagagcagttggtttcatgagctgatgagcatatcattaagcggctcgtgctttacaaaatgcattagaatatgaaatgttgtcttaacaattttctcagcagcatgtcctagcatgaaggtgttggcagcatcatcaatttacatgacgaatagggattacagtgcatgtgcaggatttattgtccaattaaactacagcagcatgccctaaaatgatgattttgctagcagcagtgtttacataatgacaggattgggaagatgaaagatatttttgcaaagctctgaaaaattaatataaagtttgcactcggaaatgaatcctgtacaacccacttcatacaaataatagttactaaaaatatcatgatacttgtgaagttacctgtcgaagagtttctccattgtttcaaactgcttctctgatgaaagaagagtttctctgacattaacgagagtgccgacataggttctgagagactcgaagtcatgcttcacacgactaagctcctgctcattttcagccgcacgttgcctttgtcgagtggtctccaacaccatgtcttcaaccctctgcctcatctcattcagcataccattcgtacccactgcaaatttctccatttcctcaactttggccgacatggactcaacctgtatggtcttcctcctaatctcttccagacccatcctcaccttctctttctcgttagcggcttccgattcagcaacaatcactctcttcacaagggtctccatgacatcggtcaccacatgtatcgacttcagaatgtcttcgacatctacatccccctcattggcatcgccatgttcggcaacacgactactatccgccgacgtttcatcatctaaaccctcgcaggaagcggactcgccgcccttggaccaatcagccagtggcaccccgttcctgtcgacgtaccccacgccatcctggtgcctaatcccgcaggacgtgtgcgcgaggtgcggtatcgccatgatcctggccttggatttgaggtaggccagcagcgtggcgatggtcttcaccctgcggcagaggtgatccagctccttcctcgagtcctcctcggagcacttcatcccgaccttgacctccacgagcctctcccgcagtgcgtcgacctgcgactgctgctgccgcagctcctccctccattcgctctccccctcctccgcgccactccgatcagcagcggcacgctccatgaaaccctacggaattcaaaccccccttaaaattgcatgtaaaatcggctagaaatggatctattcgtccccccaaattcgaccggataataaacgcgtaatcagacggatttgcgagcgagacggtggggatattggggagccatgtaccttcggtataggaggcaaggagcgcgtcgccggcggcgaactcccgctgcggcggcgctcctcgctttcttcgccgcgggttgggttgggttgggttgcgctctcgcgtcgcgtctcgcgaactagtcgctcgcctttcccctttcttcccccaacccaaactaatgaaatgaaatcattttgtttgcttacttatttcctaatccgatgattagattaggtgagtacgctaatggcaaaaagaaagattaataaatgcggacgcgctaaagcatccgtatgggccttgggcctcttctgggctttttttccaaaaaattgagcacatttgtaacacaaaaatcaaccattgtttttgtgcccgagaagcattgtaaggcagcacaacaatagcaactgtaaaagagaacgtcaatatttgtaggaagagtttttctcgtatccttgaagagatatatactttctcacaatttaagaggtaaaaactgtactaccagttgaactgattagaaaatatttaataaatgtgtagtcgagtggtaatgtaaagggtaggtgaagtaaagcatacccttggattccacttccccacgtacccaagttactggactatcaataatgagggcattatggctaccgacatctaaaaatgacatgcattaatttggcaaacagaaaatttaaacctgttttttttttctcaaaagtgttttggtttggtaatgtacgtctcctgaacaattgagatttgagagtcggtggttaaaactaaaccgtgagataaaccaaccggtgctttaattaattttgcacccccaatataagcaacaacgaactcctacgtggcggatggtcgagacggtcatggcgagcctctaactccccaccaactgccgcctctcgtcgcctcgcctcgccggcgccacctccgcattccgttccgaccagccgatcggtttcttcctcgccgttgcaaccttcgagcgcgatcgatcgaggcggttgaccgccgattcgccgcgcggcgttgcattgcacgcggctttccagttgataaatcaatcatcatccccttgatcgatgcgagtggcgttcttgttcgatcgagaggaggagatcgtgatcgcgagcgatccgggcggggcggcgcgccatcgatggcgaactgcgtgcggtgctgctgctggctcctggtgctgatgctcatggcgctcgcgatcaccgccgccgtggtgttcgtccgctacaagaacggcgagggggtcttccccttccccggcgtgcccggcgccgtcgaccacaagtacgccgacgcgctcgccgtcgccctccagttcttccaggtccagaaatgtaaggaattattctcaactttgcatgcattttttttttttgcgtttgatctcgatcatggaagttcttgatcgatgaagccgggaagctggtgaacaacacgatccactggagaggtgactcggcgctggacgacggcaaggaggccgggattgatctctccaaggggatgtacgacgccggcgaccacatgaagttcggattccccatggcgttcacggccaccatgctctcttggtccgtcctcgagtacggcgacgccatgcgcgccgccgaccagcgcgactccgccattgacgcgctgaattggatcatggattacctcgtcaatgcccacccctccgacgacgtcctctacatccaggtgatcatcatcaaatgatcgaataatctttatccaattcttgggaaatcaattaatttcttctggcattctgatctccaggtgggtgatcctaaagcagaccacaagtgctgggagcggccggagaagatgaaggagaagaggccactgaccaagatcacgcccaagtcccccggcagcgacgtggcggcggagacggcggcggccatggcggcggcgtcgctggtgtacaagacgatcaacaagacgtactcgtcgtcgctcctggaccacggcgagaggctgttcgccttcgccgacaagcaccggggatcctacacccggacgttcccggagctcagcgcgttctacaactccaccacgtaccaggacgagctcctctgggcggcgagctggctctaccacgccaccggcaaccacagctacctcgcctacgccaccggcaagaacaaggacttcgccgacctgggcaacccgagatacttcagctgggacgacaagcgcgccggaaccgaggtgggtgataatgaccgtgacaccgccactgattcaactccactgttcatggcaaattttgaaatcttgggatggttatgaagtgaatttttgtggtgttttgtttgagtttcaggttcttttgtcgagggtgagcttctttgcttcgcaaggatcagacgttgcacaagacgatgttcttgggatgtacaagcagactgctgatgccgtcatgtgcattctcctgccggattcagagaccgccgctttcagaacagaaggtaaatattcacaagattcagaagcaaaaataaaaaaagcaatctcaggttcaccatttgtgtagctggtaataataataatccagtagtatttcagatagcttgcaacgatttatttcaggtggtttgctgtacgttgccgagtggaactcactccagcacccggtggcatcggcgttcctcgccgcggtttacagcgactacatgcagagctccgggaagacggagctgagctgcagcgggcagggcttctcgccggccgacctgcgcaaattcgccaagtcccaggtagtaacaagattcagaatcatccatgaaccagagttcacaattgttcagactaacatatgttcagagagaacagaaatgttcagaaatacagtacgtaacttggatgtgatcacgcactgatcagtgatctttgttcttggcaggcggattacttgctaggcagcaacccgatgaagattagttacctagtcgggtacggcgaccggtacccggagaaggtgcaccaccgcggcgcgtccatcccggaggacgtcgacaccggctgcgacggccacaagtggctggagacgtccaagcccaacccaaacgtcgccaccggcgcgctcgtcggcggtccgtacaagaacgacagcttcgtcgacgagcgcgacaacgtgatgcagaacgaggccaccacctacaacagcgccctcgtcgccggcttgctctccgccctcgtctccacctcctccctcgcgcgatccttgtcatgatctgcattgctcggattctgacggtttaccactcattagatggcatgcaaatgctggctcaaactgatgaagaaatggtagggaggatgttgtatcatggatcgaagaagtcggtgatctgtatgtgaaaagggtaattagtactgtactagtacttatacttactaacaaaaataatcattagaaactacttttgtttgttcaattggtgctcattatactatcattgaactctgaatcattttagcacattcagttctctctgttacacttaagatgttacatatatcccaagttcaattgactgaagaaaaataaaaagaacgaagcatggttggaacctgcacggtgagatgagattaacaaggaattcagcatgcaggagttctcgcacccacacaattcccagcagaagatctgaactttctaactccgaattgtgcactgcaatttatacattctgattcctcgatcaatcttcgccagcacagcaacagtagtttacatcctctgcatcctcgaccaaatgatccacatttccttaatcatacgctacactaggtaactaagaacatgcaaaaagtgaagataaccagggaggaacacaacaatttcctggttaataattgtagcaagatagcaggaatactcacacccacaattcgcagcaaaatatctcaaacattttaactccaaaattgtgcagtgcaatttatacattctgattcctcgaccaatcttcgccaacacagcaacactagtttacatcctctgcttcctcgaccaaatgatccacattttccttaatcatctgctatacactaggtacctagaatctagtagagtactcgatctcgatggtaatcaagaacacgcccccggcgacgcgctcacggcgagccggcgaagacatcggtgggcgcgagcggcggcgcgtcgagctggtagaggccaatggaggggccgacgaagcggaagaggatccaggcgccgaccatgatgaagatggaggcgtaggcgaacttgttgagccagaagaggagccccttctccccgacgtacagctcgccggccttctccgccatgctcatctcctcccactccttcctcctcgtctgcttctccctgcgcgtcgccgccgaagccgaagccgacgccgacgacttcgacgcagccggcctcgacgacgacgacgacttggatttcatgggatccccaacggcgccggcggagtgaactcctggacgcggcgagcttggttcctcgcgcggaggcggttcttgacgccggtgggcttggcgccggaggaggga

SEQ ID NO: 39965 - DNA, 1946 bp, Oryza sativa
cagatcggcgacatcctccgcgcattgcagtaagctccgaatcttttccgccgtgttctgaaatccgtttctccattttttccatttcaaatttcgatcgcttcgcttgtggtttatgtgtgtttttagtagaggtaatattcattggatctcttgcttgcttgcttgctgtaatgtttgcttatgaaatgcgagcctggaaatcagactgttaacctgcaaaaaataaaaataaaatctttgtagtgtaatgcggcaaaaagacgggtttgacttagatgatagattgataattaatctgcttcatttgtccacagaaatgggttccagaagctggataagatcaaggatgccaatcgacggagcaggcaactcgaagagctcactgataagatgcgggattgcaagaggttatccattcttttcacacatattacgctgcttagtgtagaacagcatcttttgtacagaatgtgggcagttgaaaactatgattacaaatgtgtcacttggaaagagttgagatttggccatagccattgcattactgaattcagtattatacaagttctgatgctgatcagtatctccaaatgcaattgatttttgttcttttgggaaaggatggatctagcagtggcggcatacaatcatacagacatttggttgcttaattttctctgtatacatttttaggcttatcaaggactttgagcgagttgtcaaagatatggcaggaagtaccgtcctgagactgctaggatgcttcatgataggaaacagtcaatggtaccaccgcagaaccttatactatgatataattttatacattcagctttcctgagtcctcaactccctcttaacctgactcttcgtgttttgcagatcaaagaattgaactcctatgttgctttgaagaaacagtgagtttatacctatcccgtgatgtgaaaggctcatattaatggacatgaacctataaggggttgcccttgaactaataatcacttcaccaaattagtctttattataaacttgacagatactgctttggctaacattacatgatacttacatgcaaaagatcgtttggacttcagatatgcaagtgaaaataagcgagttgatctttttgatggcccaagtgttgaagatggctttggtgaagaaaatgtcctgttagcatcaagtaagtagcaactctagggcccttttaagtgcatatggaggtggtctattttttctcaggtgaaatgataagaatattctggcggatatgccatcactagcatgaatatatgcacctctttagatttaatggtcaattatttcttttgtagatatgacaaaccaacagttaatggatcaaggaaaccaactaatggatgagactgatcaagctattgcaagatctaaacaggttatctttactatgttgtgcaagatctagacaagatctaagcaacttgatatatcttcgaaagagaagtgcataatttttttatttcttattggatcaactaggcattttcttgcatttagtatcatgtaatttttctgtgttttgtccctcctataggtacaaaatgtagcttctttcagtttatatatatggcttctaactgagcttgttgcatcattttccaacttagcacgtattgatctttttttgttatttcagttcctttagcttatacaaaaactctttattagggtgtaattttaagtcttacagcaaattgatgtgctctttcccacaaactaagtcacatcattgctttctggcactgatttgttgctgacttctgcagaccgtccaagagaccatcaatgtaggtacagaaactgcagctgctctcaaatcacaggcaggatttctttgttcttctcaaaccagccaatcatgctgtgtaacctggatataccagagctaacttcggttattt

SEQ ID NO: 39966 - DNA, 9075 bp, Oryza sativa
tacactctgtccaggtttctcccttccccgtctctcctctactgctactgctaacctgcgtctccctcgctccccctgcagcgtatggaatggagtatccgacgaccaccaaggtgaggaggttggagcaccaccgcagtgtcagcgactcactcaggccgccgccatctttccagatacaagacctccctgaggtaaaactctaaattggggcgccgggggagacgatctggcacaggcgtggtgtccgtcagggggatcctatctcccctatgatcttcatcctcgccatggattctctgagctccctctttgttaaggtagaagagttggggctcctccagccgctggggatccctcactgggtctccctctatgctgatgacgtggtcgctttcgtcaggccgacggttgccgatttggaggccgccacaacagtgccgcgcatctttggcgaagcttccggtctccacacgaacttcaacaaatgttcggcgcttccgatcaggtgctcggatgatgacctctccttgattcaatcggcgcttccatgtccgctagcttcgtttccttgcacatacctcggcctgcctctttccatcttccgcctcaagaaggaggacctgcagccgtttgtcgacaagatcgctcgctggctcccgcactagcaatatgatcttatgtctccaaccggtcgcatcaccatggtcaattcggtcttaagctcgattccaatctatttgctgattgcccttgatgcacccaagtgggtaattaaaggaattgacaagataaggaggggttttctttgggccggcaaagtcagtacccatggtggcaagtgtcgggtcgcatggggtggtgtttgtgctccaaaatgctacggcgggttgggggtaccggatttggatcgcatgggcatcgccttaagatcgagatgggtctggttgcagcgcacttcgccggataagccatggcacggcctcaacatcccggtttccttgaacgagcgaaactttgcgacggcttcaacagtctgcgttctgggcaatggggagtccattcttttttgggaagacatttggctagagggttcctccattcgctgcattgctccggctgtttgggcggctgtcccggcacgtcttcgccgtcgcaggacggtcgccgaggcccttcaagacaggagatggattagagactgcacaggggcgctgggtttgcaggctattcttgagtaccttcagctctggagcatcctgaggtcctctgtgcggctctctgaccaccccgactcttttatttggaagtgggaagcatcgggagtctactcttcgcgttcggcataccgggcactctttctaggtagggttcctttccaatccgaacccatctggaagaccttcgccccccctccccgagatgccggttctttgcctggttggtcacaaaaaggcgctactagacggcggaccgcctgcgttctagggggttgcctcacccggatagatgtgtcctttgtgatcaacatgaagagactattgatcacatcttggtcgcttgcccagagtctcgccaactttgatgggctgtcctttccagcattggtctaccgcagtgtctccccctgaatgaagactccttttatctctggctttgcaactcccgccttaaagtgggagcggctagcagaaggggatttgacacaattgcaactctaactgcatggacaatctggaaagagagaaacaatagggttttcaactctcagcaaaggccctggtcagagatagcccgagctatggcggcggaagcaactctctggcggttgacacatgcggtgctaccggtgctaatcatttaggtcttggtttaggtcgtttccatatgctggcgtgagaataggcttaagatctttgggtccttctcctatcttcccgtccccctcttattttcttgtttgggttcgtgtaaatactctttatttctcttaatacaaagatgcgcatcttgcgtattcccaaaaaaaactctaaatttccctgacttctctctatccggggtaaaaaaaaaagttcattttttcccctatcatctatcaacacctgccatgccttgcctgcctgtgtgatttttcacatagatgaaacattgggccttattgcacggatgagttctattattatagaatcaaagcacctacaaattgattgagcatgccttcgtttgttttctcttgtaatgacaggatattcagcagcttatagtatcttttatgccactcagagatgcggctagagcgagccttgtgtcaagaaactggagaatgctctggacatgccaccctaatctgtgctttgatggcaccaagcaggagcctactgatgagggtactctcaaaattgaccgatggtacttctctaagacagtaaatcatgttgtccgacgccacaagggaatagggttaaataagttcagcatcaactgtgacctcaacaaggatgaattcaaacatatcgatggcaaaggttatagatgttaacctacaatctcggcacagaaacagatggccaacacggaaacatctgctagaagatgtttaccacttctcacttgatgctttggatgctaagcatgaccctgctcttgagtctttgttcctagctgttgtattaatagaggtacatccaaatatttctggttttaccatgctcaaaaggctcgcgctgcagtatgtaaaaatagtgggggatcttccagacttgctgtcacgatgttctcttcttgaggacttggatatcagtgtgtgcactggcgtgggtgatttggtaataccatgccaacttgacaagcttcaacatctgcggatttggggtacggaggtgcagatgattgaatttcatgtttcctgtcttacgcgttttgggtatagaggggaggcaatctcaatcatgcttcatggttgcccaaaatcagtgaaggcaacaatcgtatttcttgaacttaatcaacttgaccatgtgttcactgtgcttccaagtgctttacctgtcaaggagcttagcttggatttacatatgtacgactatgacctaggacaggtttgtccctttgttccaaggaattcatcttttggtttgcctttttgtatatttgtttgcttgcttggtagactgccttaccatttgtttggttgtctttcaggttcatacattgacaagaccactgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactccttccaagatataaggggggtccgggcgcctctaggggcatatgctgatgttcccgaatcatacaatcaataatacactcggcggattcatccccggacaggagtagggattacttcttttataagaaggcctgaacctgtataaatcctttgtctccaaacccatacactttccaagcttgatagccacccccttttattattgtcgaaatctagtttcgacagttggcgcgccaggtaggggtagcgtcaagcttttcgccgatcagtgcaatgggttccgtcaccggcatcgacgacctcgtcttcccacccgggcagacgtttcggttcggcagcctcgacttcgtcaccaacaacttcggcaagatttctctccttgactcggaatcagaccagtcgggagagaatcgacttccagttccgtttggattcccaaacgcggcagaaagttgcttcaagaccatctcgatcgagtcggcttcaaaccactcggccgagatcgcatctactccaacaacgccagatcaagacgatgagccttacccatcgatcttgatgcagctccctgacgattcggcagccgtctccaccaccacgccgtctccatcccgtaggcctaggcggaagtcggtcttaacaccgatttcgcctagcttcagggaagtcggcgtcatcctccaaccactcggcacggtttcaacggaccaactggatggctactacagctctcccaccgtcgactcacgtcccaccgaaatcgtggaatacgatgagttcggttctcgctactacgacgacgtggatcttgacgacttcgacggaagcctagaagacaactacactcctcttttcttcggcgtctttatggccgacaatgaaacggaggagcagcgccaagcccgggaagccgaagcacgttgcgagaccgagcgccgccgactggagcaggagcgccaagcacaagagcaagagcgactacgccgggagcagcaggagcatgagcggaacgcgaaggaggctgaagaccgacggcagcgaaccttggaagctgggcgccgagcgcgtgatctcatcggccagcaagatgttgaagggataccggttttccgtacccctcagcagaatgcggttgccgcgatcaccctcctcgacaccctcctcaaggaaaacgagcacaaccaatctgatcatgtcgtcaacatcctgaaccagaccaagaccatgattgcggcctcggttccagttaactccgaaagcgtccacacgccgactggtagccgagttccacacttccgatctcaggactaccgtcatccaagcctcagcatcaccggcgcaggatccaatcgcaggagcaggggtcacgacgagcggtccgcgcactcgcctcccgactaccgtggggagcgccgagtagaacggccacgttcaccgcctcgtcgccgccccatcgatcttcgcgacacaatcatgcagcgccgagcagctcgaggccgtcaccactcgccagaccgctacgacgacgaccttgatggggtagcagccttcaccgacgacctgcgtcgagtggattggccagccggcttcaaaccgactggaatagagaagtacgacggtaccactaacccagaatcgtggcttaccgtctacggtctcgcaatccgcgcagcaggaggtgacaacaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacgcaatatgatctttacaacgtcattcagaagtccggagaatcccttcgagattacatccggcgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagattatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaagagctcaaccatattttcggcggccccatggcttatgagtctaaacggaagcagaagttgactgaacgggagatcaacgctgttcagcccgacacgccccaatatcttcgatggtcagagattgcaatcaagtttgaccgctcggatcatcctgaccgagtggtccacccggggcggtaccccctggtactagacccagtagtccgcaacgtcaagcttcgcagaaccctcattgatggcggcagtgcgctcaatatcctcttcgccaagactttggatgatatgcagatccctcgctccgagttaaaatcaagcaatgcgccttttcatggagtaattccaggattatccgcaactccactcggccagatcactcttccggtcacttttggcactcgggaaaacttccgcacagagaatatcagctttgaagttgccgatttcgagacagcataccatgccatactcggacgcccggcgttagccaagttcatggccgtcccgcactacacgtacatgatgatgaagatgcctggtccccgaggagtcctaaccctacggagcgacatcaagcaagctgtcacatgcgacaaggagagttgcgacatggcccaaacccgcgagatagtgtctgcccgagaggaaatccgactggctgcaaccacggtgagcgaaggagaagtgcccgctgccaagatttcaaaaagtggggaagccgaagccgagactaaaaagattcccttagatccttctgatcctactaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcctgactggctggcaaacccggttctagttcggaagaaaacagggcaatggcgcatgtgtgtcgattataccgacctcaacaagttttgtcccaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggattaaaaaacgcaggagcaacttatcaacgcatgatccagagatgcttttcaacacagatcggccgcaacgttgaagcctatgtggatgatgtagtcgtcaagaccaagcaaaaggatgatttaattttggatctagaagaaaccttcgcgagcatccgcgctttcaggatgaaattaaaccctgaaaagtgcaccttcggagtaccgtcagggaagctgcttggttttatggtgtctcgtaggggcatccaggccaacccggagaaagttactgctatcctcaacatgaaaccgccaagtacccagaaagatgttcagaagctgactggatgcatggcggcgctcagccgatttgtttcaagacttggcgagcgggggatgcccttctttaagctgctgaagaaaacagataacttccagtggggacccgaagcacagaaggccttcgaagatttcaaacaactcctcaccaagccaccggtcttagcttcaccacacccgcaggagccgttgttgctgtatgtatcaccaccccccaggttgtgagcacagtcttggtcgtcgagcgtgaggaagaaggccatgtccagaaagttcagcgaccaatctacttcgtcagcgaggtcctgaccgattccaaaacgaggtaccctcaggttcagaagctgttatatggtattttaattactaccaggaagctgtctcattactttcaaggtcactcggtaacggtggtcacatcatttccactcggcgatgttctgcacaatcgcgaagcaaatgggcggattgctaagtgggctttggagttgatgtctttggacatatcattcaagccccgcacttcaatcaagtctcaagcgttagctgattttgttgccgagtggaccgagtgccaagaggatacccccgtggagaaaatagagcactggaccatgcattttgacgggtcaaaaagactttcgggcactggagctggagtggttttaatttccccgactggagaaagactaagttatgtgctttggatacatttttcggcgtctcacaacgtcgccgagtatgaggcgctccttcatgggctacggattgcaatttccctagggataaagcgtctaatagttcgaggcgattcgcagctggttgtcaaccaagttatgaaagagtggtcctgccttgatgacaatatgatggcatatcgacaagaggtacgcaagttggaagacaagttcgatggactcgagctcagtcacgttcttcgacacaacaatgaagccgccgacagacttgccaactttggatccaagcgtgaggcggcgccctctgatgttttcgtcgaacacctttatacgccgacggtacctcacaaagataccactcaagttgcgggcactcatgatgtcgctacggttgaagccgactggcgagagcccttcatacgatttttaacttctcaagagctccctcaagataaagatgaagccgagcggatttcaaggcggagcaaactttatgttatgcatgaagctgaattatacaagaaaagcccttcaggaattctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtctgacgccgacagaattgtgcgcacatgtgaaggttgccaatttttcgccagacaaattcacttaccagctcaagagttgcaaactatcccgctgtcttggccgtttgcggtttgggggctcgacatggttggcccgtttaaaaaggcagtcggcggttacacgcacctcttcgtggccattgacaaattttccaagtggatcgaagcta

SEQ ID NO: 39967 - DNA, 885 bp, Oryza sativa
agcgtgaggtggtctttgttctttacctgaagacccagctatcgagtcgttaccagcttctggtccttgcgaagtcgtcgtctgcgcttctacctcggggatctcttgatcagggcctgcgtccgactggtttccagtcgggggctcttgagttgttgccgtttcagttgttgccgactggtttccagtcggcggcaggtcactcggattggccctatcgcccgaagcatgggcgccagtcggctggctttcagcggtcggctggttttcagcagtcggctcggggtccttggatatattttgctctgtcatggcaggatcggggtcttttccagatggatctatatcagatggtttcctgcagagtgttctttcagtatttggcattatcttcatcggaaaacatgccgaagcggaaatcataccgagagatctaatacctggaagatgttctgatctttggcattgcacggccagccaattttttcctgggcatggtgcgctttgggggtttattaggcaagcccttatccccagatttatcatcgtcgccttcatcatcatcgagtaccagctttctcttgcgaggacctgtttgaccagtcaatttggaggtctgaggttgcggatctggtctgatcgttggccctccacctccctgcgcggtgtgttggcgaggagaccggcgctgagtgactggtggatctgacttcatcaatgcatatccctgaacaagatgcttccatagttagtcaactcagcatgaagataaaattatgttctgatcacggtttgagggtttccgatgtatacctgtggaggcggattgaatgcattatatggcacaactggcaattgatgagagtagctgactacaattgcatt

SEQ ID NO: 39968 - DNA, 3033 bp, Oryza sativa
ctgtgacccgagagatatttttgattttatcccttccttgtacctgaatttataccccagcagctccgagtccttttctttcacggttgatcgccaaaacagatccacatcaatgatatctttggtgtgacccctgtagaacttgccgtaccagaatttgacaacaggcgtaattctaccaaacttcatatccgccctcctcctcggattaggattccattgtcccatgataagcctccatcctgcccgatgtcgaaaagcattaggccagatccaaccagaaccagcacgattaacctgatcaccaacccaattacagatcgcagacgtgacctccgcagactttctgagcagatcggagagaacctccatccagatcctcctttcatgggaggagaaggctgccgcaacccagtcgcctgggtgccgcccagaccctaactcacgccaaaacatgtttgtacaagttaaaggcaacttgaaaacaatataggagtatatgaccaccaatcaaacttaaatcactgaaatatcgcttacctttcatacattcatcagttgtctggataagagtggataaaaagaaaacctaataaatgttaatgtgatgaatttgatgacaatgaccccgagttattttttcaaaacacggaagatgctcacatacattgatgcacatacacgcgcaccacctataaccataccggagagactgtcatttctcaatattgacaaatttattaccacagatagcaacaataaaatttaaaaaataattaatcgtaaatacgagcacgtgcatcagatataaaacttaataaaaacttagattgatagagttacagttttttttaaccccgcagtgtatacttgtattaaaggagaggaagccactgtatagtagccttgaggctaagagttaccgttctagtcaggggcggatccagcgtggggcggcggggtctcgagcctccactactactgatgtaaagactatgagagcccccacaaagaccccactaaaattttttaccatatataactttatctagtttgtttagacctcattgctatttctttattgatccgccactgattctagttcatgacaccataagttatcgatgtgatccgccactgattctagttcatgacagcataagttatggatcacatcgataaaaacatatgccggtttagttctcaaccgctgtactaattctttagctggtttcaaacaaaataggacaagcatataaagatgcgatggaatttgaaaacataagatgccaagtggcatatctctactgttttgccagtttgtccacgagccaaaagaaggctccaatgagaattcccccgtacatgccggggtggcgccacatgacaatgactgacaggctggccccacgtcctacctggctggccccacccctgctctttctctttctcttcttccctttcgtcttcgtcttcgtcgtcgtcgactcgtcgtggccgccggcaactcacgcccaccgcgcgcgcgcgcgaattaatacaaacacattaacacacacagagagagaaaattggcgcgcctcgcgctgtgcgccttcgaattttggaggcgacgcgcgggaggacggaatcggccggggattcgctgcgtcgccgcgcgagagcgagaggaggaggaggaggaggaagccgggatgggggtgtcggacaacacggtggggctttcgctggcggtggcgtccagcgccttcatcggcgccagcttcatcctcaagaagatcggactcatccgcgccggcaagggcggcgtccgcgcaggtcatctctctctttgctttgctgcctcattctcaggtcaaccgttgtttgcttcttgggattggtcgccgcctagctcaattggtcgcacggcatctcgcttagtttgacgacgcccgcatctcaatcccttctctggggaataatcgaacactttggtggatcttgattcgtatgcagcaacacctggaattatggattacgcagagcatttttgcaattggatcccatcctgtcctgatgattagggtggtttttttgtttgacaaatcgttgcttacctgcgccgccgcgattgggtggcggctgctgttgctccgcttctagatcttgacgaggctgcggttggttagtccaagtcgtaagcctgctcgtgcgtgcaaatcagcatcgcggtcgtcgccattgtcgctgtcttctagatgcaaacggaaactcttgctgtttcgtcttggaagaccttgtcaattcaaatgcttttgggtcggatctctaaaatttgaacccagatatcttgactttcagatgccgtgctccctatttatccccctgcgttcaattaccatggttggcattttggcaatgtaaaagcaaatgtttttttttactgtttcatctccgttgccaatctaaacatggattctttttctttttctttttttttacttactctgatgactctttgtgggtaattgccctcccatttcatcttacctgcttcttttctaacacattacaggtggtggaggatacacttatcttttggaacctctatggtgggctggaatgatgacaagtatgctcactctacacagcatttacagttagcttaattaaacttgacaatgcagctgaatgtcatctctgttgattgcacaagtgttgcttggggagatagcaaacttcgttgcttatacctttgcaccagccgtacttgtgactccccttggggcactaagcataatcgtaaggtgatttttttcaaaccaaagccttaagttcagtagtcagcactatctttgattctcctatatatggttgacatacattttgttttttttctccaatttggacagttcatttttagcacatttcgtgctgaaggaacggcttgagaagctaggtgttcttggttgtgtatcatgcattgtcggttcagttattgttgttatacatgctcctcaagaacatatgcctaattctgtagaggaaatc

SEQ ID NO: 39969 - DNA, 6496 bp, Oryza sativa
acacacatggctttttgttatcattgcaatcatctgtgtggtttctcagataaattacctcaataaggtaacacattttcctggctaccaattacttggtgcaagtatgttttgctcgattgcttcctcatgatctatttttcagtttttgaaaatctttgaaaaataaatttgttttttttaccacaaatgctaaaaaaccttgagtggtgcaatgtttctgtgctattctgatcattcagtgtatctcacttttcatgtaatcatgattttttttcccactttgcaggcactggatacctttgatttagctgttgtttctccaatttattatgtaatgtttacgactcttacaatagtggcaagtggaattatgttcaaggtagaaacaaatatttaaggtttagttaattgagactgatcccttggatggggctcacgacttaattcatcttactatcaaatgcaggactgggctggtcaaagcttcagtagcattgcttctgaattttgtggtctgataacaattcttaccggaacaattatgttacacacagcaaaggaggaagaaacaggcagttctgcaggtatcccctgttccttgttttaccttacatggcacttgtcagaaagaaaaaaaactgtgtgcaactggatcatttaaaccctctatttcatgaaagaaatgataaataagggctttcctgcaagtacttaacatcttatgtcattccaaattttcctaagctatcattttctgctgacaattgtgtgcggaatgacaatattgctctatttaaagccagccctaaggccctgttgaatcagttctctcgggaaatcttacttaagaaatactccctcggttgattttcatactaatcagccagccctaaggtctggaccaaaatttattgtctaaaaatcataccaatatactccctccggtttcataattcttaacgttttggacaagttttttgtcaaacttttataactttgactaacaataacttaaatatatttatttttaaggtactaaaacaacatatatagtttgccttacaaaatgctataatgaaaataaaaaaaatatgtatttattgtacatattaatataaaaatatagtcaaagatatatttcaagatcgtgttattgtctaaaacgtcaagaattatgaaaccggagggagtactcatattgtatgggtattcaatggtcaaagtttattctcaaaaagacaatgacttttaaataagatacaccttacaaaaatcgcgacggaggtagtacgctttagaccttttcctattttggagctcactggagccttgatttttcttttcctccctaagctgtagaacagaactatcatatgctaagatttgtgtgtattttcaatagattattgtagcacatggtttaaattttgaactgagtatgctttccttattttgtttcagctttgccatggcctttggatagagggtccatatcctggtgtatcagtttagggagcgacaatctactgaagaatgtcaatgaggactactttgcagctctgcaaagttctcctgcgccagtttaattgtacatttggaagtaatttccttttacttccattgacgaagaaacttatagagtgatgtacaaaatatcatgcaaattgcacaggaaccttagcagtgccaacattctggcagttttgttgtagaagattttatctgacattctttcactgtacataaggacttgtaaaatttgtgaaaccattcttggaaccacacgatgttaggaaattcttggaaccagattgtcccagttacctaatctgtttgtttgacagtgagcgagcagaattgctcgctgaatgttgtgcagtatgaatcagaaaagtgaagtatggtgcatgggcagcatggctgctgtcgtcagaaagtgaaataagatcttcaggattcgtttgaatctcgcttattttactgattcgatttacaacctcatcttttcgcttatacttatacttatcggtcaaaatttaaattttcaaccttaaatttggagttgattttggagttttttcatcgaagtttatttttcaacttttgcttttagttcgccaagaacacatatataaaagttttattcacattatttttcgtttgtaaataagccaaacgatggggccattaatttccatctaagttattttgcgtagtcctgatttgtttatacttgcaaaaggcatagtcatgatttatttatactggtaaaaagataaaggtggtgaatgcccatccgaccattcccatatgtaatgaattgttcccatatttcacaccatcactttttttcacttatatggtgaagagtcgctagtcaattttattagtttgtttttcatcaggaacggcggagagtcgccggtcaattttattagattaggagagcaaagtagtacaaatataacacaaggtgccacgagacttagaacaacaaagcaaatcaaatctagggaatacatcgttcccgtggagactacacaaactgtatggctaaatgactataataagttacaaagtgcaaggtgaaatttcgtttataactgtcttgcttcgtgcactgccacatggctagtacggcccattactaagtagtgatttctaccgctgcctgaaaatatgcatacattcattccttcttgatttagcaagatacaattataagtttcctcatggcgatctactaggcaaatccatcgtcccttgtgaatagaggacttcagagcgtcgataaaccggcatccaaatttagagagtaaaaacacatatgcttaatagggttcctttaccgtgtgtcgaatgtttgattcggccaccccattactacggattgttggccgtcaaccatatttcctaactagttaatcacatgaggaacaccataacaattctcaccatgttcaaaaactagaatgaattctcacctatcagagcaggtttaataatatcatcaacttgctggctataaaacaaccacatcatctatatcccgttagtataggttgctcatataactacggagtaacaactaatatattttttaattgatatgggtcccactaattactgcattctttaccattgttccaaccatgaaccaatctccattaggcttatttctctttcttcattgtaccgcgtgctacagctggcgataattctatcgtcgactcgtgttctctctctaccattccatcttctagcacaacagtgaagctgacatgataacactatcgtaggtccaggttggcctactagacatgctctcatatatcatcaatattttggaaagatcaaaagaaatttgccaaatttactgctttgtgatgggtgtatttagttcaagctaaaattggaagtttggttgaaattggaacgatgtgccgaaaaaatttaaaagtttgtgtgtgtagaaaagttttgatgtgatgaaaaagttggaagtttgaagaaaaagttcagaactagactcggccacagtggccacagtgtgttggctgtcctaaagcaaaacacatgaatcagtgttttgactcatttctccctttgtaaaaaaaaaaacacaactacagaagagagagagagagagagagagagaggggaagcgtcaacctcccgaatccatcgccgccgccgccgccgccggcgatgtctccgccggccgacaccgccgcgctcgcctccacgtccggcgccccgctcgcgcccctcgtcgccgcccagctcaacttcgtcctctcccaagccaacctccccatcagggtgggtacccccgcgcactgcttctctcctcctccgctcccgcctcacccccgctctctccttccttgcaggtggggcagatctggtccggatgccgcgacggccgctacgccgatcgcttcacgctcgccatccccttctgcctcgactacgtctactgtaaaccctcccgctcgctggctccaatggtttagggtttcatgtctctgatgattctgcaatcgcaggggacttcctgtacaatgcgctgtcgccgaaggtggcgccggatgtggtgttcggcccggacgacgaggggtttcagccgctagtcgatttcgatgagaccgggagtggggagaagagctgcttggcaaattgggattgccgggacacctcggccctcctctctctcatcaaagagctccggtaaggataactctgtatgctagcgatgttgctccttagttgcttactgtaatcgcgcttcgcgtgtgtgatgattggagtcagttggagctgagagttgcaaacgcaagggaattgtacgcgacggcgattgcatatgcctttattgtggatgatatattgggatcctggattgtcagtgtggaaaaaatgttctggaagttttgatcctaaactcgcttttaaactggttgctcttcacttgattttggtgcagtgaattttatattgaataccaaaagaagcgggcagccgaggttgatgacgcaagactgaaatttgaaataagcacagttctgtctaaggaggtaatgcactacattcagcacatcttccttcctatgggcattatgattatctaattaatgcaccgagcgtatatattttttaagtagaagactagcagttattctggaatattaatatcccaagaagaaccatgtattcgtaactcataattggttgatccattctacagcttatcgcctcttatttttgcctatttaactttcttgttttatgataatcgatggttcagtaacaactttttaaaatggacacattgaacaggggattgaagtctgcacggtatcgtccaatggtagagtaagtttactagtttccatatctgttctttcatgaaaattgatgtttgctcttacttatttttaatatattcacttatagccagatgaggtgaaatttgctgtcccacttctggatctggaccttgccaaactggttcctggatgtccttggaaacttcctcaaaagatccatttgcaggttaacttctaatgccattccttccatgggcatagttaaaatggtagcagtgatgatgacgaggaatccattcagcaaatttttagctggttatgatctgttgaaatttgaaatgcactaaagtaatgattgtaggaaggcctttcgtccatatcttattctggaacagcacttggtaaatctcatgtagcaaagatagtttccatcttctctaacaagatagtacacacagacggactgtctctctgttattatggttactcctgctctagaatagtcccatcgttgcatattatactgggcaaagcacaacaccagtacatgaaattcaaattgatcataagttttcctgaaaataaggatgtaaatttcacgcttaacaatcccttatatgtattaacatattttagaaatgagtgtcttggttgttatgggatctcacttggatgttaaagtagaaatacatgatgtgattatcaagtactcaatatgcacgctgcaaaaagagaagtactaaatatgcaaatgaactgaaaattctttatggaaacttcccaatcagtgccagcatatattaatttagaaatactccctctgtcccaaaatataagtatttttggacttcaacatggtctttaagatgctactttgaccaataatatctacaaaagtaagatgttttaactaaaaagaattgtatattatgatagtttgtttaatgatatatctagtaatatcaaatatacatgatcaatcttttttttttgttattaatagtcaaaatttaaaaagtttgacttgacactattctaaaaatgcttatattttgggaccgagggagtatatgatatgattggcaagggtttaaaacgaaaataaacttggtaaacttctagcaaagaaaaaaaaggttgcaatacacatcctgtgcttctgtggggcacaactgttcactgtatgtctgtatctatagtttgtacaatcttatggaacctattacttttctattgtgttgaaaatgtgttggttgctatgcaggctgtttttccaattagcagaagttactcctctgttccttctgcaccacgactcaaattagtctcaaccccagatttgaagtcatttttctcagttgatgatgttaaactccctccatggttagatggaatgtaagcttgccagacttgcacatgaagattgtctctcattgcatatattatatgtcagcacaaaccacacatatttgccagtgtttttcttcttctgttacaacatttcaaagaagtaaagtaactgtcgctgatgtgtgcttcctttcttggcctgaattgtgaaggtgcatggctgagtatcttcctaacttggaagaaaatcttaaaatccaggtactatagctttaagttttgcatgtaactgttggtcttgactgcctgctctt

SEQ ID NO: 39970 - DNA, 1007 bp, Oryza sativa
agatctgatgctattgttgaatgtttaggtgattcaagcaagaaaaatttcctgtatttcaatcttattatttagtggaagtacctttatgcataaaatgtacatcctttcccattattttaagcatactagacttactggaaactagctactactgaatcatttatcagttagatgaggtattgctaaaggtagcatggcatagcattaatcgtgcaactcgtgtctgttatacaaaacttatgtttctaatctataccgaaggttgtggaagcatcagcttcaattggttctagaagacgtttcattgaagcattggctcctacttttggaaggccattagaggctgatccggtacttgtttgccattgttttcgtatgttattgtctgctttgccaaattgtctaccaacctgtccacacttcagattttttgcagaaaagctacgattctttccatctcagggattttcacttttctggtatgtcataaaatttgtgaatctagtgctttctctgtttttccattacatgactgctatctgttttccaatctgaccagcgatctgatacagctttagaactgtaatgaaaaagtactagtggaatatgactttaattttctaccagttagtatattactaacaatatatatcatgtaactgctgcaggtccactttgtcattcccctccaattccctaagcatcaacctgtgctgacattagagagttctcaggtatttatttggtttgtcactgcttattgctagttgtaacttacatgctcaatagaggtcttgttgttgatatcagcatttagagctgggagtcagtagaagtgacaaggatgatacctatagcccatctacccaaacaaaacacacagaaacacagacacatcgtttttcttttttggagatcctatggggaggcaaaaatcagaccaacagctgttatactattccacttcatttcaccccttccaattcacctctctaatggatggg

SEQ ID NO: 39971 - DNA, 7149 bp, Oryza sativa
tacacaagatagtctatcaccatggcacaatgcatttgtcctttttttcagcaaaaacacaatgcatttgtcttgttgtaagaaaaaaactatggccttcgctttgtccacctgctgcttcttttgccgtacacaaaaggatgctctccgtatcccctccatcatctctaccactgttcatgctttgtactaacaccattggctgtttcaatcatctttagttttattctatttctcccgatgtgttgaacccaataattggtgatttttcgaaggaaaaagtagttggtgccgtcgataaaccactcgattcgactgtgtctcatgtgcacttctagaggtcaataaaactattggcaaatatagagcatccctctttattctttcattttagatacggcgagatggtatactattagagtatgttcttactatatgaattgatgatattctgttctcaccttttcttaaaagaaaattctttccttaccttgatcgcccaagaatgttttactgtgagtagatgtttgcttattttacctcttatgaatagggaaagagaaggcatgaagagaatatagtacataaagaaaggaagaaacatatggatggatgacgaggtcttcattgtcagcttgttgacttattagccgcaaccaaaatttgaattttgaaagttattttgggtttttctaccatatatagtctatttttcagccttatttttaaaattgctaataatataaatataaaaaaatcataaattatttatgtttgtcattcattttttgacagcttattcagctatagttcaaccggtcatagccttaaattttgggttcaacatcattctagttcctaatttcacatgcttaatcgatgatgaacactaatgaataatgaagtgtagcttgtagaatgacatctctgaggacaagtatgctgccacatcaatggcctagggttttaatagcagctatggagagatccaaatcgaacacaactttcaaaaagaaaaatcaagcacgattctatttcattctccacattacatggagttctgacctacgcacacatacacatctctctttccctattgatcaccaaaagtgacctaccactaactagctgctagtactagagtatcaattcttgcttaattatttgtgaaaacttaatttggtgccactagctagatctggattggatttctccgaatttcgggaatgatctggattggatttctccgaatttcgggaatgctaaaaactatacacctctcataaacatgatgaccgcatagcactctgatcagtttgatttacttttacttttcactgcacgttgagatgaaaaaaaaaatctaatctggcatgttcagtggatcataataagaggtagttttgcaattaactaaaacatgtatcaatccgttatattttgggatggtgggagtaattagcaaggggagaaaatcaccaagaaaataaattaaactagattatctgtctgaatcttctgaatgtgtacggtacatgtgtgtgtgatctgcaatgcttctcagtttctcgtactgcctgtccttttggccaaacaacgtgtcctttgcttgttcatatccatccccttctccatttcctactgcggcgccgccctccctactaccatctcgagattcttctctcactctctctcatctcatctctgacagtgccaggtctatctgccacaagaagctctgacaactgttgcactactgccttcgtgatgaacggataatggattaaaccggacgtttttcaaactaaacaatattacaaatccattttccaacttcctataataattatcataaataagctatttagccattcgttcattctcggtttctgtttcaccaacaactttcaccaactaaaaactctgaatgtgttggaatgcattgggtagtgctggcgcctgtcgatcagtaggcgatttattgtcctagtaagttttcttttagagaataacgatgagtagcactaacagctggagtagctagcttagcactaagtaaattctgatgattgttgtttagtactgagagtggacaaaaccaagaaagtaagctagaatcctagaagagatgaaagaaaaaaaaaacaacatttgctatctagctagttagctggccctctttgttcttgtctatggagctaggttctttttctccactcttttggaagccaacatatagatagacatgtttaatttgtttctgaaatttcatatatttttttcatccctataccatatatgaatcttgatcaacaaccattaggaaaaggatgttctttctgaatagaaaaaggatgctctttctgaatagaaagagaatactaccaaccatatatatcatctcaaaaaattgaaaaaaaaacggaattcacaaataaagaaaaagaagaaagggaacatcttttgttttgattgaacagatcctttgatctccattttcatcatcatcatcatcacaatctaacttaactaggagagagagagagagagagagagagagtcctataaggatgaacagagaacaacccgcagctgcatgacagatctgctcatgcatgcatgatcctttttgatcatcatcacaaaccatgactaaattcctaaccaaaaggaaattaaaaccctaagtattattaatccatcgatctaagagagagagaagctagccaaagaaacaccatgcatcatcatctgatgatcatctcaatcaggccctgaagcaggcggcgatgtggaagttgttgtggtgtcccgacgagccgtggccggagaggaggccgccggcgccggcgccgccggcgccatgggagccgccgtggtggtgcttctggtggtggatgatgccctggacgcggcggaagtggtcgacgccgcaggggatggtgatggcgcccttctgctcgaacccgaactcctcctcggcctccttgaggagccccacgaacagcgggtgcttcagataacccaccggcaccacgaacctctctccctccgctcctcctccgccgccgcccacgccgccgggccccaccaccctcaccgccatgcaccccttcggcggcatccctccccccgccgacgagccccccgccgacgccgatgactgctgcctcttcagcaagtgcacacccatccttctacctatatagatatgactatatctaatcgaagaaacgctagcttggtcgatcgatctctagctccgacgacgagcaagaacgcgccgccgttagagcggcgggatctccatggcggccggtgaggtggcctcgctagcttgatggtttcttggctcgaggaggagttggtggaggaggagagcgtagggtgcgcgtgtatatgaggaggccggtgactgcgcccttttgtttctatctgtgaattttttttttactcttttttactatttatgatttattgatttcctttttcttctactgtttcttttcctgcagctgctgattttcctggtgagaaataaatgtcatatctctccccataaatattactccaccatttcaggagtgatattaattaatccagaaataattatttatcttagctttctctttgggatgtttaaaagaaatgtgttttttttttgtgtgtagctagctgttggagatagagcaaggcactaactctacagctttgtattagctacagcggagagggcatctgatccctccgtagagtgtagctggccagtatgccctggtgttgcctaggctttgtgtgcttacaagtgtcagtgagaacaccatgtgtttgagatttgagaatgtggtaccatacatattagaattagttagaatcaatttaccatgttgtatattaactctattattcaaagcaaaatatttatatctttttttactgtaggtaatatctatatcttatagcttcgttaattcgaagtaattcatacatttattatacccacctacacctacctcggcctggtagtaacggatatctctatctctcactagagatgttgccggtcaactttaggagacatctgtggttcctataaacgacataggaaagatagaatttcgtgtatgctactgtcacatattacaccaaacgctcgctcattgtatctgtgcagtctctcacaaacgacataagtagtgatctggcaagcataaaaaaatttaaagcctagcaaaatacgcaatggaagtctctagacgccgatgaccaaggtcgcaggccttaaatctatccaaggcgatagaatacatgtggtatacatattgcttgcaatctgcataacccatggtatatatacatgttacatgcaaccaaaagctcatacccgtgtgtaatttactatattgccttgttatatggactcatatgttatccaaagaaaaatatgtaacattattttgttgtggtaggtagatactatttttatttgctttgcatggttaattctaagtaatatgaatattcattttatatatccattatattatctctatgtgttggtagacaaatcatcaataaacttacaaagatatttacaggttatagatgatggaagaaagataagatttcatgagtgttatcgtcatatattacacctaacactcaacgtgtagtgtgtgtatcctcaacataggcggtgatatggcaagcccaaaattttattaaaaactactagaatatatacacaatatctctactaccttaatagcgaagtcgtcttccttctctcccctccttccaccgtgcacacgtgtaacatatgtacgtaatcaccagatccaatgttttatctcccaatctatcacacttatagcccatctctacttacatgagactgacctattacaacttatgagcacgttactcctaatcgtgagtgtctaagaatactggttgataaggttactaggcttaagtccgtctcatgagatggtacatggatccaatgtacagaaaatatatgtgtgatcctctgtataacaccatgatgtaagtgttacatatgcagccataagcgcagaattttatatttgcagtctactttaaccatgtatgagtgcaccacggtcgtagcaataactagcaatattcctggatgcatatatattttggatatacatatagaatatcatatcctctagttcttcatgtagattgttacatactctctgtttttaatagattgtgttgttaatttatatatatatatatatatatatttgaccattcgtcataattattattacttttgttaagacttagtttattactaaaggtattttatgcatgacttatattttatatattcgcataaatcttttgaataaaactgacgatcaaatatatgtctagaaatcaacgacgccatctttttaaaactagagaaagtatatatttatagctagctgatagttaaattatgtacataggtgacaaagcaaattacaatgcagactagttatgacctatgaccatatatatattggcaataattgacccatacaaaatttgctagctaacctgcatgactacaaatgattgcatgtttttcttgattaattccactctaatggcagtccatatgtttactcagtagggacatgcagatgcaggcagaggaggacggagctgaagccacggattcgatctcatcaacaagtaaggacagcaaggacaaattggaaaagaagcaggtttgttatgtcccgacacaattaatgttttggcaccgttgatttctttttcttcttaaatggcttcttttgggactcaatgcatcatttccaacggctcgtgaaccggctgatgaaggctacctttgattctttgatgtggtagaggctatatagagcactagctagctgcagtgcttctgctactttcaacactaataatgagctttatgtattcgttctcttctgccaataaactgttgcataatgctagtgctaatctagcatcaatacagagcatattaacttgtctttgccgacataagtatgaaatttgttcttgtcgatagggacaccttctccaactctctgaatataaacactgcatcatgcaggaaaacctttcagactctgcacacaggtagtccaaattagttagatgtttgctgtaaccatcagttcctccacaacagaatgaaactgtgagaatatgatgcaggatgatttcaaatcatatttttgcatttactgaaaaagaactccaaactagaaatacattgaaggaaagatggaatcctgaattgtactgcaggccaccgtgcacaccaacaacattagtatggtcggcttggaggtcactcacaatcactttgctttgctttgctttggctccaataatttagccaaagttatctgcatagagaaagctaaggtttttccatggtgggtggtagtcaaacatccagccctcccctcatgcggcctccattattataaagcctcagtgacaacaaaatggaattattctcttcaggatgtggactttggaactgtatagcataaagtcttttttgtcaatgcacacctctttcgtttgcgaaatttgtcaagtacagaaagtacacagaggactactatggccggcttaccgtacagaattcagaagagggatcaaaacaacgttgcgtttgtcttcatgaaagtaaattgcagggatgctaattaaattgtaattgagtggttattacttatggattggcgaaaccgtgaaaatgaaatttgctctctggttatctatagcatataagatgcttatttttactgtagcatatccggaaatatttttatcccaataattctggctgaagatacaaatctctaaagatgctagcagcttctgaactcaatccatatctgaattctgaagatcttgcttgcacagtactacaatatacatccctaaaactttggggacaaaaatctgcaggcttaatttgaaagattgccagaaaggacaattgcgatatggtagcaaaagggagatcaatctaataatgagcaagggtattaagcatggaatgggacctgaccattgtcaccatggatggtgccggtcttcgcctttgatctgaacttt

SEQ ID NO: 39972 - DNA, 2309 bp, Oryza sativa
aaatatgatcatacatgatatctctgcatgatcaggtgtgcattcttgtctgactaatattggatggttaataaaccgttgtaaaaaccttggaattattccatcctcttttggacagacactgcaaatggaacgttgaggtgtgggatcatgatgatgctatagctaattaagcatgtagtaattcaatctctctatcaattgtggatcatatttcagaagttcagagagggtagggtacctaactacctactagtagaagaaatggtaacaagtctgaatctcaaatctgaatcagtaccttctgtagatcggattgcccattctgaacttgaagcttggtgcatcgatcgatcatttagagatctgattgacctgtgttcattcaacagaatccaattttttttttagactggtctgcagaatccagatttgagcgaacgaaatcaagaaacgtaagagcctgaatgcaaacatgagaaaatactggacgagatccgattgatatttctcgaaaaaaaaaggaaaagatcggaagcaatgatgcatagagctccagagaaagcggcgacggcggcgctcggagtggcgccgttgcaagtcacccgttgcgctgacggctgggacccacgtgtcagcgttaccatgcccacgcgggttcggtgaggaaaactccgacctcccctggatctctgtgagacgtccgatcaaggatgtgcggtagagattagataggagacaaaattttcacattggtcctttgcgtatcatgaatttccgcctttttcatatgggccttgaaaatcggggtaactcgatccatttacgaggcatttgggcctgaatggttaaacgggccaaatttactaaaggcctcaaggggatagacaagaaaactaagaacccttcggatattttttttatcgcaaacgcgtaaaagaattgcacgttaatatattagaagaaaaaagagttttagttacacaatgcaatcaggttcagataagggcggcatgcccatgcccatgctcgttaggttctgataagtacgtagacgaacataacagacacattttacagactaattaacatgtatgcaaatctggtttcatttttgtgtatatacacacacattctttttgggccgaagtctttaggtgggccggattaactcaatggctaaatcggagagctagatggtgatccgaggggattaggagaaaaaaactccgaccctttggatctcagtgagacgtccgatcaaggatgtgcggcacagattatcgcgtcagtccttcctcttctttttagctgggccaggcaaatcgatccataccacaaggattttgggcccgacggttaaatgggccgaatttacttcggggcttcatttcaaaactgccgagatcaagaggttcggaaaataaaactccgaacccccttgcagaagaaaatcggtcgcgtgtttaaacattgatcggcttccgtttgtaattcggcgaaaacatattcgagaaatcgaaggcaaatgaatccgagaaatctaagggggtagaaatcaagcaagggaaaaggatcaatatatacaatctgcaggaaatggagaacgccataggggatacggagacgaaaactccgaacctatttggataaactgcaaatttacgtatttacatcagcaaatcgtcttacattaattaacgacgtcggcaccattttctgtaagccgtacatgtgcaaattaataaatctagtgttactggatgcatcaaccaaattaagacaatcccttttgcctctgatgattaacaagctacaggtagctagcgatctttctctttttcttttttttttgacacgtacgcttgtgtttagaatttttttatgggccgaactaaagtggagaagacaaaataaaattaaagagcctctaaaagaaattgtaagagaaaatggcaattcatgggggttcggagaagaaaactccgacccctttcgatcttttcatctttggtacttgtcatatacggagcggtatattcagcaacacacttacacacatactgtatctaatgatcgtatatatatatgtgtggactaattgatctgcaatttagtgctgaaatataaatacaattctagatgtatgtatatcatctccgtaaggcgcagattgaactgtgcgaatctgaagctgtgaaactctgaagacgtgcagtatatttcatcaagtttttcagtactccaaacagaaacgatctacaagtgcggattgatcatttagtataaattggttgcttctgcggttg

SEQ ID NO: 39973 - DNA, 737 bp, Oryza sativa
aaatagatcaccaaaaactataaaaaaaaaagcattttttagatcagtcaagctagctaagagttgtgatacccaagcaaaggtaaagatcagatgaacatacatatgaaagaagaaagattaagcaaggtatttgtacctgatgaatacagactagctagttccaaccatgaaggataggatctgcatggaacaaaggcctttaatgatgacagccttttcctcatcacccttcatctcatcaaaggctaattattgcagagagagaagagaagagaagagatcccaagtagctctgataagtgtgcaattgtacagtcatgcagtctttccccccatcattacaccaatctgcatctcatgcagttcatgccaccaagatctactcctcctatctatccatcagatgaaacaaaaagctgattagttaagcaatattcagttaacttacccagttcatcagatttggaagaggcaaaagcagggggtaataagctagctcatgatcgatatgcatgggagcccttctgtttggggggaatgaagcctggtccgagatctacagacatctactctcatctctttgactgatctttttcttaagatcgatttgagagatcaaaagatcaagctaggagatcgagaaaagaagatatcaaaagagagagaaattaaaagtagccccgagccagacaacattcccctcaaaatgaaaaggctccctctttagctagata

SEQ ID NO: 39974 - DNA, 12963 bp, Oryza sativa
  unsure (1)..(12963): unsure at all n locations
tgcgacgatatgctaacacctctctaattaaaaaagtttctgtaggtgctgaccttttcaattcagagcaagctcaaaacaaaagactaggttcctgcggtctagccttacattatgcgaacataatcaatcaaattgaaaatattgtaagttgttttgacttttgatgatccatacccatgtttttcatcccttctggatgtaccactttcaccgtctacacgtttgctatatctgatcttaagactcagtgctctcataatctactgtgtctgctggatatgccccacttccatagctcacatgcttgctatatataatcttaatattcagcatttgcataaagttttgattatgttgatgaatcattcatttattcattttccttaagttaactacaacagtcagttgtaatgaatattttatgtttggtcagtataaagtatctattagtttcttagctactgagtactagttccaacaccatagtgcataggttgtattaccaaagtctagatgtttaatccttaatctccactacagctgatacttgattgattatagagtcaaagttctcaaaacaatgtgtaattatgcaggtttctagaccactctctcttcctcctagtgctagggacaatctgtatcatggtctgccagtaacagtgaagtcagctctcagatcgcgattgcaatcagttaatgcccaagaagaggtttgtgttctctgcagccctgtggtggtaaaacggttcatttcctatattctttatgcacatggaagcagtagtagtatttagatatgactagctcaacactaataagatcttgttacatgctagtttccataagcatattttgctcctgaaaaaggtgaaagtaaaatagtccatgtagattgaaatcttaatatgataataattctgtatatatcatgttaacaaagttgaggactttatatttccagttgtctccaaagcccgcaaactgataaatgtatgctgttttcattatgtgcagcgtactgtagctcaaattaaagctgaaatgcagaaaactcttcgctggattctaccgattgctgaaaatacaataaggtgggcggaacttgttgcaaagtcctactgacttctgagcttagggttattttctccctaaaattcattcctttgtgttttcatacttttaccagagcacatcaaggttttggatgggtcggcgaatgggcaaaccttgggttagtatcaaatcgtgatttgcttatcatataccttggaatttccattgataatataacatgagataaaatagtaacaagtattgctccttgcaacataacctaacatactgctattttctagttgcgaaatgaacaagaaatcaggctcccagctcagtatcacccgtgtccagactcttcattacgccgataaggcaaagacggagcaatacatgctcgatctggtggtgctgctccaccatttagttgtccaggtgaagaacagaggctatgggagcaagtcctcaaagcacgaccagtcccgatcccgcaagggaatggatcttcaacctgaatccaagctcaacacatctccagtgaacaacgccacatatccgagcccgttgtcggagtccgaacgcgagacgctggaccacctgagcttcaagaggacgggctacggtaggagcaagagctgcgagcctccacccaatagagggaagaaggcacatcgaacctgggattcatgccggagccatggcagctcgccggcgagggaattcggtaggaactcagcttcagagcttgacaagacgatggacctggatgtaatagatgggttagatagactgacttcttaccacccaacatcccccacattttgttaggtatatgctgcacaaaaataggtattcttttggtgttcctacggttgattgatcgtatatatatcttgtaaatgtgtgtgatctacctatatattctcttacatgtacatatatacatagcttagtagtacagccctgagtttgagtggaaatatagcaagatcacaagtgatgctctatgcctcgttcccatctctccttttgccttacaatttgtgcaatgtaaaggggaagtttcagcacaaaattctacatcatagtgttacttttttttttgaacgactcgcatgagacggtgcgaagttctattgatagagcaggaaaaaattacaagattacaaccgtggagggttgtaaccaggaacaagaaaaagaaaaccatcacccacacaccgacagcgccaacacacaagtccggaagaagactatcaccggaccggccgccgctagaccaacaaaaggaacacagacgagatcgcccccgaggggatgccaaaacgacgtcttcaagaagagaagcgacggaaaaaccgccgccgccgtccgtcggggctcaaaggagccaagactgggcttacgcccagcaagcacccttgaggggtgagacagcacgacaacgccctcaggagggggaacatcgatgtcggtccggtcaaggccgggctaggttttcacccgctgctcaccacctgcgaatccacgactgacgctccgatgctccaccaccgctcaagctctgccgacatgtgggacccctgcaccggcggcccccacccgctagccttcgtgcgtcgaagaccgcgccacacccaccggcagctcctcctcgcaccgaggtcgcctcctccaccgccggccgcgcctctcgcgccaagccggcctcctccaccggacgcgcctctcgcgccagtccggcctccctccatcggccgcgcctctcgcgccaagccggcctccatctccgccgcccgcgccgagccggcctccgctgccatcggctgcgcctctctaagccaagccgatctccgacccctcctatagtgttacttatcaaactcctgtttgggggagcttcttgttagggttctctctaggatcacctaggtttagatctagtcgggtagtactcttgggtggatgaacaacattatagagatgaaacgagagggtttagagaccgaccggttgaggtgttggaggatgaagaggtgccggacatcatcgttgttgtcgcgtgctagacgtgggcggcagcaacggtgtgctcgatggtgatggcggtcgtggcagtggcggtcgtagtcgatgacgagacgtggtacagcggtgagacttcccgtcactggctacgccccctctcgatcggttagggtttgcgggtggagatggcggcggcagcgaacctcgtgtcgtgtcgccccggcctccatccctctttatatggcgcaggatgacgggggcccaccagccattgggctgggcgcccccgatcagggcgcaggtgaaggccaccttgagccgttgggttagggagggagatccatctaacacttctggcagctgcagcttctcatagaatctccagttaccagaagctcccccaaacagtccagctttttacccagattcttagaatatgtagttgtagaatctggaaaatgaactagaagccaaaagctaggttttccaacttcttcagattctcaccagctagcttctcaacaattgtttctcaggatattaagctccaccaaacaggccgaactttgtagcagctggcctcccatcgtttatcttttagattactccaactaaaatttaaattaaacttagttttaagttgattctaagggttttttttaatcttagtttattttttacagtgacttttagatcgataaaaacaaacataaaagttttactcataaactattttcagttgtttcgtataaatcttttttacggcttaataatagctgtagagcaaacaaaagagaaacgatgaagcagacaactgagaagaggtcttggccacaaattgcagccgggtccaacaagtttatccagcaagattatctttctccagtctctcagcaatcttatccagatgcagatatagcagcagcatttctcgcacaagctcattccggcgatgtccatgtccaccacccacctgtacgcggcgagagagacccgaccaccgcctcctccgccgctcgccgtcgccgtcgccgtcgccgtcgacccgcccgccgaattaattaatacggccacagcccacaggtttagtaccccgtttggatttctcctttccaagagaccaatatgccaaagccgtaagatgaatagtgtcctagagttgttctagaggaaaaggataattgacagcaacttttctccaacctggcccttgtcgattgatccccatgctgtatatgatgatgatgatacatctatgtcaattgggttctagaatgaaaatattgtatgtgaatcttgtcggtgcagatgccagccttctagaatctaagatacactaatgggattgtacaaggtcaggcatgtgcatgcatagtgcataaccccagacagctctaaacaagttataatacattaacatgcagcatatcctataggggttctatatttctctaaataagataatagcagtacatctgttctaaaatatacaagtaacttttagctatgaattttttaatggaggtatagctatgcaagcatatataaacaagaaaaatggtccctatgtccaaatagaaaaaaatgtaaaattaatctagaaaaaatgtcatgtctttgtcatcacaagcataactttcaaccgattagtgggcgaaaagcactggatccagataaccacaaagaagaagaaaatcaccctcccccaaaatcattccaaaaacatcaccttctccagcaatgatctgatccaccacagcacattggcctctcatgagatcagctggcctctgcgaaaattactgggaaaaactatgaggctacgatcctgaccgtcgatttcggatcggacggatggatcaccatggataccattcaccgtggaagaaggaaggttggtctccaccatggcgccaaactgtgaaagcaacagccatggagaaggagaaaaggacatgcacatactactctctgactcagcaaacaatcacataatcctctaagaaaataaaaaaaatgatttcttctagagataagatcaagaactcaacgtccaagtggcaccactaaaattcctcaccccctaaactccctataaataattcacctttcttttcttttctgatctcatcgactcgacgacgacgacgcattccgaattattcaagaaattcaagaagtgaacagaggaggaaaggaaacatggcttcgtttgcatccacggcggcgccttggggatgcgtcgccggagctcggcgtggcggcggcggcggcgggcggtgtggggtgcgcgcgtccgcggcgctggcggtggcggcgccggcggcgaggacgcactacgaggtgctcggggtcggggcgggcgcgagcaggggggagatcaaggcggcgtaccggcgtctggcgagggaggtgcacccggacgccggcgccacgggggacgaggacttcatacggctccacgccgcgtacgccacgctcgccgaccccgacgagcgcgcgcggtacgaccgcgccatggccggcccggcggcgtcggcgttccggcgggcgcccgcgtcgtcgttccggcggcggacgtgggagacggaccagtgctggtagggcagaagcacaactccggtgctccctgccctactgcgccgcgctctccgccgccggagctccgtcgggcacggcggtttgccggcgagtgacgtgggattctgtcggccgtcggatccatcatagaaggcccagatcgaagaggaaaagaggaagcggagcgagatatttgcagaggagccctccatttaccatctattgtcaacaaggtcctcccgcgaccatctcggccgttcgatcgacttgtgcggcgcagattgagccaaaaagagaggcgcagtgcggatgttttcctatgggaccctcaagtattcggtattatcaagcatacccccatcccgccgccggcggcggcggcggcggagcaaagtgttgccgcgccggcgagtactgcggtgatcgccggcgtttcgtggggataacaccgctaatgcatggttcttctcctgcaatcctgtgtatatgctgtaacacgaagagaggcaattttagagaactcttttgtgtgctgattagcttgtttatataataggttttagctctgtctctctcaactgtaaatgatcaagaaactattgtttcttctctttccttttcaaatcatcatcgttgagtactaatttgaagaacactcgaatgtgtatctttggtgattcaagttttttaatttttgcagttacctgaataagcatttctagtttttgcatcacttctagtgtcagagacaggatacgctgtccattctgcactctgaataagataaaatatagacatgacctagtttccaaaaaattaaaaaaaacatgacttgaactgaactgctgaagaagaagcagtatacgcctactacttaacagagtgaccagattataaaaagggattttgttcacttgaaatcatctttaggatcaaaagaattgtgtaaagaacacctgcaaattgcgattaactgggaggacaatttttcctgtgaaccataagatgggataaatgcatcccaatacaaccattttgtgatgattctgctagtgctatccacagatgatgtctgttagcacagaacagaaggcgatgcagtctcgggcttgtttgggaggcctacaattcggcccaccaggattcaggccttagcatgaatttctttcatgacaccaaattgaaatctcttgcaccaaatttttcggtttcattcgccagcagtagccgttgccatgccaagatacaggacagcatcacaacgcatcatcgcagcaagtcagaaacagccaatcacatgatgccacgtgcatatagatcgatcgggttcagagtttcttttttaattcagaccatatgcatgctattattctgagttctgaacaatattattctgcagtacaacaaacatgatagtacttgaaatcatcttgaattatataagcccagttgtttatagctactgtatatacactatacagctagctactatacagatataggtgaggtctgatgaacggctcacctcacatatacagatcataagttttttttgacgcaacagatcataagtcaaaacagaatagcattgacatctccatctctgacagagcacaactactgctcgcgtataaacgatcgagtatacaacaatttttgctgctcacctactcgcaactaaacctttcttgtactatctgtttaatgtcttaacctctctgattctctgattgattctgcaacgcatcacacgcatgttgactctttaatttctttatacaacaacttgtaggtttctcggaaggacccatccattcatttgacgaactattttccttagaaaaatgatataaaatagtgaagcccagtagaagctagcttggttatctagctgatcatgacatgaacaatcaaaatttttgcatttgatttgttcactatctcctctctgtctcttctcatccatgggagcacttctccattttctctccctactactcttcctctccttgctccaaggtaagcttagctcaaaaacaaaatcatcaagcatatgcacatttgtaatttaattcagtggacgacgcagctatctgtttttaagcttaattgttcacatgatttgcttgtaatttctctaattcagtgctcgaaatgttgtttgattaagcaagaaatcactgatcaagatgaactcaattgtgatcaatatattaccaggagcacaggctgcgacgttcaccataagcaaccggtgcggctacacggtgtggccgggcatcctctccaacgccggcgtcgcgccgccgtccaccaccggcttcgccctctccccgggccagacgctcgccgtctccgtcgccgccgcctggtccggccgcatctggggccgcacgctctgcggccaggactcctccggcaagttcacctgcgccaccggcgactgcggctcgggcgccgtcgagtgctccggccgcggagccgccccgccggccacgctggcggagttcactctcgccggcggcagcggcggcggcggcggcgatgacttctacgacgtcagcctcgtggacgggtacaacctgccgatgcttgtggcgccgtcgacgccgccgccggcgagcggcggcgcggcgagtaataacgggagcagctgccaggtgacggggtgcgtgatggacctgaacaagtcgtgcccggcggagctgcaggtggtggcggcgtcggcggcgaggagagcggtggcggcgtgcaagagcgcgtgcgaggcgttcgggacggcggagtactgctgcagcggcgcgcacgggtcgccggcgacgtgcgcggcgacggcgtactcgaggttcttcaagggcgcgtgcccgcgagcctacagctacgcgtacgacgacgcgacgtcgacgttcacctgcgcggccgccggcggcggctacgacgtcgtcttctgccccggcatgtccaggtaaattgatcacaaaatatttctgcacgcacgtcttggcatgcatgcatgcgtgctttttttttttcaatttcacattggccctatacaatggcacgtcgtgtacatgtgcatgccatttggcatagcctagacggtccacaccctctatcataatggcactaccactacagacactgacgtgtaagataatagtagggtgagacccatatatcagtgttgtcattggcagtgatattatggtagaggatcctcaccaagcttttgaccagattgacttcggcgtctcgtttctaggcttgtttctttttctttcttttcgattacacggaaatcgtatacgtgcacgcaccacttctatgaatgcgccatctaacacgtacatgagattagaggtgggagacctctcggttctgactctaataactataaaattgatgtctttatccactgataaaaatttgctggctatattttttgtctgcttttctaattttaatcaaagaaacacgctttgggtattagaaaaaaattgttcgtctgtgtcttcggttagttggcattggtaataagttttagtttctgtgactccacaggaactcgaatgacaaatcacaacctgaaaatgatcagatatttaatcaagccttgattaactttttctcgagattacataatttggatgacatagacgcctagggtcgtgacaaaaattttaaaccaaataaggttcaatcgggacattgcgtccatcttaaccgtgttgttcctgattggttttgcagcacaagttgctgatataattttttagttcaatcattttggtgcatcgatcacttgaacgtgacagccagtgctggcatgcaccacgcatcacttgaacaagtttagtatgaacaaaacagagtgtctctctctgtctctgtgggaaagaaaacttgggcgtcgtctgcagaattggctagtttatatatcgtttttggctacaagaatggcgccaaattttttttttctgtttacaattaatttttagaaagtttctgtttacaattatggttaattaatataaaactaagtacatttttatttgctaatgttgcgatgattgcaacctgatgcagcctaaaatctggtggaaatcctgaggcagtaggcttgccacctacctactcaacaatggcgttcactggaaatgcagagagcttgacgatgagcaggaattcgcttgtgatcctcctgatgatcatcagctcagtgatatcgacgctatcttggtgatgtcaattcaaacattgtatttgcgtgatgtatcccattcatgattatagatttagcagcatatttttgccagtttttcttggaggaaaacttcattctttcagagcaggcagcaggttcatccactgctaaaactataatgcacaatgcttcaagattcgcaaatatataaaacatactgtttctgaaaatgcggatccagatcaaactatttctgaaaatgttcacaaatttcaaaaactaaagcaaattacattgtaaaatactgggcgagcttcttcttcttgacctgtacttgtttaccgaagcacgctgacgtccggcgtgcccactttctgatcttcttgtcttcagcaatgtcggaaaaatcacagtgatcatcatcagccaatattgtgtggggttcaatggacataaactccagggcaacggcattctcaaggatgaaatagaccagctcctcctgaggacggtaacaccgaaacccgctcatgtagaccgtcttgaggtgatcatggcggctcaagcgatagtcctcccttgctaccttggtcttgcgaacccgacatttgtacttcttgtaataatacatctgcataattgtaaactctaagcacaaaaacatgaaagctctagctgtttaatctatgcatcacacgaaaaatactacctaacagtatctaacgcatcaaaagccacacatttaccaaaagaatttccatttagttggattcttgtttttatccctctaacaaacaatgaaagcttgatctaattcccactggttctagtgcaatgaaggaaaagaacgacagaaaaacacaattcaattttgtttttcttcaaacattgattattataggtttaaaaaacatttagtatatcatagatagattgaatgcaattgaaaccgcgctaaaaattttaacaggtgtacataatctcaaatgaaaatgagtgaaggcaaaggaattatagcgcacttaatatgactgggtaaaatggatcaatactcacatgccattctagcacctccagtagaggagtgaattccaagtagtgcgccaattgaacaactcccttacaagtattcggagcactagttaagacatatacctcacacttcagatgcctcanatgcataaacatgttgcgtggttgtcgaaactagatttcgacaataataaaagggggtggctatcaagcttggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatcttggaaggagtccggattacaaaagataatctatattcctaacggaatatgaagataaaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtaaccctctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacactattgtgcattacatgacaaaagcgtacgcggcgcctaaataggcatgctagccgactgctttttagccacaataaaagaaatccgagtggtttacactctaaaaggttcacgaatgaactcacttgacaggcatccgaataaaaaaactctaaagatacccatcaagtaccataaagattatggtaataaataagtcaaatagcctaggccatgactatttaccatgaaaactggcatataacacgccaaggaaatgactataataaaaacaagtcattcctagttaacccaaacagcttttgtagcctaaaaaagcttgcaaaaacagcataacgcctttctgtcggacacctttttaacttgcattgcaataattccaaagaattatatgaccgcataaaaaggatttcatcagcattgggcaacactgttgtgtgcataatattgccaaagcaaaatatgcctaagtccctaaggaacacaatgggccacgctgttaaaagtattgggctgaagtattgttcaggcctaggcccattagcacctccgatacccttaactgaaaaatccgatatccaagcggcgcttcgtcttccccgccggaactctcgccattttccccactccctgctacagtgcaaagctgcgccggcgaactagggttcacaactccggccaaatccacctccgaaaagtgcatcaaaatccttctcgtgatccaccgcctcaatccctcacctctcccaagccatccctcgaatcaaatcagcacatttgagtgaaaccgatggcggaagagagagaaagcttcgaaggccaatgggcgtcgtccgacgtaacggaggaggatcttaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaat

SEQ ID NO: 39975 - DNA, 1086 bp, Oryza sativa
ttgaaggaagtcgaaggtaacgccagctaacaatctgagcttctctccttataacgcaacagatgctcatcataaatgtgttttgcagatcgcaagatcaaatctcaagctcagtttgacgtcctggttggtaagatcaagaggcttgaaggagcaagggataacgtcgccaatgccgctgcaccaattatccaagctatgttcttcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgataaaattgcgagtgatgttgtagagcaatttcgcaatgacgacctccaaccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaaggagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgagaaagttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacc

SEQ ID NO: 39976 - DNA, 1708 bp, Oryza sativa
acgttcccaacatatctcatagtgcaggcatttagcacggcactgtctatcactcccggttgtaaacttaactaggatgggagaatgatcagaacatggcgaagtcagatggaccacctgtgcattggtaaaaatatccctccaactttcatctgccaaagctctatccagccgaacctttacattggctgaaccttgtcgcttattatcatacgtatgaggtacccctgaaaaacccaagtctaccagctgacaagtctgtaacacatctctaaacgcctgcatttgggcattactccttttcctaacagaagtatgctcaaattgccatagagcttcattaaaatcccctacgacaagccacggcagagaggaagtctgtttaagagcatttagatgagcctacatcctgcatcgattttccactcgtggttcaccgtacacaaaagtcacatgccacaaaggaccatccgaggacagacgcacatacgcatcaataaatctttcattaatagaaattatttccatgtggatagattcatgccaaaacaaagcaagacccccgctcatcccctcatagttaacccccacaaaacccttgaggcccaatcttgatcgcagacgtttaactctatcgaccttttgtcttgtctcactgagaaacacgatatgggaacccgcctccttaaccaaggcgcaaaggtcatgaactgacgcagcgttcccgataccgcgacagttccaagccatgcaattcattgctcctgacgggacccgaccatcggtcccgtcagttgaccagcggccccagggctggttgcctcattctccttcccggttactaccccttcagtcttcctggctctcttcagtgcccgtgaagaaacgcccgattcaaacacagatttgctgctttcttccaccatttgttgatattccagcagagcttgcatgactctccctgacttctttgttgcaccctgtgtttgaggttccctcctgtcctctccactgcaatcttcagacaattcatcaccgtaggaagcttgctgacttatagtcttaatagccggtatcatctcacaagaaggtaatgaagttgtatcttccacaccatccaaccgaatctcaggtccacgtttatggcttgctccctctcttcctgggagagaaaccttctgtacttctgtctcccccaccttcattttctctgcatagcccgccaactgttcatcaatctgtgtgtccccttccttctttgcagactcaaaaccatcatgagcgtccactcttggtggaaccaagtcctccccctgatctccttgtttctgtcgtgaggacaatgaacttgcactccctgcccccctgaagaacaggttacgcaccacccctgaagatgatggtactttcaccttactcaccttcctctcaaagggttttagaggggagcatcttaactctgccgaaaacttgaagggctggtcattgttgactcctttcctattgcactccttgtcagagtgtcccagatatccacatatgaaacaaaaatgcggcaccctttcataccaaagatcaaaacgctttgtgacctctttgccctgtgctaacatctttatagccaacttcgactttaacggacgcttgacagataagtccacacgaatcctaaagaaatcatgtttgttccgcccatcgtcacccacat

SEQ ID NO: 39977 - DNA, 5446 bp, Oryza sativa
cctcaaaactgtggttctatgttatgcaacgagacttagtccttcatgataagatattaaggcctaatgaaaaattcttgaatcctgattcctacagcagtttaaccgttcaataatttgaagggagaataataataataaattaatgaatcctacatcttgactccataaaaattataagtattatcaattacatacggcaaaatacagaaattatcaagtgatacatacagaagtattttgagccaaattgatcaattgctggatagtagtttccatatgctcttttgaatgatcctgaggcgcaaaatctgtcgttaatctgcacatcagaattcacagcaacagcatagtgttaagtacaggaagtgctgatatgattgtaaatagcatcttaaatgaaaagcatacttctcagattcttacttgttgaaatagcgtcctaagttatgccatgttgggtctttacacaggttaccaaatcgaattacttctcttgaaaagatgtcaagttcatccctgtagaattccatcaaatccatgtcagccaatcgcattaacaacaaaaaaaaaaaggaacgataggacaacttccttcttgaaccaatcataccttttgtcaacataagcaatatacaatagttcactggaatttgaggagaccaatatttgcactccatctgaacgcaatatttcttccttcaattcctttatactcgtgtcggagcaagatctccacaaattggaagctttagctattgtgtttgcgacttcaaatgctaaaatacagactctattgcctcgatttgttcccccagagagaaatccactgccatgatttaaatttgtcatgctactcccgagggtatctaacacctcgacagcagcaatgctggctcttcctaaaagtgtacctgtttctggtacctgtcacaacttagtatgtcagagttaatatgaaaggaaaagactactcttatcttctaatgatatagtctccgcttttgctgccttcaatttccaatagaaagacaactagttatagcacaaacaaagcaaaaggaagagcgagagaaacgtattatcccctctaagaagaataatatcagatgtttcgtcgtaacaaagaacctaagaaagaaggtatatttatttgaactagcagtgcttttcctgtcaatcttattgcaaaattatgaaacaagccaatttgaagtgcaagcttttcgatgaaaacatagactcaatgaatgaaacgggtgaaatgaaacaaaatggggaggtcactcctctaaggctattccgtagtcctttcactttgggggagatggcctcctttcatttttctgatgatatatagacgatcacccctgatgcgcattggccagatcaaagtaggctgcgcattggtgtatttcttaacccgatactttagtaaccatctgtctatatctttttccatctccaggatgactgccgaatcactgggtgcctgaattataacactagtaacatgctgagagtacataaacaaagtcagcttctttccagttatacagtctgtactttgtctcacttattagctcctgcacatttagtgttttcttccaagtagaagctaagcagatcactcatgtctttgcaagaagaaaagtgaaggatgtaatttcccaaactccatggttggcatggaaaagtggtcagcaggaaggaacaaaagcagaagctcatggttgggtcgctggcttgaccagtccaagaagtagactcaggctgacagcaacgtgaacgttaaataagcacggcagttcttcacttatctgagcaaaaggacggaatcctcctcctataggacaatagtgcttacaatatgataaaccaagggccgccaagattgactctgctgcatcctacacggacttgatgaatttttgtgtgtgtaagctgttggttttcacttgctgtatgtattgttgtgtccctctctttcccctgatccgcttaaagaattcatgcaaagatgcagtgcagattccccacggtttgtgaaattctgcatcctcagaccactgccaatctagtttgatttgagttaatcaaagcggagactgaaatacgagagagcagcttcagatgaagtccccatggaagccttgacagcgaaaggcagctcaattaaagcttcacagtgatgctcagtttgacggcttctctgaatttctgaacacggcggcgagagaagaaacgcagcaaaaaataacatcaaatcaataatacccccaacttgtgattttgaggaattggacgtggaaggcggattgagatttcgaacccaaacaaagcgctccgtttgcggcaacgcgtgtttggtgcatcaagtcgtggagaattctcaccggctggctacctaactaagcagaaacaaatcgcgaagtagagagcagcacatgcagctgtccgatggaagttgcaggcaagcagggcggagagttgagctgaagcacatctcgatggatcgatggagctcgaaaattccaacacatgcagcacatgatgcatagaaaattacggtggtagtagtagtagagtaccttgtgggaggtgagtagcttgggcggcgggatggcgagctcgccggagtcgaagtcgccagggccgtagcgaccccggcgcgcctcgtaggcggcggcgagcggctgcaccgagcgcggcgcggcgtcgtcccgaaaccgcctggagcacacgcaccccatagctctagcttagacgtacaggtgctactagtagtatctcagcacgtatcagcctcgtcggcggagcagcaagcttaggtttcgcaggtggcggaggttggagtgagggagacgacggtggtggtggtgggaatggatcggatcggcgcgcgggattggaattggaagggaagagcaagaggaggaagagggggagggaaggaagaccgagagacgagtagtcgaggagactagttgtgttgtgtcgtcctgaccatgctgctggtgctcgtcttgttgcgttcgcatcctttgacttgttctctctcccgcgcccacgccacgctcacgtacgccacgcgcctccccctctctctctgcaaggcctattcggttctccacttctccaccacagtttaccggagaaactattttcatcatctcgttgtttacatgtaactttgttatggaaaaaataaaaaaaattaagaagatgtattaacatgtgatatatcactctacaaacatgtatgttcaaatttaacttctacatctcgcaacgaaaaaacaaacgaatttatttttttttgcgagatgtagaagttgcatgtttgtggagtgatatatcacatgttaatacatcttctcaatttctttcaaattttttcataaccatttgagtgatgtgcaaacaacaagaggatatcccctcgaggggtgaaaatccactccccagtttaccactgcgctaaaaattatggggctcttttgttctctaccttacttcctccgtcccataaaaaaccaacctagtaccggatgtaacatatcatatccagattcgtagtactagaatatgtcacatccggtcctagattcgtttttatgagacggagagagtatctaccaaattcttggcatgttttggtattaccaatttttttttgtaaggtagagatttattatacatgtttggattgctactaatatgttgccaaatgttgatgatacagagaagaagactctagattagtgccaaattgatcataggaatagccaaacaatttggcttcaatccaaacctatactattactattgaaggtaccaataaattggcagggcacattttggcatcaatccaaaatggtcatatatcagatttactccttcagtaaaaaaaagtctaacctaaaatatcaaattcgttgtaataggatatatcatatcctatcttaggttggattttttttaaggagaaagtatctacttactactactgtttttgttttatattataagttgatgttgaacttctttggatttaaccaaaattttaaaaatatagtaatatttttaattaaaataaacatagacatattatcaaaatgtatatttaatgttagatttgatgaagttaatatgatgttttagatgttactttttttttacaaacttgattagaaaaatcaaaacaacttgtaatatgaaaatgaatagggtaaattaagtcgattaatttcttgaccatcatttagaaacttcaaaatattaatagtaaccaatttttttgtttcaaaagcttaatatcggcctgtagcctagtggttacaagagcctcagtagcacctaaggtcctgggttcgactccccatgggagcgaattttccaggatttatcggcgttgtgctttcagtggtaggcgacgtacccgtcaacagctaggcgcctgtggtaacttcgtcaatctctccaggatttgccggcccagtccagcctagtctttgaagatgctcataggggtagggtttacttcgtcaatctctccaggatttgccggcccagtccggcccagtctttgaagatgctcataggggtagggtttgcgtgcgtgtgttcatagggcaaaaaaaagagcttaatatataatttgttctcatagaataaaaattctctaggagatatttttactactactgcatactccttccattcaaaattaaaagaatcaatttttttattataaatctacacatagtctatatttagatttgttgttgaaattattttttttttggatgaagggtgtactgttacagatacagcaagattaaaaagtcttgctgtgagtaatactgttgctgaatgtttttcctctgttattattaatttatattattattgtcgatggtaggattagaccacgtatgctaaattgctgggtttagtctccgaacgaaatggtagttatgtgtgcatagttgaaaattggatttggcttcttcaaaaccgaaacacgcttaattttgaccttaatgcaggtaccgtcaatggaaaaaccgcacgtgtcctttgatcacaaacaaaagtcattgttctcctactataaataggactgcatatgcttgtcagatgcgtaaagtatatactatcggtttagctttctaaaatctcattaatactatgatattatcattgttattactttccctgtttcacaatgtaagtcattttagcattttccatattcatcttaatgttttttttagaaatcatcttgatgttaataaatctatataaatatatataatgtgaaaaatactaaaatgactcacattgtgaaacggaggaagtattattttaaccatcaacccaacagtactctctcatcttctggtttactcttcctcataaatttttctccccatattaatga

SEQ ID NO: 39978 - DNA, 716 bp, Oryza sativa
ttccattcagttattggtggctatatcatatgacagagggagtagaacagtaaattgatacggatgaagtagctggtaagcacgtataggagtaactaattgcaatcaaagcgtttgtgcttaccaaccagtattaggctctgtttatttcagcttaggattattataatctagattactgagtcagattactataagctagattgttataatctgtagtagaataagcggttaattgtttctttcctacattattagagcctaaattattgggtttgcaagtctaaagagggagtgggtggcatggtgggtaatttttcacccaataatctggaaaaagctcacctaaatgagcttattagattataataagctgtgctccagattataataagctactttaataagttgtatgtttctttcagcttactcccaataatctggattataataatctcaagctgaaagaaacattgccttagaagccattatattattcagcacatattagaaatcgatcatgacaagtgaatatatatttgaaccagctcggtcagtgtcattagtcgcacggcaaacggaagtttaaacgaacagagattataactagctaggtctaggtgggcacagggacgatgttcttaattaggtcattaggtgaatcatctcaagaagttaagttaagtctgtttatttaatccggtcgggctgcagga

SEQ ID NO: 39979 - DNA, 4532 bp, Oryza sativa
  unsure (1)..(4532): unsure at all n locations
aattcctggctccatcttgtttttcactcactttccgccactcagcatcctcagatgttatcatttatcatacatgtgtccctgtattgttggaccagaagtcttcggcacgtaaagctttagataaagcagcacctgacctgagtcagagcttctggacgcatatcataattgcttccctgcttggctagcttaatatacaaggccaattaagaatgcatttatcagaagaacgtgcacaaaccacccttattgatggcatccaaaagctacatttcctctgccaattaggtctgtgaggtcaaaggtctgatgaacctggcaaaagcagagacagatttctgaccacagaaccttcatctcagtgcagaattttcaaagactgcatttctattgtacagtaacatttccctggaaagactcctttacatatgatcagagacaaatgaggcttttgcaaatgtaaaacaatgaagttccacctttgaaagttgaaacccactagaaaggagacagataaagcattatctatgttgagcatatgtttggagtactaaggaggaacttagcatctgttgaggaatttagcatctgttgttgttagagaagaaaataatgagaaaacctgtgatcaaagggattcgaactcaggcaagcatgctgctccctgtcagccgagctctccctgccaaccaagctaggtgccgttctcttctacataagtagtagacgaaactcagctggttttaactgcatagacaagcattttgctgtccttctgtcagtaaccatgaaatgcaacacacggtcacccttgagctggtgagacacagctatcagccacaaagcagatagtactttgcttacaggagatgattctggagtgctttctttctggtttcggcagctcaatgatcccaccgtgaaaggcgaggaagcaacagaaatttggtagctcctccaaagtggagattatcgtggaagctgagctgtttccaaatcccaatactacacctactaatcgtctcttatctgaaagataccactgatcatttctgaataacgaaaaaaatgagaatgtgtaaataggcaaagttctatgattaaggccacgattgtcggttatttgggcgttttccacatatgattgatggcatctaatgatcacatttctactgattatatctctgggtcggttcagtaatgaggaaatgagagggaaacggctccttcaagttgttttactgtcttgtcgtgcagtctttttcttgtgggaaacagttcaacaaccactgcagcttgttgggtacctgggttcatggattcttttaagaccttttctgtggtggtcttgtttggcagtgcttaccttaaagctcttgcaaactggcttctcagatgaactctgaatatttcgttgtctgtacaggtagtgtttcagtttaccctatgagctacaactaacgacataatgtcagtgggtgcttaaagagactagtctctaggtacttttaaggtaatgtcagacttccgactgaatgcatatctgaaaactatgttcttgattgagaacaaggggggcatggttaaccatttcttttttgtttcagaaaggccagattggtatagctgaaatttgtttttttgctcattcttttctcgatataagttgaacattgccttgttttacaaaattgctcggactattcagatttacatactattgatcgtcatctcatattattgatcatcaccatttgcttggcaggttgtcagaattaaagactgccaagatcttggaagaacactattggtggtggcaaaagtgaattgttcatcactccccacaaacaaataattagcatttttcatgttgacattttatcgacaacaaccaatttacaaagtgtgcaagtgtaaattaacctttggacacttgtctatgacacgatcttactcgtctcctcctttttatcaaaaaacaatgaaagaaatgaatctcaccacaagaagaagaaggagaaaaaaagcgaatcaaaaacagaagagctctcctatctaccatcagcatcatcaagatccccagccatggtgtcagggctctggcaagaagtcgcgcgcccgttccagcgtgttggtgagcttggtgaggttgagctccacattctgcttgtccaggtacaccgtcttgatggcgtcccagcctttcttgtgcacatcgtatggatgctggatgtagaaatggtctctcgggtagagctctctcagcgagctctcgtcgaaggagacattgtactccatgtagttgacatccatgtccttggctggatccttgaaggtgacacgggtgagccattcgagccccccgaatggcaccacctggatgagcacggcgcggctggggaggaacaccatgttggtgaggccggcgccatggacgcccatcatcacgtcggcggagttgacgaggcgcgcgaagttgggcatgtcggtgtggttgtccggctcggcgatgcgcacgtcgaacctggcgagcgcggcggcgtgcgccatggcgcgctcgttgaggaagcggcgcgagctcttgcgggagatgatgaggaggcgcggcttgtcgcgccgcggcgcgcccgtgcgcgacgcgacggcgcgctccaggcggaaggtgcggcggaggaggcgcttgaagtcggcgacggtgacgccgcccggggagcgcgccgggtcgatgcccatggcgcggtggaacgtggcgccgatgaagatccgcgggaagcagtgcacctcctggtcgttgtcgacgtcgatgacgtcgtaccgggagagctgccggaacagcggcgtgaacttgtcgagccaccaatccttgatcccgctgagcaagaactgcacctcgccgccgaagtggttggtgctggtgaagagcgggacgagcacgtcggtgtagtcatggtacaggttgccggcgaagccgccgctggagaagaggaacgccgggacggagtggttgcgcgtgcagagcggcggcacggcggtgtggttggcgccgccgaaggggacgagcgtgaactcccgcacgtcgtccatggcgacggcgtcgtggaggcgcgcgtacggcttggttctccactccttgtcgagcgggtgatgtagatcttggagtggttgccgtcgacgcggatgtcgcccacggcggcgcaccgctccgaccgcttgctcgtgacgtagcacgtcggcctggtcgggtcgaagtcctcctcccctatcggccccgtcatcttgtacctcgtgctgtcgtaatcctcgtcgatctccaccacctccatctcctccgccgccttggctgcaaccacaattactcacagctcatcactccatgcatcaatcaaagctcatcactccatgaatcgatcnannncaannannannnnnngnaggaggaggaggaggaggaagaagcgtacggaagggggtggagcagtagcgagccttgatgtaggtgaggacgcagagggagaggagcatggtgatgaccatggcggcgttgcccatccgccgcggctcggcgcgcccccgcgccacatgatggtgcttcatcggcgccgggctctcgccgcgggcggcgcgcgccgcaggtggtggtttggtttggatctgaaggaagcaaaaacgatcgggcgtgagcagcagagagaggttagtagtattaaaggcggggtcggggtggcgtcgcgtcgagtggatgatggcgaggcgatggcaaccagaggttggtggcgtcgtgtggtgggtcggagctcgcaacggcgcaaccactcactacaagcacaagcagcagcagctgctgcacagtgcaaacggcaaagcagagcaggcagctacagctacaggggtggggacgagtagacaaagcagtggcccagctagcgcaccagtgcaccaccaacaacaacccgatcgccgatcgctcgccgtcgattggccgaggcagataagatcgcttattcacagatgtactgcagtgataaagggtgtatggtttcaaggctgaggtacaatgtttaacctctacccctaacacgttataattttttttcttaaaaaatgtttggaggcagcgcaaacgcaacaacgctttgttgttgatgggtacgtggttcaacaaaaaaatcaaaccagttaagcttcgttcacttttcaattttttttttgggacgctccttccgtcaacccggtgtttttctttgcgtcgattatatgtgatgttggtgaagaaacggtcgcctgcctcgtgcttcatgacgagaggtaggttggttcattcacgcgttggcgttggcgttggcgttggctacagaatggtgatcacaacagattcacagatctaccaaacgtttgagcctaccaagtacacgtaccaagctgcagcgacacgtacagcagtgtggaataaatggcataaaaatgtacagcagatggtgcctgattaattcagagtgctcgcggcggcgccgggcagcgagaggaacact

SEQ ID NO: 39980 - DNA, 5112 bp, Oryza sativa
ctacaagcttaactgcatagtagtggacacatgaaacttgagggagaaaaggaacccatttatccacccaattagttgctcggtcattctcatcaacctgaacgcaagaacaaacctgtatatatgcaaccacttgaccaatcactcgacaagcaatgccaattcatgttctccaatccaatctcaccaaatcgagaaccaacattttccaacgacaaaataatacactgaacctatgcctgcatttggaattttggatcactcgttcagttcttgcaccgttttattaacctgtagcgatgtactaccaccatctgtttcagggattcagaaaaagaactgagagagacagcggagcttactgtcgtcgttgctacgatgaaaagggttgctttcaagtgtccatctctgtggcaggtgaatggcttctttatataagtcccaaatggatggaccatttgccttggatctttgctttcatctactctctgctctgcctctatttctccttttgttaattgacatgtccttgttaaatacttaactatgtagtcgcactgaaaataaaactgttgcttctgatgcaaatttgctagagctggctacagaatgggccttgcttgatgaattgaagcaaaagcaacattgctagcgacttggaggaattgggaatataagatgttgctcgatcagacagccatgaactcccagcaccaatgccctgggcagcatgtgttttgtgggggctatctcgtacaaattggccagcgatccagcgtaccaaaccgatttgtcgtgggattacaatcagtcgatcacaaggctacaaaaaacggagttaatcaaatcgaagactgcgtctgcgttggtcgtttcataatcacgttcgacaactttccatgtgtgaataaacaaagtcaatcataaggggaaagcacctttatcataaaggtaaaaaatcatgatatatgattacacacagcaggttctcaattttaggtctgttcactttgatgtaaaaaaacattaccaaattttagcattaccaaaatttggcattaccaaaatttggcataggcaggattttttatatggttaccaaaatttgacagcaaactaaatgcagccactttttttacagctttatcaaaatttggtaatgttgaaaatggcatcaaagtaaacaggcccttagcaacttgccaatattttggtaggatttcttatataattaccaaaattcagcaacaaactaaatgtagccacttttatggtaactttaccaaaattggtaaggttgaaaatgacatcaaagtgaacaggccttttttttaaacaaatgttctcaaaatttatggattacatattgatgtgcctattgaggatgtgttagagatacgattacaaacaagtattccttccgtattttaatgtatgacgccgtttactttttgaccaacgtttagccatttgtcttattcaaaaaaatgtaattatcatttactccatccgtcccaaaatataacaacttttagccctcaagatttgtcccaaaatataacttctccactaacattctctttccaaccaatcacacccctccaccattcactttcccacctacctccattacttaaccaatcacaaccatttatcattcacttctacctactttcttaataaccatgtccaactctaaaaatacttatattttgagaccgagtaatattttattatgacttgatttatcatcaaatgttctttaagtataacataaatatttttatatttgcacaaaaattttgaataagacgaatgattaaacattggctaaaaagtaaacggtgtcgtacattaaaatacggagggaggatgtacttacatgtgatgatgatgtgtacgcgtatacatacaagtacattcttacttgcggcccatgttggttagacggtcgtaacgggattacgattttgtgaagcccaagaactagattgaggtcctacgtgcgctgggctttcctcttacttgcggcccatttatgttgggctgtcaatttatgggcctcattttctaaagtggctcaatgaggcctagcaaggtttatcacggcgggccatgaatttgggatccgggcctttccaatgcttgcaaaataaaggaataagatcactttgactccctcaactgaccaacgaatctaaatcgtatccctcaagcgcaataccagaaatcttatcccctgaacttgtaaaaccggtgtaattttactcccttggtggttttggatggcggtttcgctgacgtggtgcacacgtggcagtgttgacctgatctttgttccacgtggcatttgacgtggcgtttatgtggcattaaaataaaaaaatatatgcggggcccatttatcattcacacaaaaaaaaattgtgggacatgtcatcttctctctcactatccttcttcctcctctctcccttatctctctctctctctccccttgacaagagccgatggcaggcgggggctcggtggcggcatcagcgagtgggtgcccggagtggtggctgtggtgggcggtggaccttggagcaatagcttgcacgccccaacgcgcggcggcggactggcctcgagcgctccggcgtcgacctggccatgatgcggaacagcgactggagctcctcctcctccgacacgggccccctccccgaccacgtccgccgcgagaccgccccttcttcctcttggacttgccgccagccgtgcccgcggcggcctcgcggaggctcgggaagttggcagcaggagtagggggctcggtggccgccggggcggcagcgttcttgcgctcctccacctcctcctcggtgcgctcggtgtcctccgccgcgcacattccttcgtgccaccgtgcccggctcgctccctccccaccacggccagcccgcgccatcgtcgccggaatcatcctgctcatcgctgttgtgcccttcgcgccatgccctcgccccggcaacaatcccaattttccgtggcgccagcgccgctccagtcccggacctgccgaagctgaatccttgctactgcggcggcgagggcggcggcggaggcggcgcgaagaccgtcggctgccgctccgtccattgcccgccgccgccgctccccacgcacgaagagaaagagggagagatagaaagggaggagggggaggaggaagaagagataggagagggtgacctatgggatccacatgtcagtgggtcccacaaattttttttgtgtgaatgacaaatgggtcccgcatatatttttttattttaatgtcacataagcgccacgtcaatgccacgtggaacaaagaccaagtcaacactgccacgtgtgcgccacatcagcgaaaccgccatccaaaaccatcaagggagtcaaattgcaccggttttgcaagttcgggggtcaatatttctggtattgcggttgaggtatacgatttagattcggtagtcagttgatggagtcaaagtgatcttattcccaaaataaaatcccttctttgcatgaatattgtgagtttcaccaatactatcactgaatattttttcagtttctacgaaatttgatctgttttgcacattaaaactcacagatggcactggtatcttgaataatgaaccagattagtacattgtgatcctgacagggcaacctgtcttggccacaactagcaatttgttgttacaagaggtcaaccagagattgacctcgttctcacactgacaagcacatccatttttacaacttattgcaaacaggtcaacaagacgttgacctcacccacgcattcggaagctaaaaaaactttttacaagcagcaagcaggtcaacaaaaagttgagctgcagatgctgaagaaatgaagatatctgaactttgtctgaaaaaaaggaaaaaactctgaacatttcagaattcagactgacggattggcgttcgtcagttggtgcaggaagggaagacccacaccggcggcggccacttccagagcaggtcgcgcacggcgccgcgtggcaccttgtagctcccgtcggcgaggtcgagcacgccgacgtcgggaaccacctcgtggcacctctcgtgcgaccatggcccgtcgtcggtgaagtagacgcagttgcccttcacctccgggcagcaatccgccgggacgcacagcgacgcgctcttgcccaagaacagcgcgcgcccggcgaggatgccggcgccggcgccgtccacccgcgcccactcgccatggccgccgccggcggcgttccactcgaagagctcggccttgacggtggtgtactcgacgcgttcttgccggggctcccacttggaccgcgcgtgcgccttgtccctgagccggtgcacctggagcaggtgtcccggcgagagctcgacgaggtatttgctgcaggggatcgacatggagcacgcgcggccggagcagcagcacggcggcgcgatctccctgggcggcggcggcgtcgtgcccgccgccgtgacgtccatgtcccatgcctcgacgcgacccacggagtccagcgtgtacaccgcttggtgcccgtcggcggcgggggcggaggcggcgcgcacggcgtcgacccagcatcgtgatggcatgtcgaggagagtccacttcgtgtcccctgctctggcaatggcgagacggtacagtggctggcagatgagcagcacggcgtagccgccccaagaccccggcggcgtcgtctgcctccgcggcggtgcaacgaggatggccttctcgtagagctcgtacctgagcctgtccggcgcgaacgactccggcgggacgagcacctcgtcgccgtcgttgtctccatcgccgaagcagcagcggaggtcgtagctcgcgacacggccgtcggcgtcgcggctggcgtcgacgaagggcagcgtggtgaccgagggtagctggacctgcgcgccggtgagcgggttcaggaggtggagctcggaggcggcgtcggcggtgacgagccacccgtcggacgagccaacacatagccgctcagacaccggcggcgccggctgcgggatggcgtacgccct

SEQ ID NO: 39981 - DNA, 4364 bp, Oryza sativa
  unsure (1)..(4364): unsure at all n locations
ttgacaccaccaaggtgtaaccacaagacaattcaataagctcgtagacaactgctagtgaaacaacaaactgcacacaattctttagacgacactgaactgcagattttgtaccaggcaaggatagggatgaagattgaagaaactgtaccttgttacgaggtgattgcttgttattgtaggaatgacatgccacagccactgcaggcagcagaagaatcatgttctgaatgtttgaaacaacgtcccagcgaaaaaatgtttgaaacaacgaaacttgtgcgttgtggggaacggcgtgaaggccttgttctgggaggataactggctgcagggagaatccatccgctgcaaggcgccggctctctatgctgctatcccggctcgcattcgcaaaaaaagaacggtcgcagaagctctgtctgataggcggtggatcaaggacatctctggtgcccttggtattcaagccattcttgagtatttatccctgtggcaagacattcgtgcagtgcacctcacggaccagcccgatgtgctttcgtggagatgggaggggtcgggcaattactcttcccgatcggcttatcaagcattgttcctagggataacccggttcagtctaccccgatctggaaatctctcgctccacctcgatgctagtacttcgtctggttagtggcgcttaacaggtgctggacgggtgatcgattgaggaggcgcggactgccacaccccgaccaatgtgtcctatgcgatcaatgcgatgaaagcatcgatcatctcctggtcgcttgcccaaagtcccgctagttgtggtggatggcactgagggccattggacaaacaagttctctgccgacgaacgaagtctccttccacctctagctttgcgatagccgaaagagattgaccaaggcagctcggcgtggtttcgacaccattgcaaccctcgtcgcctggacaatctggaaagagaggaatagcagcgttttcaatcagcagcaaaagacttgggcggaagtggcaagggcaatggccgccgaagcagaactctggagacttgcgcgagcagccattccggagttcttgccacagccaactgtcgagaggtcgcaacatcggataggagaatagatcttttggggcaattgtattcctgcatctccccttcacttcttgtatttcctgtaattaaactttttttccatccttaatacaaatatgcgctccttgcgtattcccaaaaaaaacgaaactttagcagcacctttcacaaaatatatctgaacttaaggagccgagcaaaactaagtcagctgatttatatcatgtgcctgaaaaggttaaaaaaactatggcagagttaagtaccttaccgcttcctgatcaacaagtgatgagttatttgttctaagaggctgagggcaataatgaggcttgcattcaatgataaagaatttttgcctactgtgaaatgttaagaattactccactgtgttaaattgaagaatatgaaagatcaaatgacatgcaaatgacatattgacctgcgttccttgaaacaatacaatctgtcaaactgataacatattgtataagtttcagttcatcagaaactagttattttgtacagcgagtctcagcagttaggcccagagtcggcccagtatcanatttaacaatagcaagatcgtcgacggacagtgtcaatggcaggaggtgggctccttgcggatggcacaatagcgatgacatagcagagtactggagtagccagggcctgggggtagtttcagtggtcgggatcagtgtttttctgttgcacaggtcccggccttgcctgttgtgattgaaatcactttgtaaccttttctcctccaatctaataaaatttggtcggcgtccttcagccatgcccagcgataaataaattaccatgaaatcccacaattcttttttcgggaatacgcaaggagcgcattttttccattaagagaaataaaagttatttacatttgaaagaaaaaaaaacagcacgggactgatacaggacaataacagacaatcctaagtctatctctcacgctaattttggcgaccaaactccctcctgaattacagcgcaaggatcgccgggtttgctttacgccaaagagaggcttcgtccaccatccctctggccacatccgcccaagatctacactgctgattgaagatccgaccgttccgttccttccatattgtccatgctaccaatgtcaccaccgtgtcgaagcctcaacgatgtgactcacttagcaccattctgctatcgcacatccattggtgaaaagaagcttcattcaccagcaggcagttggggtggccgattgctctcaaagtccaccaccaaagctgccttgattctgggcagccgactaggatatgatcaatgctctcatcctgctgatcacagagaatgcagcggtcgggatgcggcaatccccgactccgcaatcggtcggctgtccagcatctattcaacgcgaccagccagaggaagaaatgacagcgaggtggtgccaacgagttctagatcggtgtggattcaaaggcaattcgtccaaggaacaaagctcggtaggtagattttgaagtgtatttgcttgagctttcccacttccaggagagtgagtcgggctctgcggaagaacaatcaactgactgaatcagcgaccaaagttgaggtattcgagtattgcctgagtcccaagcgcgccacttatgtccttgatccatctacggttagacagcgcttcagccaccatccggcgcttccggatacgagtagagacatgatcgtagatggagggtgcaatagctcggatggttcctccttgcaaccaattgtcctcccggaaaaggattgtttgctcgttacctagctgacagacggtggaggcggcgacaaggtgaagttctttctgtgtgcaggggattaaatcccacaattctctcactgccaatacctattcagaacagctgaaagattgcaaaaagagaagagtgcgatcagacagataaccaaaaaatgagcatctaaagcatcagatatgaactcgtatgaaatgacagaccagtttttgtacacgtgatggaagcagcacaagttgattatcaactcaatggagatggatgcagagaagattctccaagactagaataaggcacatactaatccaagaaagaatctgcacaggatttcagaacaatcaggtttttcaggtagatgaatcacacagtattaacgttgcgccaaacagaaagtgaaccgggatggctcaaacaagagaatgttcattaccaatcaaatcccagtcgctgtctttgatgattggaatggttcctcttagcttgcggcactgccttttgagctcctcgctgcctccagagacatctagtatttctagtgaacttggaagaccactcttgggcaacgaactgatgaactcactgcacgagatctctaatctcttgaggctaacaagcctgtgtaacacagaggggaggaactgcagccggcaaaaactaaaactgagctcctgaagggaggagaggtgctcaagggccatgttttgctccttggtgaagcgtttcacctcgttattgcaaaaaatggttagcttggtgagtgagggggagaggagtctgcagatgggcacaacaagcactcctgcgatgtcatccgttacaaggtgctgcagtgatgaggggttgatcccgacgaagaatttggggttcttgttgactcgcagccttgtgagttggccttgggcgagcagagaacacaaatcctcgcctcttaaatcaccacattctatgcctaagttggtgagagagctgaggttagagaggagcgacagagtctccatgccacttacacggtcaatagacagatatttcagggaggaaggaaatgggaaagatgaggaagatgatgagtaggaggagaagaaatcagggcaatcgataatagtcaatgatacgagggagcgcaggccttgtaaccctccttctatgcctcttaggcgtccttccatgttttctccaagtgaatcgtggtggagatcagctttgagcaacaggagatgaacaactcctgtagctgggtaggcaagagcagcagtcctgaagatgccgctgctttctcgtcctctcctcttggctgttgttgctcttgtccgaaacgtgcattctccaacttattaccagaagtgatggtgaagatgccgatgttgccgttatctgctgctcagccacaccaagcattgctatcttctccaatctatacattgtcaagtcagagagtttggggaaatggg

SEQ ID NO: 39982 - DNA, 3421 bp, Oryza sativa
ctaacctttttaaattccaaaagctttggccttctatacaactcaaggatttttcactgtgctggttaaccaaccataactcccctataggtgggaatttgttccagtctagaccatgcagactaagagattgcaggcctttgattgacaagttaaaacctaaccatgatgggcaagtggcacctccatgcccttcaatttgtagctcctgaagattgttatgtggcttaagactttcaagaatatgttcatcttgggaacaatcctttgttgaccaatgtaatattaacttgtgcaaatgacttttgtttaaaagttttgcttcgtccgccgcctgtgcattttcaagattataaatgcctagtgttccgttcagctccaactgtcctaactgtcttaatgcaaatggctcactttgtcttttcactttaaatctccttagttcttgtaaacattttaacttacccacattagcaacgtcagagtggagattgtcatcggggacaagaaaatggcgtagccttacaagattatctatatctcttggtaaaccaaagtgaccattgcattttcgtacatcaaggatcctcaagtgataaaaccttgaaatggtgttgggtagccttatttctggaaaatatcccctaataatccttaagtagcgcaagtggacgagatttgaaaagttgtgcaacatattctccactgcatatgatggagtagacaacaagatgacgcggagtgattttgcgttacttaacaaatcaccaagaggactgataaagcttccatggaatcgtccaaatagcataaaagagtgtagcttttcaacatccagtctcttacttagtgtgctgaaatccgtcttgatgctttcaaaagtcactctatcatttacatccatgtcatctatcacaatagacaaatggcgtatagatggtggaatttgcacaaaccttacgttagaactactgacagcaagacattcacaggatgaaaccttcaatgctaactcatgtagtagatcatgcatactgtaataaggagacccatcttcattcacattttttttgaaaaatccaaaatcaaccaaatgattcaaacaactcaatgctatatcttcagttcgtttgttttggtcctgatgtgattgtaaaatgtctagtcctatccataggtgaatcaactcatcactgtcaaacttgtaatcttcagggaacaaagcacaatatataaaacattgttgcagatggaaagggagatagtcatagctaagctttaatgctggcataatatcattgtcaccagtttgtaattcccattctttactttctaggacacttgtccaatgattgaaatcaaggtgatttctcaacaatcgacctacagtttttgctgccaaaggggagccctttagttttttggctatcatttctccagtctgttgtaagatagcatgatggtttattaatttctcatcaccaaacacatatgcttggaacaattcccataactcttcaaattccagcccttccaattgtattggacgataagtcttttgtactatttctgcaactgctggaaaacgagtggtgactagaatcacatttccctttgtttgtgcgtttctgaggggtgctaatagccttttccaatcatcctcattactgcaattccacatatcatccaagacaagcaaaatcttctttgacttcaatcttcgctcaatcaagtcatctaggtcacccagttgctcattctcatctaggtcacccagttgctcattctcaactttaggtattgaatcagcaatctcttgtttcaatctgtacgcattgaaattgagagagatacatacccaaacattaacatcaaaaaggttctttactgctttgtaaatttgctgagtgagagctgtcttccctattcctcctggaccagtaattggaatgacggtcaggtccttgacacagcaatcaccatgagttatgtctttaataattctatccttctcacccttcctcccataaaattcaggctctatagtcgctgaagtggtcacaggacgaagcatagcaatgctgcttcgaatggtgcgatttgattccggcaactctagattaagaatggtagagactttggcacagactagcttcagctgctcagagatgtgcttgttcttgtggacagatccaccctatcgaacttcagctttggtgttttcatagtgtcctccctctgtgatccccactgtttttcttttctaggcatgtgcgttgcagtagagctgtggtcgatatcagtagagccggtgtcgttgtcgtcttcatcggtacagtcgtcatcggcatcatgttcaccagctaaagagaggtcactgccggcaacagctttctcgtcacctccgcccgagcaacaagcagaaaggtacctcttcttaatgtttctggcggtgtggcgggtgttgaggaggaggccatggaggcagcctctggtgtgctcgtcggcggcctcgtcggtgccgtcgagctcgtcctggatgcggaagtagtccagctcgtccagcacgtcctcggcgtcgtaggcgaggccacgcagctgcaggagcagctgcttcagcgcggggctgcgggtctccctgccgcgggcgttgtcgagcatcacctgcgcgtagagcagctccagcttgacggcgccgacattggtgccgagctccgagcaggccagccacgcctcgacgagccctcccgacagcgggctcagcgccttgccgaccatccaccgcgccgcttcaacggccaccgactccatcgatcccaacgtgcgctgcagccggaatcgcgcgagctgcacgggcgtaggagcaaagcaagctgcagcaaactggtggaggagtagtggataagtggagtacacaagtgctagctgaacagctcgtcagttcttgctggcaatctcaacttgtttgttgttactactctgcagtggaggacccagcatggcagcatcaactagtccattggttgctacttgcaagtggaaaggtaatgtatctgggagatctctcagttccttcggtgaattacctggatatggaatttacctctcgtcactgcacaatcttgaaactaccgcctgaggacaccagttccagaatgcaatagcttgtcaggcttgccgacagaagtgtgtcgttccatgcatcatctaactgcaagtctgcaactgatactccctccgtcccaaaataagtgcagttttgcactattcacgttcaacgtttgatcgttcgtcttatttaaatttttttatgattagtatttttattgctattagatgataaaatatgaatagtactttatgtgtgactaaatattttcaattttttcacaaaattttcaaataagacggacggtcaaac

SEQ ID NO: 39983 - DNA, 1427 bp, Oryza sativa
ttatgtatgtgggttatgggaattgattacgggcctctcaaacaaggcatctgagcatcggcataggtactaggccagctcggtacaaagaaaggcattttattagaccatcaacaaagttattagtctaaactgtacagcatttgagtaaatattattttttgagaactgcagttaagtaattagagaggaaaaaatagcaggattgttgtaataaatggaatcgtttcgcttattcgcggaataagcaaaacatcttatttacaaacgaaaagaaatatgtgaataaaatttttatatgcgtattcttagtgatctaaaagcaaaagtaaaggctgaaaaataaacttcgatgaaaaaaaccttaaaatcagcttcaaatttaaagttaaaaattcaaattttagctgataagtataaatataagcgaaaagatgagaccctaatatcttcgctctgttcgtattgagcaggaaattaatttggctacagcgttaccatagtgactacaagtctacaagtcatactaccttcctctcgtataacttgtaattctagtttgtttagcaaatattaaggtttaagaagaaagactataatgtgtcccttattaaatactccttccgtttcataatgtaagtcattctagcatttctcacatttatattgtgttaataaatctagatagaatacattgtgaaacggaggaagtagtgtatactatataagagtggaaaggtaatcgagggtaaaatagaaagaaatttaaatgagaagtgattaatgagactattagtactctattgtgataattattttgggacaaattcaaattctagaaatacaattattatgggacggaggtagtacattttatcaaaccgaggagaagaagagacatgactcaaatttcaaactgacgcaacactattctctaattcaaatttcagtatccgctactactggtggcgtccacttcaaaactgatactttccggcgagtcgctgagcaaacaccgcacctcgtcgagctcgacgacgtcctgcgtccatggatgctggtgcagcttccgcagtccgcccagcctctcggcgacctccttcatcgccggcctgtcgccgccgcacatctgcaggcactccagagccagcagcgtgatctcctccagcactcaccgctcgcctcgctcttcacctgctcatccagtatcaaatcggctctgttctccctcatggcggccaagaacctcgccgacaagctccgcccctcatccggcccgtcgaggcagagcggcttcttgccggtgagcagctcgagcaggacaacgccgaagctgtacacgtcggctcttctctgggagctggcgtgtctgcatgtattttgggtgaaggtaactgcacgtcccctgcaccatggtaaaaaaagac

SEQ ID NO: 39984 - DNA, 710 bp, Oryza sativa
agtctttgtcttactatgttgtctataactaacttgtccttgatgcgtttacttttgttttctttataggctgaaaaggcccgggctagagttcagggttcagatggaagaatcacattggcctgaacatggatttcaccagttttgagtcatgattataccaccacaaaagcagttattgataccatagtactatatatagagtaattgatactgttgattatttgaaacttgtttgctgtacattcaataattgtaactgattgggcatgtgacttcttttcttttgtatagttgatatggtgtgctgtgaatgaaattctgcatagttcgccctgcaacacaggataaaggtaactcctaaccatcttttccaacacaattctatttccgtgtttgaaaagctttttcgaacatttttctacaattagtgcccaagtggaattattggagtagatgaaactaaaccatcagaaactgaaattgaagtcaccaaagcataactagggcagggtactgcaaatttatttttatttccccctccataccagatcagattgctattgttatcttttgaagacaaagaggagtaatcattaaattactattatgagacactggcctacctaattcgatgttcttttcctgaggaaggtaccaagctagtctagcttcgatctgagagtcgacgagtaccatattacattcct

SEQ ID NO: 39985 - DNA, 3375 bp, Oryza sativa
  unsure (1)..(3375): unsure at all n locations
actgtgaaggtctcaggggctactgtggagattatgggtaccccatacccacacggcatggttatccgactagttataggggataacttatatttatggaatatgtaacagttcatgacttgggtattacgtttccttgtatattacagaacggcctaaagtcctagtttggtaatattgtaaagtagatttaggaaactgataccgtgttggttaaggtttttatcttgtaatcctgcctcccatcctatataaggtgggcaggaggccctctagggggcatgagacaacctgatcgtcagataaataaacacccggtggattcaaatccccaaacaggagtagggtattacctctcattgagagggcctgaacctgtctaaatccctgtatctgcatccatccacttttaggtctcgtacgctacccccttttcatattaccgaaaatttgtttcgacacgttggggaggtggttgtgatgttggcgccgccgtcatctgggtcgctgccgccaactaatcggacaccactgccgagcgcctcttcaccgagcttgtcgtcctcccgctggctcaggcacatgcatcggcgcacttgcaccctagccccccgagggcgccggtggcattgtagctccgaccacgccaatcgaggccgtcacgaacagcgacggcgcagccgccgccgctccccgcgcgagaaagggagaggtgaggaacattgtgcacatctgcgcgtaaaccccttcctggtggtggccacgaccaccagctcgtagaaggagagctcggtgcgaacctctcggggatggcggtgagcgagtgcgcgcatgcgatagcaaaggaggcggcactgccacgggttgacatagaggaagaagataatattaggatgacatgtgggtcctagttgctgattcagctagtcaatcacggtcaatgtgccacgtcagctgaaaccaccttccaaaccactcgaggagtctatttgcaccggttttgggagattagaggcgttttacccagtttttgcggctgagggatgcgattcgaccaagtgcaagagatgagggaggtcggatggacttattcccatacataatggcccgtcagagtgcatgggccggaatttcgagcctaccaaacaagcccagaagtatcaacaggccttcctggatttgtacctcatggcacagctcgtaaacaccacaagattgaggcaaccgagcccagccatcatccagaagaagcgatcaggtgcccctcgttgaggtcgtcggggatccaccccggccggccgccggtcgccgtcgcccacgacacggccgtcacgacgagcgagctcaggtactcccccgccgcgacggagatgaacccgagcgccgtgcacaccgtcttcatggccggcggcgcctggctgtagaagaagtccagctgccccacggtggcgagcagctcgccgacgcccaccagcacgtactgcggcgcctgccacaggatgctcgtcggctccatcccggcgtgcgccgcgcgggcgcgcctcgtctcgaccagcgccgccgcggccatggcgagcgcggccatggcgaggccgccgccgatcctgagaaggtcggagatgcccttctctctccccgtcagcctcctcgccgccggcacgaacgcgcggtcgtacagcgggatcaacacgatcgtggtgatgatctggaaggtggccagggatgccggcgggacgtggaaggagccgacgcgcgtgtccatcgccatgnccctggctcgacgatacgtcgaattggcctgcgccgtcgcggtgtagtagaaggcgacgcacgcccacaggggcagcatcctgacgagaatcttgagctcctccacctgcgtcaccacgcaaagcctccatggattgcgcggcgcggcgccctccgcctcctcgtccgacgccgtcacgacggcggccttgtcgaagaatctgatcgagcagttgcatctcaagaattagccaattacattacacctacagcatcacaaacaccagatgcaacgagagacatgaactgaccggagatcggcggtgtgctcgatcctctgaactcccttcatggaggaggcatcctccgataggtcgtagagaagggccatgtcggccggcggcgcgacgttgaacttgcggacggcggcgacgacgacctggcagactctggtgagcgggctaccgcgggttgtctgaaacctgtacgcccgagacgcggcgacaaggcaggagagcccgacggcgaggaccatcgccggaatccccaaccccaatgcccacccgtagtggtcttgcacccacaccatggcggtggtggatatcacggacgcgcagttcatggtgaagatgtaccagttgaagtaggagcccttgctgatgcgctccgacgtgtcgccgtcgtcgaactggtcggcgccgaaggacatcaggcacggccggagaccacccaccccaaatgcgatcatgtacaggccaagaaacaggatgatcacttgagctgaagccatggacgacgtgtccttgatcagcagcggcagaagcgccgacagagccgccatgagcatgccctgcaccacagattaggtacgtacagccatgaagctgattggatttgcattcatggcagcacacagtggggaaagtgatttcatccctccaggaaatatccctcgtttcatccatgccaactaattagtcataaaaaaattaaaaaaaatggacaacataaattaatataaaatataaaattaaatgacaacataaattaacataaattaatattaatataaaattaaatgttctctcaagggataaaaatccacatcccacacagtgactgattacttgccatcagccataaattcacggcaggaaggacacagtgactaattctaattaaggctgtgtttagattggtataaagtttagattttggttgaaattgaagacgacgtgactgaaaaaaattgtgtgtatgaaaaatttaatgtgatggaaagttagaagtttgaaaaaaaaaatttggaactaaacacaacccggatcgaatgaaatggaggggactaacagcgacgccgatgcagcagctgacgaccatggtgcggtaccttccccagtaggaatcggcggcgacggctccggccagcggcgtgaggaagcaggtggcctgccacgtcgacacgttgttggcggcggcgacgttgctctggtgcagctcggcggtgaggtaggtgacgaggttgaacgtgatgccgtagtaggccaggcagtagcagaactcggtgcctatccacaatcacaaagcaagcagaataagcatctctctcagtgttgtcatagctca

SEQ ID NO: 39986 - DNA, 718 bp, Oryza sativa
caaaatgtgaattaccaaggtggccccagaacaaactaccagtggatggacaatgttttgagtttgcagaaacttggtaaggcactgaagcaaaccgtatgcaaaaagaccaggaatcaaccacacggcatatagtccagcttcagatgatatctcaggattttgaccaagagcgataagaatttggccagcgaatgccaaaacaaaagccagcgggacacccataagcataagaacaaagatagccctttgcgcatgtgtcccaagcatatcatattgttttgctccatatgattgtccacagaatgtatccagcgcgcttcccattcccagcttgtcatggaataaacagatatgcagttttcattgaaattttcttgcaagtaaaagatcaggcatcatatagtagaacaaaggagaatccatacatattctttaagaaaaacaaacgagattccatacattttataaagaaatgccagtcaccataattccataagcacaatacaactacaagcatatacaaggcctctttagatcattggatggattgtatttttgtagaacttgaactaatttttggatatgatgtcctaccataaagcaaacgcgccgtactttgtactgattttcacttcccaaatttttttgccgaacaaaggagtaactattcatactaaaagaatttaccaacccgaagttaaagtatatgtaatta

SEQ ID NO: 39987 - DNA, 8968 bp, Oryza sativa
  unsure (1)..(8968): unsure at all n locations
ttcccaaacagtccataagcttcacactacagttttctaactttactctcattttcgatgcgcacttttaaattgtgtgttttttaaataattttacagaaaaattattttaaaaattatattaatttattttttattaatacttaattaatcatatgttaatccgttgctctgtttttaagcgtcgggaaagggttcccagccccaaacaacacagccaaaccctgcctcgggctattaattaactcaggtcttctcttcctctctctgaaaaaaaaactcagagcaagtagcaagagttcttgataagttaaacacaggaatctcgtacggatggatagaaataatgccttatccatctggattagcaggaaaaattgaattaaaatcatccaaagagataagaaattttctaatccaaacaagtgtattggtccagccctccagctggtttgatatcgtttcatgaatttggacgggattgtatgggctaactaaaatcatccaaagagataagaaattgttttaatccaaacaagtgtaatggtccagcactccagctggtcgatatatgtttgatgaatttggacgggattgtatggactgttatagttcagatagtgcttcgaaaagaattcagggttaagtaagaagaacttcagagaggtgtcagcaaatttggatggaaaggattaaagaaacgtgtaatcgccccactgcatattgatttcctaagtacatcactgcagaatctctgtggacatggatagcaacgttttcactgtcatctggtaagcaggcaaggtcagacatggtggcaactgacgagtgtcaattgggcaaatatgaaattgcagctaactgactctaatcatagtcaatcatcctattttaaggattggtcaaccatcttaagataaatgtatgatccatacatcagaaccaacgtgatcagaattaaagaaaattccccatgctattcgcgagatgatctcgcgctgtgtacatgttagctagatgctcatttgttcatggatcctggcgtttacttcttgatccttgtatattgctcatgccagagtgttaatccaggatatccagcttgcagtttttattggtgtctgcaattgttttcttttgtcatgaccagacagcaaaagacgcagttttgagtcattgtatatgcagaagcacaggatgcaaaagcctcagccattatgattatgcaaaatgcaggattagcaagtgtttcacttatgaacaaataatctcccactttatataaagtgcacaaagttcatccaaaatataaatacatataaagtacaaacttgcaatctgagcaatctcccctaccatttcgttgcgtttgctccgcgattcccttaccccccatgtgctcctgtgctatcaaacaattcccttttgctagagcagaatcatgaaatgccaaactgatagatctgaggggtacttatcacgctttttattctttttcagatgtagccttgcagtgtaacggatctggcctctgaactcatcccgggttttcaagtgcaaaacaccattagatggcacatgtcacacattgacttcacaaattatatcgggcagatttgccacttgagattaaaacagtcgaaatcgccaccacaaactggagttttcttgaaatcttgcttctgaattctagctgtttcagagaaaagaaataacagcataaagacgaagaagcaacgtcagttctcgtgacgaaaaaaaaaagaacaaaaaggaaaaggacgcgaataaacgtggtttccatgaactgcccagctggttcaaccgaccaaggcctgattaattaattgatcacttccaaatcatgtagcagtactgttcttcacggtcactattgctcgctgctgcttcgctgggtccatcgattaataatctggtttgttaattcccctggacttaactaatcaacttgcctagcaatgtactaatacatgcaaatgtgatgcatttatggatacctgcatcagagagggagctaagctctatgttttgtatatagttgtaaagctgctgttctgttcttgtccctggtgtgtgggtagttgctgtttcagagatgaaggcagctgtgaggagcaagaagagcaagggctctttctgccaccctcctctgctcctgctcatcgtggcaatccagttcttgggatttactcaccaacccttgatcagtacatggtgatgctaaccacaggtacgccgtaatcataatcgttttgtattcttcagtttgtatgttgattagtagtactgtcagagaagcatatgctgtttgtcttgtcgatactccattcctgtgcatatttggaaacagttgctgaatcctttcaagaaaacaagttcctttatttgttgggataaaatggtaacagttgctgaatgatgaattgattagttcgttgacaatgtccatcatggattcatgataggctactgctcacgttaggatatcagcatctgttgttattcccatgttcttgtgatcgaaatgggttaactgacattgatgggttgtccctgcaggcaagcctggtttcccatcaatgttgattgatggtaggaggagcttcaaacaagtaggtatgtgtcacataatcttgggaatttcaaaccccacaatgtgattaatttctgacgttgttgattctgagtttatcttggagaaaagattctgattttgttttaatttgctcgatgaaattcttgatgcagatgagttcatcccggagcctcacctgcgatgcgacttcagagacaatagatccgacgtgtgcgagatggagggcgccatccgcatcctcggccgcacgtcggaggtgttcctggtggcgccgagcctcgcctccatctccggcggcggcggcggcgtgaacgcgacgggcgtggacgcgaacgcgacgaggtggaagatccagccgtacacccgcaagggcgagtcccgcgtgatgcccggcatcacggaggtgacggtgcggctggtgaccgccgacgaggcgccgccgtgcgacgagtggcacgacgtcccggcgatcgtgtactccaacggcggctactgcggcaactactaccacgacttcaacgacaacatcatcccgctgttcatcacgtcgcgccacctcgccggcgaggtccagctgctggtgacgcagaagcagcggtggtggttcggcaagtacagggagatcgtggagggcctgaccaagtacgagcccgtcgacctcgacgccgagcagcgcgtccgctgctaccgccgcgccaccgtcgggctccacagccacaaggacctcagcatcgacccgcggcgagctccgaacaactactccatggtggacttcaagcggttcttgatgtggcggtacgcgctgccgcgggagcacgcgatccggatggaggaggaggacaagagcaagaagccgcggctgctggtgatcaaccggcgctcccgccgccggttcgtgaacctggacgagatcgtggcggcggcggagggggtcgggttcgaggtggcggcggcggagctggacgcccacatcccggcggcggcgtcggcggtgaactcgtacgacgcgatggtgcggtgcacgggtcggggctgaccaacctggtgttcctccccatgaacgcggtggtgatccaggtggtgccgctggggaggatggaggggctcgccatggacgagtacggcgtgccgccgcgcgacatgaacatgaggtacctgcagtacaacatcacggcggaggagagcacgctgtcggaggtgtacccgcgggcgcacccggtgttcctcgacccgctccccatccacaagcagagctggtcgctcgtcaaggacatctacctcgggcagcaggacgtccgcctcgacgtccgccgcttccgccccgtcctcctcaaggccctccacctcctccggtgatcgccggcgatcgatatatatatactccggtgaggcgatcatgcatacagaacacacgtacacaggattaattacagcagaagatggagttcattaattaattaattacagtggtagatgatgatgtagtttaattaattttggtggttgcgcaaggcggcaacgtttttgtatgataattaatcgatcctgtttcttttttttttcttttttttctgttgcggagccgtgttgcgacgtgcgtacgtgtgtgttacggtaagttggcctgctgcaattagctggttcaacatgacagaaatgcatgtgacactccatcctttcttgtacagttgtactgttgttaccttacaagctacgattattggctggaagcctgtgaggaggatactggcccaggtgatctatgggccacagcccatagaaggagctgggctgtgtgctgttgctcgtaatggcccagatcagtctatagtcttgggctctacaaatacggcctgtttctcggcttctcgcaacgccgttgctgatgatgattcagccgaacggtcagggtccaactcgacctttgaattttcacggattaaaactctcgggagtttggccggagtagtaaattctgattcattcttcgcgttggtaatgggcatatgcatggctcagacgtgatatgcgaggcgtcgccatgaacgcggctttgattgctcgcgcttatcccggtggacgtcgtcctctataaaacaaagcactccagctcgatacagcataacgcagttcgcaagttcaatcgcaagagtactctacttctgcaagcttattcttcgactgatcaagcaaggtagagacatgggcggcaagggtggcggcggaggcggaggcggcaagggtggtggtggaggaggtggaggcggcaaaggaggtggaggcggcagcggaggtgggggcaggagcggcggtggcggaggaggaggaggaggaaagggaggtggcgaaggaggttcaggcaagtacggcggcggatacagcggcgggcacgctggtggcggcggtggcgcaggcaagtccggcggctaccacggcggcggtgggggcgacagcatgaaggctcccggcggcgacggatcgtacatctcccgctccggcttcgagtccaacccgcagggctacttccagggcctccatggcgatggcaagtagaggttttggagcgctccaaaagttaggctgctaatcgatcagaattcgcgattatggcccatgaatggtggcttctaaataatgtattatcgagtctgtaaggcagtctactttctccaaatctctgttatgtatcggattatcgtggaaatctaagtgaatgcgttcgataattttatgtcttttaggttggtacgtaatttcagcaagatcaccgatgttcttcttgttactcccctgcagtgtattggaaacttctcgaggggatgtcttctgntttgtttaaaaaccatccaaactgttttaaaaatttctaaaaaaaaatttaaagcactcatgacatgtctatatgtacaatttcatgaaatcttaggtccaaactcaactcacatgtcgatatataaaaaagataaaaaaattgttaaacaattactccctccattccataatataaggcacaaccactttttttaagatattccataatataaggcatacatgtatgtatgccattaactataacaattctccattaaattactatttttttaaatccttcactcacattctctaactctattggatggatgcattacatttattaggatgatctaaactacaaggtgataataactatttcttggtctttgggttaagggtggttgtgacttatattttgaaatggagggagtatttgtattcagttcgaaagaaaaaaaaagtacatgagaaatatcccatcgagagtttagaacccacccttatcatagtatgtcttcttttcaataaaagtatgatactccctccatcccaaaatgatatgatatatatttatgtaccaacgttaaggataatttaaatcacatcaatcaagatactatacatacattctttcataatgatgatcaatttaagaaattttggatttcattatatgattatcaatttgggaaggagagagtagtattttattaacaagatatctttgaatatgtgatattttaattgaaatgaggaatttgtgtaaacaattagttatgaatgtgattttaacgttcaaatttgggtttattattttttagttgcaaggtgtttaaaaggtagcagtatttagtttgttcttaagataacttattgattttctcatttcttttagtttggggtctcatggtttatctgccctaatataagtttgggcctcatggtttgctgtttgtgcttatgctagaaactgacccaacctggttcagttgccaatgtgcatcagtgcatctcaggcggataggcacgagcagcggaggaggctacgcacaggcgtttactagcgtttcttttgccatcttcgatgcgtaagccgtcgcgtcaattaagtcttttttttatcaggagtcaaccaagactggacacgatcgagccgattatgcgtgcatggtcatggagggcgagggccgttcaaaattgaaaacgaccacgtcaaaggtcggctcttcgatagttcgatcatctacgtccactaggcccaattgatcggccagattgaacaaaaaaatgaagtcggctatgctagaattctagatgcatcgcacggcatcatttgcattaaatttcatcactgatcaagaacactgaacactcaatgttggaaatatagtcattaatcgacatattttaatccaaaaagttaaagcaatgatcatggcataagcagtatagggtgatcttaacataaccagtagcatactatgcgcatcatgaatgtcaggaacaggaatataccagtaacgcgataacatgctagaggcatcatgtagaacaggaacaaaaacatagcgcacatagtatagcgatagcgctaacaatgggaacaggaatagcgctaacaacagtagcaggaggagaagagtatactccgagaatagccctccgctggatggtgaggcagaattgcctccgttgttgttgtcgttcacggcacctcctggcgcaccagctccggatccagctcccgtcggcggcgtaccacctccgccagcagtggcggcggcaactccagacatggcgatgagcagtcgtgcgggaggcactccccaaaaatctgatcacccgcctacctggtgcagatttcaggcgaaggtgtggtttcggaggcactgctccttccattctctcgtgcgcgcaagagatcagaagcgaggaagcgagagcaattcaggcgcggagaagaagatactaacaccgggaaagaagctaaaaaaccggatcggactcgcggcctccttatctatcaggagaaagaacgtggacgcgctgttgcggagggaatcgtgggaacgtgggttagtgcctgcaaaagaatagcgacgtgacgcacgcacgcacgccgccatctgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaggagctaagccttgactagaactgcagcgggaacaccactccacaggcatcctcgacggcacggacgaagcctactcctcggagaaacctccatctgacacatactcgaactctgggggggttgggaaaaatagagcaagactgagtactacccactgtactcagcaagtcataccggaataggggtatgatgcagggaattatcaaagaagagctagagtggttcatttgcataaagcgagcatttataaacagaagttaaaagatttaagcagttgtaataattaattaatattgatcatccgctgtccaacgctatcccacgttgcaacaggcccaaccatccacctaaaccatccaaattcaaaagattacactagggtgagactaatcacggtgaatctggttgaccgcccataaccgcgggcacggctattcgaatagttttactctgatcagaggtatacaactgtacccacaagacacagccccacaacacgtttccgtgcgccgacatgccaccacgacacatcggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaggctacactacaagcccagccgttgcccacgctagcttgtggtaagtacgataagttcttccagggcatcccgcgaaccggtccttaactgccatgggtgcgaccagcgaaaccatgcacccacagcccaccatgtgatttattttaattaaccagcaccaaagcggtggcactaatccaacactaccattagaaccaacagtctaaacattaataagattttccccattgtgcactagttgaactaagcatggctaagcaatccctagtccaatctctagtcatgttataaccccaagctgacaaaagggacatggtgcaacaatagcatggctatgacaataggtaaacaccccatagaaatattataaaacaatgcagtatttgaaggaaaacaatagagcatttgcaatataggatcaacatgttcaagtgacaagcatgacttgccttgctctgctgctggaggaacctcggcgactatttcgaagtacaccggagcgtcggaagaaccg

SEQ ID NO: 39988 - DNA, 2332 bp, Oryza sativa
gcgcggcggcgccgactggaggaaggagacgggcccaacaggtggggcccacctgtcggcgtcccggggagagagggagggcggcttgggccggcccacaaggaggagggcgcgcgcggcggggtggttgtcacgccccgaactagtcccgaccggaaatagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcatacaaaaggaaagcggaagccaggacttggaccaatcaacacaggcgcgacttgggaactaggccgaaaccctaaaactcattgtagccggcttgctcctggaagaactcctcatcagcaggacccgcttcatcttcttcagcaactagggggggattatttatatagtgcaagggtgagtacgggagtactcagcaagccatgggaagtaagtgtttaatgcaggcttcaaggaaaggctgatgtttctgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccggctaacaacttttcaaacggccacccaggccaacaacttttcaaacggccacccgggcctagctgatcccatcagctgcagatttttcaaacaccgaaccccttttcacacagcaatttcacaagcagtagtcaaacaaaactacgctaggaatcacctcacatccgcccgtgaccgtgggcacggctgttcgaacagtttaatgacctctgaagagggggtacgctttacccacacgacattactaacccgggtcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacattccccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcacaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggggcttgatcctcgaaatcctcgcactgcgggtcttcgggctccgaaactacacgcgaaatggggcaactcaacaaacagcgaaaataaagccctattaacgacctctaagcgtgccattagatagatctcgagatttgatgaattttggaagttgaacggagtcaaacggatttacggttgggaagatattgaatttctaagattattggatttttggtctaacggaaaaaaggattaaattaaatccctttttttttggaaaagagaaagaaaaggaaggagggaggaaatttagactttcctcgggcggctagggtgcggcccaagggatctggggcggctcggccgagcttaatgggccggccggcccaaaacggcccaagcgcgcgcgcgcgcgggggaggggagagagagtccggtggaccgggctcaccacgcgcggtcccgggtgggacccgcttgtcaacggctcggctcgccgtgcggagggagcacgcggcgcacgcgcgcgggcggggaggaacgcggtgcacgcgcgcggtttgcggtggacgcggatgcgacgggcccacgcgcagcctcacggctcgcggtggaacgcgcgcacggggagggaccgaccgg

SEQ ID NO: 39989 - DNA, 4377 bp, Oryza sativa
ccgcccccgaggggtagatgggccgggaggaaatcggcccatcgaccccccgggggaggcaaaatagacttttgcggaggaatttgatttggaaggatttggattcggatttgaactcgacgatagatcggggtttgagatcttgagatggcacggacactagacaacaagcaaataaacaaatttcgcaattagattttttaagagataattttcccgctaggcgccacgacggaacgggcgctacacaaaggcgcacgggagggagggaggacgaaaagagatggggcgccgggaaggagggcgctgtgtgggagggagggaggaagggattgacgaaaataggtgtgaaagccatatgcattttttagttaggtatagatttaaaaaacacatggtttagctgttcaggaaatgtgcacgcagcgaaaaaacaagggagtagaaattggaaaatgcaagatgtgcaggcaacactgctatcaaattggactgatgatagaaacaagtgactggtaagctgatgtggatcagggagaatcattactcactagtgatcagtactgctatgttgctttcaataaaagcaaagattctccttttaaaagagaaagtggtaattagcgggaactattcaaagctctcgaggggacatccccgttgtttgcatgtcacttaaatgattatgaaaaaccataaaagaagataataatatgtaatagatcactctacaaacgtgtaatattaaatttaacttctacatgttacaacgaaaataataaattttattgtgaatagctatagtttaacttttatgtttgtagagtgatatatcacatattaatacgtcttctttaatttttgttttcataactatttggattacccagacaatgaggagatgttccgcgagagtttaaaatgcactatcgtaggtagccaatcaatttaacatttcactcaaggagaggccaccatttccgaaatgtaccatctttaaatcaagcaatgggcactgtttggttatatttcctgtttgctctgtgttttcttccaccttccatttctgaatcctcttgagaacttgcatagtgcatcatctactttagaacaattttgttggttcggcactgggaaaaagagtctccatgctgctctagcgtttcgtctgcaggcaaaatttttactgtgcaaaccaggtttgtctatcttttcctcagagaagcagctgaagaggaacacaaaacttcttggttgcgcagcaggtagtgcagcacaagcagcagcctggcactgtgattcccaaggaattcatgcctgtgactgtgtgacatgcccatcggcacatggagatttcacgatcagggtagcgaaggaagcatcgaacagatgcttgattgctggcctgctgccgcatcggatgtccagacatgaaccatctcaaacgaagcgaagcagatgctgccgcagtcccaggctgtctttgatcgtaggagtcaaggtgcaaccaaagttttttttttttttttagaataagagggcaagagtactgccccttttcattgactgcctcttttttttagaataaaggtgcaaccaaagttgccacaaggataaagcaggagggaatcaaaacaaaggcctttattgctttgccactgctacactacctctctgtgaatctgtgcagtttcattgtacgctgatctctctggtcgaccaccggcttagctgagagatcctactcgtgcccggtgtcgaggagagcgcgcgatggagtcggtggccgtgaacgcggcgcgatgggtggtcggcaaggcgctgagcccgctgtcgggagggttcgtcgaggcgtgggctgccaccacggagctcggccctaatgtcgacgccatcaagatggagctgctctatgcgcaggggatgctgcacaacgctcgcagcagagagaccagcaaccccgcgctgcagcagctgctcctgaagctccgcggcctggcctacgacgccgaggacgtgctggacgagctcgactacttccgcatccaggacgagcttgatggcacctacgaggccgccgaagagcacgccaagggctgcctctatggcctcgtgctcaacacacccgcacagtcagaaacatcaagaagaaggcgtgctcatgcggagataatggggaagcgagtcgccataccaacgatggggaagcacttgcaggcagcagctgcattcacaagctcttttccaatgctcgaggtacttactatccatctcattgataatataaacaccttccacgcctctcttttgtaactgaacatgacggttgtgacacctttatcaccattgcaacattcctacagaaagaagccagttcctctgctgcgcctatccttgcaaagcatcgcacatagagcacaccatgaaaacaccaaagctgaagtttgacagggtggatctgtccacaagaatgaagcacatcgtcgagcagctaaaaccagtctgcgccaaggtctccaccatccttaatctggagttgttggaatcaaaccgcaacattggcctcatgagtctcaatgctgcgctttcccggatgccagggcaagcaccttttcttccaagcagcgttgctatgagccggcctgtaaccacttcagagtttatagaccctaaatttcatgggaggatgagtgagataaataaaattattggcattactcggggtgattattgtggcaaagacctgaccatcattccaattgttggttcaggtgggatatgaaagacaactctcactcagcatatatacaaggaggtacagaaccattttgatgttaaggtttgggtctgtgtctctctcaatttcaatgtgtatagattgaaagaggagattgccaagttaatgcctgaactcaaagatgagaaatctggtggcccagacgatttaattgagcaaaggttgaaatcaaagaggtttttacttgtcttggatgatatgtggaattgtggtaatgaggatgagtggagaaggctcttagcacccctaagaaaagcacaatcaacgggaaatataattctagtcaccactcgttttctagcagtcgcagaaatggttaaaacaattgatcattcaatacagttggaagggctagaatctgaagtgttttgggaactattccaagcatgtgtatttggtgatgagaaatcaataggcaatcacgtggacttacttgtcactgggaagaagatagcggaaaaattgaagggctcccctttggcagcaaaaactgtaggacggttattgagaaatcaccttgacttggagcattggacaagtgtcctcgaaagtagagaatgggaactgcaaaccggtgagaatgatattatgccagcgctaaagcttacgctatgactatctcccttttcatctacagcattgttttacatattgtgctctgttccctgaagattacagatttgaaagtgacgagatgattcacttgtggataggactagacatattacaatcgcggaatcaaaacaaaaaagtcgaagagataggactgagctatttgaatgatttggttaattatggattttttagaaaagacatgaacaaaaatgggtctccgtactatacaatgcatgacctactacatgagttagcactaaaggtttcatcatatgaatatcttgctataagtagttctagtgtgagaagtgtgcaaattccaccatctgtacgacatttgtctattgtgatagacgacacggatgtaaatcatagagtgacttttgaaaatgttaagaaggattttagcactctacataagagactagatgttgaaaaactacagtctttgatgctatttggacaatatcatggaagctttgtcatcccttttggtaattggttaagtaaagcaaaagcactccgtgtcatcttgatgtttaatgcatcttatgatatggagaatatgttgcgtaacttctcgaaacttgtccatctacgctatctgttgatgtaatatgcacttgtattggggaccttcttgcatatgtagctaagtgaaatagtgtgtgtgtgtggctgtgaacaacacaccagagaaaatccccaaaactgaactttatggtatcagagccctaaccctagcttgctgccgccgccgccgccgtccatcgccgccaccgtcgccgctgccgtcgtcgcacgtcgcccctgctctcatccggcctgaccagcctctacacacaccacgttgaggggctggtgagcgcgcgctgcgcgcggccgcgcgggcgcagcgcgtgtgttgtaacctgctgctcacgcaggaaatgtgaggagctcagctaagggaaaaggaggatggt

SEQ ID NO: 39990 - DNA, 723 bp, Oryza sativa
actctatcatttacatccacatcatctatcacaatagacaagtgccgtatagatggtggaacttgaatagatctcacattagaactacttatagcaagacattcatatgatgaaaccttcaatgctaactcatgcagcaaatcaggcataacgtagtaaggagacccatcattttgttcatcttttttgaaaaatccataactaaccaagtcattcaaatagttcaatcctatgtcttcggttcttgtattttgatcatgtgaatgcaaaatgtctagtcctatccataagtgaatcaattgctcactgtcaaagatgtaatcttcagggaacaaagcacaatatgtaaaacattgttgtagatggaaagggagatagtcatagctaagctttaatgccggcataatatcattcttaccagtttgtaattcccattctttactatctaggattcctgtccaatgatcaatatcaaggtgctttctcaacaatcttcctacagtttttgccgccaaaggggagcccttcaattttttggctatcatttttccagtctcttgtaagttaccatgatcatttactgttttctcatcgccaaaagcatatgctttgaataattcccaaaacattttaggttccagcccttccaattgtattgaacaattagttgttttaaccatttccgcaaccgctggaaaacgagtggtgactacaattatgttt

SEQ ID NO: 39991 - DNA, 5292 bp, Oryza sativa
  unsure (1)..(5292): unsure at all n locations
gcctccctctctctctctttcaggaccatgtcgttgccagtcgcgttcatgctattcttattttattcgttgccaacctccaccatctatggacaagacacatcatgggacacattcttccatcttcctcagcaccatttggtcgcccgagcaccggcgcccatctttcctcctcttttgtttctcacctttggttatgaaagacaatgaacattgcgtattgtgcactattccttcttggtccagtccaaccatgcttctagaccactcacataatattgagatcataaaaatagaacatgaaaaattctaattatgtcaatgaaacgggcactcatccaaaattaatggattaggttttcatctatgaggtaaaataagttttttttttcaatttctagctaatttcagtttttttctatttgctgtattagttttagcactatttgatccattaaaaatttattataatttataatttttctctgtattgaattatttatagctaaataaaaaaatggggatttagttatataattttcctaatattgaaatatcattccggccaaagttatttgcagtttcatgttgttattttattgattatattttcttcatcatttatgtctaattgtgatatatggtttaggattttaatttgtgtcaatgaatgctaatccattgcaacgcacgtgcattatgctagttataaaaaaattgcttgaaaaaaatcatattaatccatttcttaatttttaaataatgcttaattaattatactctaatgagctgctctgttttccgtcctaagggtctgatgcttggattaatgagcaatcgattgcccaacaagcacctcaccttgtggaggtagtttcagctcgactgcgacgctcccgaatggtggcggaggccatcctccataagcagtggacgagggacataatccaaggtgcactgaccatgtgactgatcgttgattacctctgtctttggccagtgatcgaggctactactctgatccccgacgtcggcgaccagatggtccggcgatggtctagtgatcatcaatacttgtcgagttcggcctaccagctcttcttctccggcatgcagccgttcccctgctggaaagagctttggcgggcttgggcactgcctcgatgtaagttcttcctctggctcgcacttcagaagagatgctggatggtggatcgactcctaaagcatggcatggcctagacacacatcctgcccttgtgcagccaagatgccgaggacgtcaatcacgttcttatctgttttgtcttcttgaggcaagtctggcagaaggtgttggccatcgcgaggctcactcttgctgcgccaatggaccaagacgacctcgtcgactggtggtccagtgctcgatgatcagtggacaaatgcaccttgcctagcctcgactctctcatgctactttgtgtcctggtgcctgtggaaggagaggaatgctcgggtcttcgacaacaacctatcctcaattcaggcggtggttgatgagatcttgcaggaggttgctgctagcatagcgcgatcgtgtaaatgtatttttcacagcttctaacatattgacatgcaaaacttttgcgtgttatgaaaaaaaatattcaggtaatgttcattcagcttctgagcttcagctcgacttctgtcagccatttcattaatcagacttgttaccagactgatgcatcacaaccctttccgacattgcactgtctgaatgacgtgcgtgtagatggttacagattgcacatttcaacttgcttgatgacgccgccctgcagctttgtctgcgaataattttacaggcatgtcgatgcaactatgggagaagttcgatagagaaatggtagtaatctgcaacaataaaacatctgtccccaaaatcagtactctgtctggtttagtggcaaaaggatgccttcttttttccctgaactcctaaagcatatactcctatataagttaaaaaagaagagaaaaaagaaagccagagaacaggccattttacaaagagagatagagaagagtgatatgatatctgcagccatcatctgattttttttctttgaacatttgccgtatccccttctggccagtctgcaaaacagcccgggccaagtcagataaccatgcgcgtcatcctcccggtttacttataataatggaaagatatatcagccgctgcaccaccacaacctatatggctatattactagtgaaataacaaagtacatatgtttaaaattgtaaaatttaccagacagggtgtagaaaatgtcccttgtaaccagcagcctccttgactccttcgttagggacttgcaggctacacctactgcagggaaaacagaacttaggtgtgttttacagtctttccttggcaaaagagatgaaacaattatctttagaaagcaacttacatgaaaaaaagaaagttaatgcaggagcaaactatccagctaaggatgccatagtacttctgaaactgttgagattagttaaatcactcctgctgacaaacaagtggaagttgttcgctgtcagaggctgagggaaataatgaagatcgtatttcatatgattcaaaaagaatgtctgtttctactgtgaagttttaactgaatgtctgaatacattgcaccaccttgatgaactaaagaagaagaaaaactagcatggcatgctgataagttttaacccgtttctcgaactaggcttacacagtgttattagttccagttcatcagacagctattttgtgcatcgaatctcatggtgtcaaattcaatgatcaaactaactagtaaaattgcagtgaaaggcaacagttttctcaaagctaataattctattaaaacctggaaccggttaaagatctgatgaacttgtatggtatcatcaaccagctttgtgtatgtttttcaaaacaacaacaacaacaacatcttttgtgtacagacgaaggaagaagcacaatccaacactaccacacctatcaacataaaaaaaaggttgtgcatggatgcaaagaaaagaagagattctgagagggataaaataggagtaccttggattagtactctctatctttgatgatcggaattgttcctcttagcttgcggcactgccttttgagctcctcgttctcacaacgacagacatctagttcttgcaatgaactcggaaggccacccttgggcagtgaacagatggctggacaccagtcgatctctaatatcttgaggccgacgagtctgtgtaacccagtggggagggactgcagcttccggcaggagtaaaactcgaggtcctggagggaggagaggagcagaagggcctcactctgctccttggtgatgcgctccacctcatgattaaaaccaatggttagcttggtgagtgatgaagaaatgaggctgcagattggtggtgcaaggacccttgcaatgtcatccgtttgaagctgctgcagccgcgaggggtcagacctgacgaagaatttgggggtcatttggatgcgaaggtctgtgagttggccatggtcgagcagagaagacaagccctcaccacttaagtccatacatttccatatggttaatctggtgagagagctgaggtttgagaggggagcaagagtctccatgcctctcacatcactcagatacatcttttgaagggaggatggaaacgggaaacaagacaaggaggtcgagtagtagtaggagaggaaagtggggcaaccccaaatagagaatgctcgtagggagtgcaggccttgtaatcctcctcntatgcctcttaagcctccttccatgccatttacaagagaatggatctgcaggatcagctctgggatttcgctgatgttcaactcctgaagttggtgaggcaagagcaatagtcctgcttcagctgacactttctcatcctctcctcttggttgttgctgctccagtccgaaacgagcatctccaacttattaccacaaggtgatgatgacgatgccaacattgttgtcatctgcttccccagcacaccaagccctcttatcttattacatctccttgaaataaacatggagagtttggggaaatgagatagaaacaacgtcaattccttcccgctacaaccacactcaaagatctccaatttctcgattggaaactggtagctgacagtgttctcagattcaagatgtgacatgacattgcttgagtcagatatagtgagtctcctcaaacatgatagcattaggaggtattccagcggcaaaggagggcatttcttcaaatccaactctttcagatcagttagattaccaaaaaccaatctcctccagaatgcaccatctagatgttcatcctttcccttgactagcatgcataattcatattgcttattttttgagtaatccaactgctgaaaatccaatccaactccttcaatcagcgcacggcatggagagcctctccaaggaatgggagggaatgatgacagctttggacaattaacaatctcaagctcctttagtgtacggagttgggtcaagttcatctcttgctccgatcgagggcatgtggaatgtgaaaatggcaactccgtgagttctggacaatctcttatgatgagcacctttagcagagagaacacaaagcaagaatcatttccaacccattttgctagtctctgtatgccaacaagctctaacctttttaaattcggaaagctcctctctgttgtacaaaccagggattcttcaccatgctcattaatcaacaacaacttccctagaggaggaaatttgttccagtctacaccatcaagacgaagagtttgcaagcctttgatggacaagttaacacccaaccatgaagggcaagtagtgcccccacgcccattaatgtgtagctcccgaagattgctatgtggtttaagactttcaaggatatgctcttcttgtaaagaatcctttgtcaaacgtttaatatcacaatctaatatcaacttgtgtaagcgacttttgtttgaaagttctgcttcctctggtgcctgcgcattttcaagattatagatgcccaatgacccttttaggtcttccaactgccccagctgtcttagtgcaaatgcctcaacttgtctttgaacttcaaatctccttaactcttgtaaacattttagctttcccacactagcaatttcagagtgaagattatcatttgggacaagaaaatgccgcatccttac

SEQ ID NO: 39992 - DNA, 1776 bp, Oryza sativa
gagggcttttgctttacttaacaaattacaaaaggaatgacaaagcttccattgttttttccaaatatcattagagagtgtagcttttcgacatcaagcctcttacttagtgtgccaaaatccttcttaatattttcaaaagttgctctgtcgtttacgtccatgtcatctatcacaatagataagtgccgtatagatggcggaatttgcatagacattactttagtattacttatagaaagatattcatatgatgaaaccttcaatgctaactcatgtagtaggtcatgcatagtgtagtaaggtgacccatcttcattcacatcttttatgaaaaatccataattaaccaaatcattcaaatatctcaacccaatatcttcaattgttttgttttcatcctgggaatgtaaaatgccttgccctatccacaagtgaatcatctcctcactatcaaacttgtaatcttcagggaacaaagcacaatatgtgaaacattgttgtagatggaaagatagatagtcatagctaagcttcaaagctggcataatatcattttcactagtttgtgattcccattccttactttctaggaccctcatccaatcatccaaatcaaggtgatttctcagcaatctacccaccgtttttgctgccaaaggagagcccttaagttttttcactatcttttctcctgtctcaagtaagttagcatgatcatctattgatttgtcatcaccaaaaacacatgcttggaataattcccagaactcttcaggttctagcccttccaattgtattggtcgatcaaatgttttcaccatttctgcaaccactggaaatcgagtggtgactagaattatgtttccctttgtcattgcttttctgaggggagctaagaactttttccactcatcctcattatcacacttccacatatcatccaagacaagaagaagcttcttagatttcaatctttgctcaattgaatcatccatgtcgacatatttctcatcatccttgagtttaggtatccactttgagatctcttctttcaatctatacagattgaaattgagagagacgcatacccaaaccttaacatcaaaatggttatgtacttccttgtatatgtgctgagtgagagttgtcttccctattccccctggaccaacaattggaatgacggtcaaatccttgtcacagtaatcaccccgagtaatgtcctcaataattctacttctatcacccttcctcccataaaattcagggtctataatccctgaagtagttacaggacgattcatagcaacgttgcttggatgaactagcgtttgccctggtttccttgaaaattcagcattgatactgatggcaatgcatgattccaacagctctagattaaggattgtagagactttggcacatacgggcttcaattgttcgacgatgtgcttcattcttgtggacagatccaccctatcgaacttcagctttggtgttttcatggtagatatgtgcaaggcaccggagtcatcacaattgtcaagaccaggtgcaaaagggaagcatggaaggtgtttaccaacgagatggatggtgctctgagcactgcaagcgaggatgcgcatgcagccgctgccagcaacagcctcctcttcgttggcgtggcgactcgcttcctcgtcaccaccgcacgagcaagaggcagagaggtaccttctcttgatgtttctggcagtgtggtgagcgttgagcacaaggccaaggagacag

SEQ ID NO: 39993 - DNA, 740 bp, Oryza sativa
agctgcagggatatctaatgaagtttattaccaagaatcgggcggcatgccatccatccgcctgtgcgatgcttcagcgccgggttgccatcgacgccaagagacccatcagtggtgttgcttcttcaacctgcagcaaccaaaatccccagcctagttagcactgaacgtatccatgagcggctgcttcaaattaactaggagtagctagttcaggcaaggctcaatcaatatttttctgcagggaaactgatgagaaattaaacaaactgcatcgtggaaatcggcataaggctagcagtaaggagattatgaacagcgattaattaattacctcgggttgtagcagcgccactgcgtgttcctgctgctcagtgtccgtggacgccattgccggagccggtcgagagctcgaggacaaactgtacaagctaatcaagacctcgagaggatatacaggacaaccttatcccgtaccaactctatcagagacccaaaaggaaaataaagcgaataaagattagtatacaagttaatttagatacgaaggagtatattattaattacctcggcatgcataattaattgtggtttctgcgacattgaagcctcggaaattattgttgctggctgtactagcgtctatttcttgaacaagactgagaaatcccttgttccttttgatttctttagtcagtagtgtcactatccgcaccgatttattcttggacgtttccttt

SEQ ID NO: 39994 - DNA, 724 bp, Oryza sativa
agagggagatcttgtgccttcgatttttttttttaaaaaagggaaaaaataagcatcaattctttgactgtaaaggttataagtttaagggtgtacctcttcattccagcttgtacgaagcagcatgacaaccagcgctaaaatttgcactgtcatggcgcatattattcccaaccaaagtccctgcacagaaaaccaactcagagtgggattacgacagaacttgcacaacaatgtcatgccagaattgcatataaaaaataaaatttaccttaccatcgatcttcagaacaaatgcaaaagtaacagctgaagggataccaattgtatagtaagcgcacaggttgataacagaacagactttttgccagccacaccctctagcagcaccttaagagtcataaaaaaaataaacaaatggtgactaagatcaataatattgaggtttgttggcatcatggttactatggatgtgatataataaaggcaacataaaatatttgaccaaggttaaaaaaaactaaattatgtagaaatatcatgaacaataacaagtctaaaatatcaaaagattacatcaccccccagaaaatggcatatgaactagcactctttgttctttaaaaaaaaaaacagaacaaaaaaaaactagcactccaatggtatgaagataggagaagccacatatttttccatcccttcatttaatccagtggaatatgag

SEQ ID NO: 39995 - DNA, 7362 bp, Oryza sativa
ggggatccctttcccgaacccatacgtgtttcggtcagtcttattgtaaccggtttgtcgggaaatatacgtacccagatttttccaccacgacgtgcatatcgtgtcattgctcttcgtcctgcttctatctgcctcgcggtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattcttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggactctctttgttattccttgaaatttttatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctattttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctattttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcattcggcacgcgcaatttcttttcccgcgagacagcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcccgagtccatttttttattatgtgtaattacttcgaaacttgagtctgcttctatttttctattcgagccctttttcctattcttttgtatatagttcttgatacaattccgtattttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagataggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttctttttttttattttgaatctttctattctgaattcagttaacgacgagatttagtatcctttcttacactttcataactcgtgaaatgccgagttggtacgaattcccccaatttgcgacctaccataggatttgttatgtaaataggtatatgttactttccattatgaatcgcgattgtatggccaaccattgcgggtagaatgctgagaaagttgggctgatcgtagccgtgcaataacgatcggacggtgaatccgagagctcccaccgcttcgagtccgtacgccgccgccgcgccggagttcgccgtgctcccgggcggagacaaccatggctgctccgcctcgcctcgctccctcgccggccgtggcgcgagcggggcagcagggtaggcgccgccgccatccacgccggagagagagagagagagagagggaggcggagaggagagcccccgcctcccctacgacgctccgcggcgcgagaatgcgagatcgcggcggctccgccatcgatccctcatcgtcgctcgcctgctgctggcccgcccttgccggctaggtggctggctggctgaatccacaagcagccatgatcgatcgggttggtggtggaggaatggaggatggttttgggtgctctcggtgttgggacagagacaggaggaagaaaatggctggttcaccgggccatctgatctgacgattactggtatgtgttctacttcctgacagaaaaaatgaccaaacattaggatcatgagttcgtttttctgctctctggagtcactgcaaagatgaacaatgaaaaagaaagctcatggatggtctatttagctagattatgacatacggaatcaattcgatgtatgtacaaaattcaggtagtcctatgagaccatctaaacatgttctagattgtaccacctctgttccgaaatataagcattttttgttaggaagctggacagagggacgtctagatatgttgttagaaatgtttatattttggaacatatggattagaatatagtttaccagacatatattgctacgcttatttgactgatcaaatagtttatcaacaaacttttaatacactacttagctcggtaaaatgtacccttctgtttgacgaataaagatctctctttcgtcctccaaaaagggagtgtggaagaaaaatggaaaggcttaaaaacaaatactgaagaaaaggtatagaattataacatccatgtgccaggtgtagaattaggttgaagggaaagccatggcccatgaaaaagatatgcaaatgaaaagtgagtaattaataccaatgcttcttcttttctcccttactccacaaatatgggcaaacttaatgctgttttcttgtgaggctgacacatcaataaggctgcaaactattaaaacaaagattcataaaaaaatatctactataacatgacaagaatcattcatacacgaggtctcgatgagtttgcaaatccaaatcacaatttacaaaaattatcctttttctttatccaccagcttctgtttaaagtattgaaatgtctccacatcatacctgttgttatcaagcaaaggtaaactcacaaaagcaacaatcaatatctgttttttgaaatgcaatgaagctgattattgcttgatacctaagctttgcttgctttcaaatcagccggacatgtttggctgggtaaaacaatacttgttgtaataacccattgtataaaatggcattcagtacaactgtcactgtggctaaaatctttgaagtttgaagaagggttctcagatcaccagtaaaggaaaactcttgtgggaaacaatgctgatgcttgattccatttgcagttaagatgcagcaatgctattttgaatgataatgacgagaagttcatgttgaaaaaattggttgattttctgtctactccaactatcgtattagtattcattccgaattccatttagaaataaaacttacatgagttaattgagtgagaaattaattcttcccaaggatcatatttttctgcattacaagaaaacagaaaggatatagtttctgttaattgctgcagaataaaacaggcattttttttcatatgccctgttgctcactatgtttgtcaagtggcagtggcttcattttatattcccattcttaaaagcttagcttgatggatttggtaaaccaagaggtccttcatgtgtcgggaatgcagaaccatgccgcactacatttcagcccacgagaaatatggtatattctggaaaaaaagaacataatgccaaccaatcgatatttttataccacgggatcctaccattgttcccattccgtaatcgggtcaagtgagaaaacttcatgatgcatgaaattggatgtctgccgaagtgtagaggatctgcgaggttccctgtccaacgttgccatggttcaattctttcaactttgggatgaactgttgctcttcaacctcggcaatgatcctgacaaaatcagatggaaaccaggtcctgatggtgcattctctgtttcctctgcctatgatatgttttttatggcgaggcaaagctaccccttcggacaacacatttggcagaccaacgcgccatctagagtacgattcttcttctggctggctgcaagaggaaggtgtcagacagcagataatctggcgaagaaggggtggccacatgaagacagatgcgcactttgtatgcgcgaacaggaagactgccatcatctatttgttacctgcgaattctctgggagagtctgggaactaatgcgtgcttggatcagtgtcgacttcccgatcccaggtcagattgattgcagtctaatcgattggtggtttgaagccaggcgctgttttcggacgggctatagggaaatcttcgatgctgtcctcatgttagtatgctggttgatatggaaggagcgcaatgctcggattttcgagcaaaggttgcgttcccctgagcaattggtggaagacatcaaggaggagatcaatgtctggaggtcagcagcagttttcaaagaagtgcaacaccaatagcttgtaattgcagtgcccttgggcttttattttctcgcttgctgggttagtggctaggcctctttccctctcgacagcgtgctgtcgttgtaagcgtttttacgtaacaaattccccctttcttaatgaaattggtcgaccgaatctttcggccgacccggcaaaaaaaaaaaaagtgttcaggcaacatggcgatcactgcagttagattactgtgttgatgtttgactctcaacttttggtcaatgctataaaaataattcattgctcctcacccccaaaaatccctctttgctctttaagttgatctttatgttagtatttgatgtggtttcggatttattctgggtatggtggctacagcgacacagctacacttatttttcccttttgcagcattggctctttgttttgttcggattgtgtttaattacatttggctttaaattggaactgaattatctgttttcaggggggttggagtctataacatatttgttccataatcgaatgtcggaactaccttatgcttgaccaaatgccagatccaattacatggcttgttcatatgcattagttgtgtgtaatgcaacaagagaactgtgcctagaaattctggcgatcttcaagagtaacaatgaacaaccttgtcatagctacatctatggttttccatatccagctgcactgccttgttcactatgcaggatggtactctcagcactacaatgtccagacatcataatttcactacatgtcaactgggttgtcagttgtcacatcatgtttccctcttgagctgtaccttgagcattttgccacctatctgtgagccattcatcctcctgatagcagcctgagctgatgctggtgtgtcataactaacaaagcctgcacagaagaagcacagaacatgaataccacacagactctcattgcagtgactatgcaaaatacagagttgcagtgcggtttaccgaaacatttactgacaccagtagctctgtcaatgaaaaccttggtactcaagatcctaccaaattcttgaaatagatttgccagatcttcatcaccgtattcttgagggatgtcatagacaaataaattagccctaggaggtcctgagggttggcataagtaaaatgaccaatcagctaacgaaccatggaaaatgcatcttatatgacacagtaagcttaagttttactaaccttcaatcttactccctatctttgtgtttgctgcagatgaggcatgattgctatgactgtttggtatgtttaccttaccatcagagaaatactgtggtgtatctcccactaaggcacctgcatatgatactgggtaatgaagacctgacaaatcagggtaaggaggttgtatgtatccagcagattgaatcaggttcgaaattttaggatctgttcctggaaatatatttgtgttgagtccctggagtaaatttccttgattgacatgtgggtacatagtgctgtacaatgccaatgggttcttcgtgtgtccataatgccctggtacctgcaaaaatttgtgtacaaacct

SEQ ID NO: 39996 - DNA, 15955 bp, Oryza sativa
tatatccatgcatcaggatttgtgattctgatagcagaatcacaagtgaagtagcatacaacatgaagaatatcatcgagtaaataactcttaaaataggctataacctataagagctcatttaacactactatagtcaaagttctactagcaggaatttcaagcaatcctgtcctttggaaataaacatttgaggcagtccttcactaaagaaggaaagatcgggaacaacagaaaagatgggccagtgttcaaggtgttacctctaacgttttggaatcacactcattaggcttatattgcttctcgtcatgctctacaggtaagagagaatgctgaattggctgtattggatcattatatgtaactcgattctctaataagttcaccacgctcttgagctcagtcactagcatctcaagtttgtcgtttgtcatcttcattagatctttcaattctggatccgttgttccttcagtctgatagtgaccatgtataattgatagtattagaaagaggatgattgctacagaaatagcggggaggggtaaagcttgttttgtagagtacatattttttttaaaaggaacatatagctctagtttgttgaatttctagtattgacttgaacactagataaatgaaatgtagctagagatcttcatatgcatccagctcaatattaatctgacgattttctaaaggcacacttttgcaccatgaggtgaatcttttgtctgctcatatactatcatactctaatgggatactatccaagccctggcttagtttatctataaaaaaaaaatgtgattcgatagctagcatagttcagataataataaatgagaagttgagaacaaaggaaatatgtttgaagctagctcctcatgtcttaattctatgagttatctataatgcagggatttcagtaccagaaatgtactccctacatttcaaaatatagggtgtattttattttgttatattataatagagtatgttagtcaaagccttgtcctaacgaaaacaaaatacaccctatattttgaaattgagggagcccaagcattcctatatctccagttcccatcatttctatgtcagaattttggtggttctgtattcgtttgagcagttgcaattgataaaataattcagatgaaagatcaccttgtaatccaatacattatatggaggaagaaagctcatctgtggtgctccagatattgatagcagctgggggaagagataaaatcttaagggcttagaaggttgagcctgagctttctgtgcctttctagcttgcttttccctttcagtgtcagccaacttaacaaccaaagtcgcacttgaaccctaagtggatgtcgtgaagttgttagaaaattcagtaaagttgcattccttgtttcttcagtaaagatcaatttgctatgttgtttgcaggaacaaaaccaatgttgcaggctggagagctctacacagaagattcagataggagaaggcttacattgaacacaacacgtgtgccattcaaagcttcaatggccgctctagcatgttctttgcttccaaattccaggatagcacaggctgcagcttttttgtttataacaaatcaaggatgtgagcactaaaaccattcatagtatttcagataacaaaaacgagacgatctgtaagttctactaccttttcttgttttctgtggacttctcagtaccttcagttgtctaatatttccgtactgcgaaaacaatgcagaaacttcattctccttcacatcccttggaagcatgccaatgaaaagcttctgctctgcggctgcgagtcaggcagcaaccgtttcagagtacaacatcagcagggttgcaagagtgtcacaagaagaacaatgtcccaagttatttaggaattaggaccaattcttctttgattaggaatcatcagtaccaaatacattgtattgggaaattatacctaatcgttccagctcgccgtccgcgtattttacctgcattgccctggacgcctgattgaggcgacaggaacagaatttgtgttatcagaactacagaattgacaatcatagagcacatatcatctcatcgaatgtagaaaagtgttagtatatttaatccagtcctactttgcatcgccatgatatagagaccgaggtatttattccattatctaaaagaatcataattttggtatctattgcatatatgaaactaggatctagaagttatactacatcaaatccaattcaattagcctgcgtaaaattgcgtaggggaggttgtcttatcagaactacagaattgacaatcatagagcccatatcttgtcattggatttcctttttgataaataatctcagtgaaaacgagctttttcctgtctgattctacacaaatcactaggaaccaaaaagaacatccttttccaatctccatgaactgttcctgtctccatccccatcttcagaaaaaaaaatcaccaaatcaatcatggatagaaagatacttgcattgccctggatgcctgattaaggagacaggaacaacatttctcttatgagaacaatctcattgaaatttgacacatattatctcattgaaatttctttttgataaatatagtctcaatgaaaatgaacaatccctatatctgattccacaccaatcatgcacgaggcacatctttagtcacaaaaagggaaaataaaaatcctttacaatctccttttccatccccgattccagacaagaattcaccaaatcaatcaatcaatcatgaacagaaatcatgatttttgttgcccccaccccaaattgtatccaatcttgcaggtgaatgcaagtgaagaacttactcctgggagggtgcacttgttgtggtacgcggcgatggccttgtctgcctcctccctcgacgagcacaccacgaagcagcaacctgcaagaacccaaataaattccaaattttcatcatcttcttcttctgcttctcacacacgggcaagagcaaatcaatggctcaccgcgggaggcgccggtggcgcggtcgcggatgacggtggcgtcgtcggcgcgtgcggcggcgcggaccacggcgaggatgtcctcctccgccatgctgcgtggcacctggccgacgaacagccgcaccctctcgccgccatcctccccatctccggccatcgccgccgcgatctgtgtctctctctctcacgtttctttccttttctgatggcgcctgtccgtcctctcctcgttcttgcctgcgcctttttgctatctctgacgacgagcactaaccactgactgattgtttgattgattgatcagtatcagggtctcgatgagtacaagttaattaatcgatgagtagtaccaccaagatcttgatctcgagtaggagtaaatgtgatcgaatcatcatctgattgagcgaaaagcagcagcattgaatgagcagtttggtcgagatggagtgacgtcgcgagcgatggtttgctttgatctttctttctggtcttgctcgcctttttttctttctttttctgctgcagccttttgcattggcagtttctctcctttcatttgcttgaggagaagcacagagaaggaaagagtgaggcgaggaggaggaggagatggttttggacggaagctgcagttcgtgcaagtttggcattagagctcagagactctcacatggcgggaccaaggctcgttttttttttcttcacgacaaattgagataataatggttattagaattaaaagggattttaatttcgtcgaagggcatttggtctagtggtatgattctcgctttgggtgcgagaggtcccgagttcgattctcggaatgccccttaatttactttttttttttttgtttttctgagcatgcatttcctgaagttttttttattccttttcttccatgcattcattccttttcttttttcctttgttctttttgcatgcatttgttgaacactaatcatcatcttccttcttccttttttctgagcatgcatttcctgaagtttcttttccttcttccatgcattccttttcttttttttccctttttttctttatgcatatgcatttgttgaacattaatcatcaactttccttctgctggttcatccttcgggcaaattagcatttcctttctttcttgacactgtataattgatggctagttctctcccaccatatccatatgatttaatatcctactttaattatacaataatggcacccacaatggttatccataggctctctaccagagatacatgtcagcatattttcctacttgaaagagattaaatgaagagagagagcaaagctatctattaacctggagataatctatagagaaaaacgaggcaatggattagagagctatagatacccatgtagacataccattgaagtggtttactattaatctagtctattgctgagatgtacatgttttatagatagcaccttactttaccattgcgggtgctctagtagctccgcaaatcccactttaatatccttcaatgatttcacctttcctcctcttcccctattacatctttcaccagcaccaaaccctagcagacgttctctagtacttcctccgtttcacaatgtaagtcattctagcatttcccacgttcatattcattaatatcaatatgaacgtgggaaatgctagaatgatttatattgtgaaacggaggggtactatttcctcaaatcttgttccacagccctaccgagctaggtcacatgcaaacatcgtcatgtgcataatgtcttcagtcttcacatcatcatggcctcatggggcattaggacagccttattgccaacatgtctattggcaagaatgccactgaaaatatcagattaagcttccatagtttgtcccaaaaatgcttgtgtcttttgcattttttcaaaagccgggtaatataatgaaaattggcaaatattgctactgtggacgaagcagacagtctgacccctccccttcacgtcgcaccactcaaatatgaatatcatgctgcagtgagctgaagatcactctggattattctcacatgtggatgcatgtaaagcatgcaaaaccttcagatttcagactagacagcgcatcagatttcaatcagagcatgtgtttcgctatgcaacctgtacgttcagaacttcagactcttgagtgacagcattcagatttcattagaggcagcaagcgtttcactaatcactatccgagttttgcgttccgtgatgaagttaggcgtaggtctcatcagattatttactactgagtttttttttatttttgaaactttttaatttttaaatttaaaaataaatcttttcaaaatttatttataagatctaaactttttgtcactctaattgaattggcatagcaaaacaacactatcacgagtgttattttaccatgccggtatgactggcgtgacaccgttatctcgctttgtttggtgtgttagtattgttttaccatgtcaaatgggctggcgtgatttaaatgttcagattctgaaaataagttttagaacggtatattttttaattaaaaatttcaaaaagaaaagatctactactgaattgttgaaacgtattatacgctccatacttcaggaagtatataaacttttttaaaattcagtagtatacttgtatttatggccatacgtatgtgtttttcatgtcacaactttaataacttctatttaataaatttatatgtttacgaagtgacatatcacatatttatccatttaattaattaatttttaaaaaagaattaacagctatttagatgaacgagggtttagaatacttttccacgcagatggtgatactatatatattgagttgactgttcaatttaactcaaaagctaacatgatgagtgaagaggagcagttcaatttatattcctagcactactaatgcacacggccgcacgtcggcgccggcgacagataccatcaaaccacaccgcgttccaacgaggagagatcagaccagatatatatctgatatttatctgcatgactagtattctctcccttttatattataaatcatttgattttttttaagtaaaattttgttaagctcaattaagtttatattaaaatttagcaacatcaaaaatattaaattagttttatcaaacgtaagattgaatttattttgataatatgtttatttttttacttaggaaaaaaaaccaaacaacttataatataaaatggagaaggtagtatttaaatactcctccatgatatcacccctggctactcatgggctattatactatttgccatgagaaacgcttccaagaaattatattcgagtgaactaaccaatcatgttaacctgtcattattatactgataatttattctcaaatcatagctgcaagaactacgatctcgctggtcgctgctattatctttggattcgtcgtttctggcatctgttactacgagtggaataaaataaatactagtttttgccaagataatccaacgtcaacgtaactactgagccactagtgttataaataatcagcttcgagaatggagatgtagttttttttttacgagggagaatcgagatacagttcatagcgcagtgataaatggtgtgtgattttaacctcgagatcccgtatttaattcctaacatgctcacaatttttcaaaaaaatgtttggagggatgtctctcatttcaaatctttctttttattataaataatcagcttctctccttgagctactcgccgaggcacactttgactgacacttccattgcagaagaagcagaagagacagatcaaagatcaagatgttcagagcattgcagatcgtcctcaggtatagttttacatgatcctagctgcaaattaaagcttcatcgctgtcaagatcgccttggattaagaacaagaacagcttaattacttatatgtgtttttgtgcaattttatatatttgtgtgttgggtgcaggggtaagagccgaggatttgtcagtcacttctcctccacggcttcaaattctgaaaggttgcaaacttaatttcagcatctatttatgtttgattttttttttgttcactttgtgtttggttgcttgcgggttgtgaatcatggagaagcattgcgccgtgacgtttgatttttattttttttttggtttttgatttgcaggttggctgggaaggtggcggtgatcaccggcgcggcgagcggcatcggcaaggcgaccgcggcggagttcgtcaggaatggcgccaaggtcatcctcgccgacgtccaggacgacgtcggccgcgccgtcgcctcggagctcggcgcggacgcggcgtcgtacacccgctgcgacgtcaccgacgaggcgcaggtcgcggcggccgtggacctcgccgtggcgcggcacgggcagctcgacgtcatggtcaacaacgccggcatcgtgggctccctgtcgcgccccccgctcggcgccctcgacctcgccgacttcgacgccgtcatggcggtgaacacgcgcggcgtcctcgcgggcgtcaagcacgccgcgcgcgtcatggcgccgcgccgccgcggcagcatcatctgcgtggcgagcgtcgccggggtgctcggcagcgtgacgccgcacccgtacagcgtgtccaaggccgccgtgctcggcgcggtccgcgccgccgccggcgagatggcgcgctccggcgtgcgcgtgaacgccatctcccccaactacatccccacgccgctggtgatgcgcatcatggcggagtggtaccccggggcgagcgccgacgagcaccgccgcgtcgtggagcgggagatcaacgagatggagggcgcgacgctggagcccgaggacatcgcgagggcggcggtgtacctggcctccgacgaggccaagtacgtgaacggccacaacctcgtcgtcgacggcgggtacaccgtcggcaaggcgcccaacctgccggcgccgccgcaataatcaacacgagaatcggcgaacgaataatggcaacaattatgcattattactccgctaatgaacaaatcatatgcttctcgttgtttttgcatcgatcaaatgcattgttgtgttgggatcaaatgcctttgtttggagtggatgaggttttgggctttttgcccacgacaaacaatgtcaagagatgctgctccaagtcttcttctttctttgtttaattaaatttcacaaaacgaaagatatatcaatcaagttatcacaaaactatatatttaaaatggtgtatcaaaaaactacagagttagcactaaatttaccataaaattacaaatttaaggtgaaatatcataaaaatatagatttattaataaagttatcacaaaacagcacatttagctttgtaatacttttattattaaatttatagttttgtgatacttagtcttaaacttatagttttgtgataattttatttttaaatatgtagttttgtgatacatcaccttaaatacgaagttttgtgataatttgatcaaaatacctgtattttgtgattttttttcttgaaatgattaaagaaagaaatgctattccaagtttgcgacccgtcggtcacaatatccaaagctcgcatgcaaatgcagtccaacaaggtaagctaagctagctagcgggaaactattttaaccgctcgagtagatgtccaaccgtttattgtatgtcatctaaatgattataaaaaaattaaaaaaaatatgaataagatagatcaatatgtaatgtatcaatccacaaacatgcatgttaaaattcaacttctacatactataacaaaaataacaaacaaaactcaaattactatatgtatatttatagttaaattttttatttttgttacaacttgtagaagttgaattttaacttgcatatttgtggagtgatatattacatattgatctatcttgttaatttttttgaaaattttttgtaaccatctagttgacatgcaataaacgggtggacatcttttcgagctattagaatccatctccatagctagctccaaaatccgtacagtgacgcgcaaagtgagaataattcaacttgttaggatttaggaatcagtctacccaaatttaaattctaaattttacatgggtgctcgtatttaagagtaattatcacaaggatttaaatcctaaatttgacatagatgctcgcatttgtgacttattataaaaaaatccgtatattctattacacaacaattattttattaaaatagatgggtaccccacgcattgctatcgaagaattatatggtaaaatagtagatatgagttatgaaattttatttcttacttactatatcattttctttaatgtgcttatatatttagcacttatctaaagattataaatgactgtgttgttactatcttttggggagaagagatgcaattgccccgttgataaaactattcaaagacgaaaaacaattaagatgatgtggcttcattagagaggagagaattagcattatctatacttggtgcagataaactttatagatatataggattcacgcacgtgacagtacactaaggttgtgttccgtttcaggggatgagagctaatccctcccgcacgaaaaaaggagcgatccattagcgcgtgattaattaagtacaaaaaaaaactaggaaacgggattccgttcaacgggataacctacatacatgcagtggcttacatggagagatcaacccagctctatacaaaaggcaagggcccacatgcatgtcctatccttttttctcatccatccatgcagcttatgggtccacgtgcatgtgcgtacatgcttgacgttttgctcctgcatgtacggtgcccacatgactttggcaaagaggtcgatcaattccatgcagtaattaatcatcaatagtgaatacacttattagatcattagtacagaaatataatccctcatacctaatatgtattataacttaaaaaaatatagtgcaaaaaatggttccttggatccgatacctacatatatcgtaactgatatctcataagtatcatcactagtacccatgtatcatcaccaatacctgataggtatcatcactagtaccagataggtatcgtcaatggtacccatgtatcattaccggtacctacatgtatcatcatcggtacctcacaggtatcatcactaataccagacaagtatcgttattggtacccatgtatcatcaccgatacatgacatgtatcatcaattggtacctatatgtatcttcaccgataccttacaagtatcatcaccggtacctacatgtattatcatcgatactgggtatcgaccaaccgatattgttacaactgatattataggtaccatcgagatacttggtacctatatcagcatgattcccatatgtaccagatttgggactggatatcgggtatttggctatcaagtaccttgtacctagattggtctgatacctataggtaccatacctagtactaggtatcagggtacataaggtatcatatacctaataccagctgagtatcgggtactaggtacctggtacctgaattgatgttgaacgatacctgttggtattgggcctggtatcagatattagctttagtatcagattccaactcacatgccacgtcacatgcatgcaactagtaacacagccacgtcacatgcatgcatgtagctagcaacacagccacgagtaatcaatagaacgctcctgagaggaagcaggtggcagggccccctagcgacgcggaagggtatctcgttcccacgggatcccgtggtctagctatcctcattaagtattagctattttttttaatttgatttgattaagcaattttcgtatagaaactttttgcaaaaaacataccgttgggaaaaggggtgcctcaagagtccgggttggtaactcttgcctccagcatagaaaacggagcgatccattagcgcgtgattaattaagtattagctatttttttaaaaaatgaataatatgattttttaaacaactttcgtatataaacttttttttttaaagaaacacaccgaaatagcagcttaaaatgtgtgcgcgcggaaatcgagacggggagttccgaacctgcactctcgaacgcagccaagtatgcatatttttggcccgccaggccacgtgctgtgttttctttctttttcccccaaaatttattcctttttaattacacaggccagtcgtcttcttcgtcatcctcgatcagcgagagaatataatttgcttctctctctctatcgctcgcggttgctcaggcaagctgagagcttaattcagaggcatcatgttcacagcgatgcatcgcatcctcagcaggtatggcggattcttgtagctgttctccgattcggatttcagaggagcagccagctcagtgtgacagtgtgaagcttactgtggaaacaaatggccaaataattggggttggttgttgtaatgcagggggaggaggacacctgcagcttcgtcttcctccgtcactgccttcgccaccgcctccgattcacagaggtgatttgatcgattcatcttggagttgcattgagccattggttggggacgctgatttcatcttcttgattgcgaatcggggatggatgtgaatgtgatttgcgggtctgtaggttggccgggaaggtcgccgtcatcaccggcggcgccagcggcatcggcagggcgacggcggaggagttcgtcaggaatggcgccaaggtcatcctcgccgatgtgcaggacgacctgggacacgccgtcgccgcggagctcggcgcggacgcggcgtcgtacgcgcgctgcgacgtcaccgacgaggcgcaggtcgcggccgccgtggacctcgccgtggcacggcacgggcgtctcgacgtcgtcttcaacaacgccggcatccccggtgacctcacgccgacccccgtgggcgcgctggacctcgctgacttcgaccgcgtgatggcggtgaacaccagggcggtggtggcgggcgtcaagcacgccgcgcgcgtcatggtgccgcgccgccgcggcagcatcatctgcacggcgagcacggcgggggtgatcggtggcgtggcggtcccgcactacagcgtgtccaaggccgcggtgctcgggctggtgcgcgccgtggcgggcgagatggcgcgctccggcgtgcgcgtgaacgccatctcccccaactacatctggacgcccatggcggcggtcgccttcgcaaggtggtaccccagccggagcgccgacgaccaccgccggatcgtggagaatgacataaacgagatggatggcgtgacactggaggccgaggacgtggcaagggcggcggtgttcctcgcctccgacgaggctaagtacgtgaacgggcacaacctcgttgtcgacggcgggtacaccgtcggcaaggtgcccaacatgccggtcccagatggccattgataatgtaccacggttgatgaataataatgttggtgatgtgtacacaattcgtagtattaactctgtttcatactgtaagttcgtttggactctttttaatcaaacttctttatgtttaattaaatttataaaagaaaattagcaacatttacaccattaaattagtttcattaaataaaaacattaaatatattttgataatatatatattttgtattaaaaatcttgctacatttttctataaattttgtcaaatttaaaaattttgaatagaaaaaaatcaaagcgacttatataatactccatatgaagcagagggagtatattgtgccaatcagattcgtgttatgattacaatgacatttatgtttagaagaaaaaaaaaggggctgtttatatatcatgtgacagaaaattccacctcctatcattcgaattttggaccattggatgtgcttcaagattcgtgcagaccttttaacttaactcgtctcctcctcccccggttccagatcgcgccgccaccctcttcctcccatcccacgcgcgatccaccaccgccaccaccgccaccgccccaccgcgccgccgccagcctcgccagctggccggaaaaggtcaacggcaccggcgagccccctccccctcccccttccccttcccccctcactttcttctcatggcggcgacgacgaggtgcccccgccccgccgtcttccccgtctccggcggctccccaccgccggatccaccaccaccggccgccgcctcctaatcccacgcttgctttgcccctgccgccaacgctggcccaccaccctcctccatccccgcggctttggcggcgtcaccgccgcttcgccgcccaccggagtccaccgcccactgccggtcctccgccgcccacggccatccctataagccccgaggaaacccctctcttccccctccctcaacccccctcctatcctcacccaaaccccaaaccctaatccgccggagttggggtgtcgtcggcgccggagaagaaggggagcccgccggagttggaggagagaagccaatgcacaaatcttggtatggatccaatgatcaaaaaactgtaagatttcatccccaaatttcattcgaatgccatatagcaatctcaaaaaaaaaaaaaaagaggtaagatcactatcactccacggaaaaacagggcgacgcccgcatgaatgatgtgctgaattaacgaatgaatgggccgggcatgcacggagtggaccaactcattcttttttctcaagttaaggaagatgattaattgattatatctccggcctatgtatctatgctgtgttcttttgctggctttcccaacttacccttttttttcgtatgtatgttttttaattgttaaacggtggtgtgtgttttgtaaagaataatggagaagtagaaggagaagattattcaaccatattaatgtttaattaacctcaagcttgttgacacgatagggaaatataaatcttatgagtatatgagtttataaaaaatgatgatcaaatattataatgcttgatttaagacaaaacaagtaatttgaaatagaggattaaattctagcccgattatctcacatgacatccttgctcattctaaagtctaaacccactggttgtctagttttgacttcaccgttgaccacgcttgtcctcaagtaaacacgcatactatagataaaccaagagaacttcaatatatttggtctcttttgaaacacgggattaacaaaacataggaatatgaaaagtatatgatttttacaggaatgcaaatgtaaaacacaaaaaaaaagaatgatttgtttgaatagatatagaccgtaggaatcaaatgcgagagataaactcaaagaaaactttctgagaggttggaactcttgctaattttttcttcaaaatctatatacattgagccattcctttggaatttcatagaatttaaaaagctcaaatcctttatttcaaagagctaaataggaacatcttctatgggatttgaatctacaaaattcattcacaaatccttcgtctctcaaaagggccttaacgtaataaatatcaaacatactccaacaataattgaaaagaaaaagaaaggatattcaaccacattaatgtccagttaagtttgagcgcggccaaccaccttgaagaaaaatccaaccacgtgatttgaaaaattgctacgcgtacgatgaaattcgtactacgttaggtcccatatttatcgcatacaccagagactctgtgttcgggaggagggttcccaacccctcctccctggcacacaaaataaaacatctattattgtataattaattaagtatttactaattttttttaaaaaatagattaatatgttttgtaagcaaatttcgtatataaatttttttaataaaaacacaccgtttagcagtttttaaaaagcgtgagcgcgaaaaacaagtgagggaggttggaaaagggaggtaacgaacggagctacatgtatcgtactatcatcgtatcaagtttagtatcgtactatcatcgtatgaagttatatcgtacgtattagactgctgcgtggtctgtgtatcaatatatacatttctcgtacgatctatatgacgactcctgtggtatatgatgcgtgcaatgcctccttttctttttctctagaagttttcatgttccccaagtcaaaccatacggtggaatagatgaaagaatgcacggtttgcaatgacggtgaggtttgtgagttactattctctttcatgagggcgcctagctcttctgtgttttttcttctagcaattttaccattcaacatatttagtatctcgatgtaccatattttatacataaaaatttaatacctcgaggtactaaattttacactagaaagtatcttgagggtattaaattttatactagaaagtatcttaaggtactaaaagtttatgatattttaaggtgctaaattttatactagaaagtaagtatcttgaggtactaaaagttcatggtacttaaattttacactaaaaagtatcttgagatattaaagtttatggtacctacagatgccaaatatatttggatagtaaaattgctcgttcatactggtttaatggcccatcaactttgatatttgcacatggcctattcacatcatctcggacaatatcgttaccaaatgatgggtgtggttatatttacaacgccgcattttctatactccctccgtttcgaaatgtttgacaccgttgactttttagcgcatggggctgcaggaatt

SEQ ID NO: 39997 - DNA, 6139 bp, Oryza sativa
tatgcctacataaaaatatatttaacaatgaatcaaatgataggaaaaaaattaataattacttaaattttttgaataagacgaacggtcaaacatgtgataaaaagtcaacggcgtcaaacatttcgaaatggagggagtataagaaatcatcctttgacagtacaaatcaacattgtaaccacgttataaatttaaaaaattaaaactgtaaatttcaattctaatattaaattttttctagtacactatataagagaattacgataaaaacaatcgattatttacttgagaaagtagatagaagagatagaaacatatatatactttacataaaaatgtaaaagagatgacaatcacataggctaaaaacgactgcagacatcaagcttaaaaatgtaacaccatgttttctattagcaaaaccacaaaatcatctccgacaacgttggcatcgcggcgcaaccggtggtcaaattaattgactgaattaattactgcttcgtaaatcctccatttcgtgtgttcgattgacactagcactgatcaggacaagagaaaaagggaagaagaagccaaagccattgtgctatctctcgcagaaagataggagagcctgatagggagatgaccatatgcggctgatctaccatctacttcacagtagtagaatttctcagcatgctaggtaaaaaacggaactctttcggatcataaatattaatttcatgtctaggacacgattcgtttaagctgtttaaaattcaagttccgctagaagcacgggctgagttgccaaacatctgcttcctccgttttttaatatatatacaacaccgtttgatttttaagatacgtttgatcatccgttttaaataaaaagttgtgtaattattatttatttttattgtaacttaatttatcgttaaatgttatttcagcttgacttaaaaatattttatatgtgcaaaataattgaataagataaataattaaatatttggactaaatcgtggaaatcaagaacgaaaaagagaggcacgtgctgacggtggccgaccggccttcctgaagggggctcgcagtgcatcaagccaaccaaccggctgttggctgatggcaaaatgcgggaaattcagaattcacttacttcctccatttttaaatatagcacatttagtacgagtgagttagtttagaaaatgaactaactatcctgattagatatttaaaatataaaaatggagataatacaatttaacattaagttattattcacgtgtcacgggtatgtcgacatgaacaatacggagatcggcagtggcataaccccatttaaatcctataaaaatactacacaatttctgaaaattgttaagttgggtatttttcatctttgtccctcatggcgatctcgcgcattgctgtaggaatttatagatctatatatgaagaaaaaacttagtacttaaaatatgatagggatcatggtgtacaacttttgaatcactatgttaaattttaagttgcaattctctgtcttctagttagctttatttcagctagatcacgaagaggaacgatgctaagaaggaacttagcatcaattatcaattattaagagagaagaaatggtgagaaaacccagcgttgaggggccaacgagagcacctggtagctccctaccaccgggctacaacgccgttctcagcagggggccaccaccatccttccatattcggccaaaacactaccttataagtgtgtttagttcacgtcaaaattgaaagtttggttgaaattgaaacgatgtgatggaaaagttggaagtttatgtgtgtaggaaagttttaatgtgatggaaaagttggaagtttgaagaaaaagtttgtaactaaagtctaggtcacggacaaacaggagaagaagaagaacatgctgcttgttgtgactgcaccgacgtctttcgtggaaggacgtgatcctgcggtccggcacgccgtggaataacgcatggcgatcaaagaccaaggacgattggaaggtaagctggctcggcccttcttaagaggctcaaggtgagccagaggccatgatcacatcataccttcttcctaaccttgcaaaattagggaacaattaattcagctactagtagctgaatttggagctagctaattaacaggatgttcagagctgcgcagctcctcctaggtacatatcaggcttaattgtactgtgttagtgagagtgagactccaaattactagttgattaggatgacttgataagtgcatgtccatttgtgtggctggcagggagacaacagagctcttggggcagcaacttcgcctgcaggcttcgtcagtggcttctccacggcttccaactctgcgcagaggttcgctctttggtcaagttcgttgtactaaaacgtatcacatcataaacttttaaacttttaaagaattatatgtaaggatagtgattgagacaattagactatgtttatttataaaatatgtatatattgatgttgcaggttggctggcaaggtggctgtcataaccggtggagctagcggcatcggcaaagcgacagccaaggagttcatcgagaatggcgccaaggtcatcatggccgatgtccaggatgacctcggccactccaccgcagcggagctcggcccggacgcctcgtacacgcgctgcgacgtcaccgacgaggcacaggtcgcggcggccgtcgacctcgccgtgaagcggcacggccacctcgacatcctctacaacaacgccggtgtcatgggcgccatgccgcaggacgacatggcgtccgtcgacctcgccaacttcgaccgcatgatggcgatcaacgcccgggcggcgcttgtcggcatcaagcacgccgcgcgcgtcatgtcgccccgccgcagcggcgtcatcctctgcacggccagcgacacgggcgtcatgcccatgcccaacatcgccttgtacgccgtctccaaggcaaccaccatcgccatcgtgcgcgccgcggcggagccgctgtcgcgccacggcctgcgggtgaacgccatctcgccgcacggcaccaggacgccgatggcgatgcacgtgttatctcagatgtacccggcgtaagcaaagatgatttggagaagatggcggacgccgccatggacgccggagaggtgatggaacctaagtacgtcgctagggcggcgctgtatttggcttcggacgaggctaagtatgtcaacgggcacaacctcgtcgttgacggcggcttcacgtcgcacaaaggatccgacacacgtttgaattagcgatgtgtccaactatagatggacaaatggaccgctcggcccgggcacgaccagacacggaccaatatgaattagtcacatgtgctcctcattggaataagtctgttgtacctccctcatctgtttgggttgtcttatatggctggattaagtcaattttgcatccctcgtctccttgggccatgccttatgtgactagaagaagtctatattgcatcccaaatcgttggatcgggtcgtgccaggccggcatgtcgtgccaaggaaaaggtccaagcacggcccaacaatcgggctgtgctggcacgggcctaacaacaatcgggttgtgccgtgtctaggccgggccaaaaccccgtgctgtgggttgagccgtcgggccctaagccttttggccatctatacgtccaactaacatatattgaacagacaccactacttgtcttggtagtctcgttagaataagataaggttgtcacatatgtgttgtcggaattagaaaaatatcattgatatgatggtagagttattgctgcatgactctagtcatataatttaaattctggttttctaaaagaaatgttaaattttggtgttcataagtatgattgtgtgcatcagtggattacagtagacgactaggcaattttcataatttactatctatatatgtacaatacaataaaacaaaacttgcatgggcaactctaaggaggtatgattgtgtcatcgtagtaaatttatgttttaaattaaggacacatatataaatatttatttataaattatttttttaagttgctaataaatcatccggataagcataaggataaatgaaacgatagaaccctcaatctatcgcaatcgttgagtcactggtagccgcgccacagccattgcagctgcttcctttcattgacagcttggaggataagacacgtgcaaattgccatggaaaattggcaatgccacaagagaagagaaggtccaccttatcaacaacaattaagagaaaccatgtggaagaagctgacactgtactgattccggcacgcaataatagaagacaagagacaaggggtaggtaagatggctggccttcttaaggagaggccatctgttaattagtactacctgatttcaagcaaaggcttgatcagaattaatccatttaattctgctctgccttgcaaggaactttgcctgcaggcttctccatggattccaactccatccagcggtttgctgctctttatttcagctcctttgctgcgaataattataatttagacatattcttttcttagagtatagtagtaatgtacattagtccatataattaattttctgatacaataggaataatttttatcttcggcttctgtcataagacggtgtatttatggatgtcgcttgcagtttggctggcaaggtggctatcattaccggtggagccagtggcatcggaaaggttacagcaaaggagttcatcaagaatggtgccaaggtcatcatcgccgatgtccaggacgagctcggccactctgcggcggccaagctcggcccggacgcctcgtacacgcactgcgatgtcaccgacgaggcgcaggtcgaggcggccgtggacctcgctgtgaggctccacggccacctcgacatcctctacaacaacgctggcatcatcggcgccatgccgcaggacgacatggcgtccgtcgacctcgccaacttcgaccgcatgatggcgatcaacgcccgggcggcgctcgtcggcatcaagcacgccgcgcgcgtcatggcgccgcgccgcagcggcgtcatcctctgcacggcgagcgacgcgggcgtcatgcccatcccgaacatcgccatgtactccgtctccaaggcgaccaccatcgccatcgtgcgcgccgcggcggagccgctgtcgcgccacggcctgcgggtgaacgccatctcgccgacgggcaccaggacgccgatgatgatgcatatcatctcccagatgacccccggcgtgggcgaggacgacctggagcggatggcggacgccgccatcagcgccggcgtggccatcgagccggagtacgtcgcgagggcggcggtgtacctcgcctccgacgaggccaagtacgtcaacgggcataacctcgtcgtcgacggcggcttcacaacgcataaaggagacgacaatcgcatgaattaatgacacacccaactaattaatcgatcgaacacccttgttcgtcgactcgtcagaataataaggttgtggtgcatatgtacgtgcattgcacttgatagtgcagcggcaaggagtgtgtccctccaattctcgtttttttattcccgaattttggctaatatatatgttctcagagttataaaaacaccgttacttttttttataatagaatagaatatttcggcatttgctaagaagagctacagctaattattgcaatctagcactctaaaaagaccattactgtggtgtaggaatcatgggcagggtttaatatatcagaaaggagaaatttttcggaaattcccaacgaaattttcaaacaaaatttgaagttaaacaacaaaattacagaaaatttacctagatcagaatataggtaagtgatcaagtccagctaatccaaagcagagtgacaggagaagatgaaatgcactttatgcaacgatgctaggccagctttgtggcttgtgtcttcgtcctcgtcgtgccgaagagccaaggagctgccgccggcgactccagaacagtgttttgccgaagttcttgaccggagcata

SEQ ID NO: 39998 - DNA, 2261 bp, Oryza sativa
taaaataagttttcaaaaaggaccaaaatgtaaaaatttcagaaattaaagagtaatttaattttaaaaaggtttttaaataaaaataaatttaaaattaaagggataaagtaaatcaaataaatttcaaataattttaaaggttaattaaaataatttaaaattagaaagtaaacaaataaataaggaaaaagtttttaaataaaattttaaaaatagaaaatttggtatcaaaataaagggtttgaaattagatgaatttagatcaaaaggttcactggaattggatttgtggtttgagagatgtggattgctaaagattgaaatggaaataaaaggaaaaaggtttactttatagaagtagggcccactgtcagttccttcttctctttcttttttcttcttccttcttcctgcttccttctccttttctgtttcttcttcccgaataacaacagagagagagagagggagacagggcgtcggtgctccggtggttgaacggcctcgatggcggcgtctaagcgtgttcccgagcatcgcgcacccggggagggtggaggaaggcagaggtagagagtaggatggccggaacggcggcgacaagagcttagctccggccggctatggtggtggcttgtggcagtggctaaaggagaggggaaataggaaaaaaatggaatcaccggagtgaggcaaagcctatggtgaaagggaattggaagaggagctacggaggaggagatcggccggtggcaggcgacggccggtcatggcaggagagagagagaggaagagctcaaggctctgatgtgggggaaaaagaggggacctcgtcgtccttttataggctggggaggtcggtggatggagagaagtcgacgacggcacagctcggcgtcggctcggaatgatgaggggcggcgacgtgtgtcctcgccggattgggcgtcgtcagtggtttggtggtcggtggcggctcatggcaacgcgtggcgcggcgtcgtgcggcggtggcgaaaatggtgggcggcggcggcaaaagcggcgggcgacagcggctgagcagtggcggccgcagcggtggctgtcggggtgccacgagggcccctggtttgctgcggcggtggcgggatggctacggcagtggcgtggcggcagcgggcggcgcgatatggcggtggcatcggaacttggcgaggcggcggcgctcccacggaaggggagaggaggcggcctggcttgggccggctcggctgggcttcggctcagttgggctggcagctcaagaaggagggagtagaaggaaggaaggaatgggccaaatgaatgggagttcggcccaaattgaataggaagctttgataatggaataagttcatctaaggtcccttaacttgtcaacgaatcctattttcgtcattcgaccgcaaaaccagatacaacgggtccctcaactatccaaaccggtgcagattaggtccctcggcggttttgaaggcagttttggctgacgtggcacctacgtggctagtttgacttggtcttgatctgacgtggcattgacgtggcgcttacgtggcaattcgatccggaaaaataataaagctcgtgggacccacatgtcagtttcacatagaaattaataaaaaaaatggtggggcccacgtgggccccacatgtcatcctcaccccttttcttcctcctctctcccaatctcccctctctttcctcactgaccggtggagcggggcgatggacggggcggagcggggcggccggcgggagcgggccggcggagcggagcaggttcgcgggcagagcggcggcggccgcatgtcaccctcactcccctcttcttccacctctcaacctttttgtcggtggggagccggcgcggtgactgggcatcggcggcgcgcgggaacacaaggcaacagcggcgtggaggagggtggtgccattggcgcggcaagggaggtgctggctacgatgggggcggtgggagaggaggagagcgtcggcagcgcgggaaagggcgacgggcggcgcggcaagggaggagttgagcggcggcgggcggcgggagagcgagagagggcgacgggcggcaagggaggagctgagcggcggcgcgcggcggaagagaagctgcgcggcggtggtgaccgccgccgaggagggcgtcgcgacgggcagcagagagatgggcggctgccagttgccgttagggagaaggtgcagctccacgcttctcgct

SEQ ID NO: 39999 - DNA, 3987 bp, Oryza sativa
tccacgcttctcgctccgaccgccgccgctccgcctgccccgctccgctccgcccgcggcccgccgccgccctactttgctccggccgccccgctccgccggcccgctccggccgctgccgctccgcctgccccgtccgctccgcccgcggcccgccgccgccctgctctactccggccgccccactccgccggcccgctccggccaccccgtccttcgcccgctctagtcgccgccgccctgctctaccggtcagtgaggaaagagaggggagattgggagagaggaggaagaaaaggggtgaggatgacatgtggggcccacgtgggacccaccatttttattaatttctatgtgaaactgacatgtgggtcccatgagctttattatttttccggatcgaattgccacgtaagcaccacgtcaatgccacgtcagattaagaccaaatcaaactagccacgtagatgccacgtcagccaaaaccgccttcaaaaccaccgagggacctaatctgcaccggttttgatagttgagggacccgttgtatctggttttgtggttgaaggacgaaaatcggattcgttgacgagttaagggaccttagatgagcttattcctttgataatttgtgtggagggttttgaatggaattcaaaggagatgaaaatctaagggacgaatatttgtggaatttttgaatttgactagaattcaaaggggaaaagttctaaaggaagatatttgtgaaccttttgaactttgcacaaggaatataaatataatttaaggaattgaaaactaagggaattttgaatggagggttttaaatagattcaaaggagatggaaactaaagggaataaaaatatttgtggacttttgaattttgaaaaataatagaatttttaaagtaataaagaggtttgaaatatttttaaaacaaaactaaagatatttattttttaaatataaatttgagaaggataaaaataaagatgctccaattttatagaattcaataataattaaatgtaaaatttgtcacgaaagattttcaattttaaaaactaaaatagtcaaataggaagggaaagaaatacaaatgatttaatgtctaactttggataaatttttgggatggtggcaaaatagatagaagggaagcaaataggactttagccccaatatatgtggtatagatttttggtgaaatatttgtgggctaaaggaaattggattttgtaagaagggggattaaatataagtttcttagcacaagagcaatcactcaaaaatttgtgataatattattcttgtgctacatatgtgattaagccataggaatcaaattggcggctcgatccaactaggaacttaaccaatgaatattttggatcgattaagaggaggtaagggttttcggggataggtttagataggggttgatccaaaataaatttcagcagaaagggagttatactggtttagctctaaagataaaagtggttaatgggatataacagagagtcgggtcaatcggggaaatattggcccaagctaaatagtagactttggaatcttgaattgataatttagatgaacaagatttcaaaggggaaatatttgtgggagtatagaactggattcggaagtatatgtggatgggaatttttataggaacggaattggtggtagattgataaactctaaaggatgggtatgttgactcaaagggggattgaaaaggatattttatggactctggggatatttaggtggagatccaaaggaaaggtatagtatcaacatttcatgtactctagagatattcgggtagagttcaaagggagagtattaactctgagaaaattggaaattatcattttatgtactctagggaggttagagaatgacatttcatgtattctggagatggttgagtggagatcaaaaggaaagtattggttctggggaaaataagaattggtatttcatgtgtttgggtagagatcaaagggggagtatttggtggaagataaaactggatttggtggtagtgtggtaagctctaaatgaaaaggtattaaccctagagagattgatatttcatgtgctctagagatggttgagtggaaattgaaagggtatttgttggagatgttcgggaatggattcaaaggaattataatttagagccaaagttagagattaaagaaaataaatggaaaggtttttaaaaatttgaaataaataaaatagagaataaaataaggattttataaaatttaaaagagagcttttaacttcgcaaataaaatttagatctaaagtaaaagagattaagagaaagcaagattattccaatggaagaatcaagaagagtgcaactaaaatatttcgcaaaaaaatttcccgaaattttgagtccgttacactcccgctctgcaccaccgtgctggcgctgtcagtcggctgcccgactccctaatcatgtttccgacgccggcgaccatcatctgcaaccatcgacagcccaggctcggcgccttggccagcggccaccattctgcccccgctgctcggcgcggcggcggcgacgcgccggcgttgtctcccctcgacagctttgccccttgctatcccttcgtgacgttcgagacgatgagactgacgaggctagacggctttggctggccaagtttggacagcgagggaggcaggttagctagccggatggcttggccattcaaatagcaagtctattggagaacatttttttttccaaaattaccaaattttggcttggagagagtgggatagctaggctcttggagatactcttatatatcattctaactctcttctagcaaaagggcgccctagatgcaaaggaggaggtgcctacccactcactcaccttctaggccccccgatgtcatacattattccacgctaggttttgctatttgacccgcgacgatagatttttaggcttctgtttttttaaattttcgtccatagaatattgcatcaagatttgcgtttgtataaatccaacttacagttacactcgattatagtgcacttacactcaattacaattacatagcactacttgtattcagttacattgcatcgaaattagttttttcagcagttaatttctctattcaagttttacgatttttgacatgtttattttttttttgttatttcgtctaaatcggactatatccattgattgaaaattctacgagacttaaaagattataaatacatcgaaagatgaatagctagttccgtcccttccacgttctcatcaaaatccgtatcccgacttgcaaggcgccttctccctcagccgcttttctttcatgcatggagcaagagagacagcgccgccacctccccgcgccgcgcgcctcccttccgccgtcgcgtcgcgcgcctccctccgccgccgaccgccgtcgtgaaaccctagcctcatcccctcacgccctcaccccctacatggtggagggggataataagactgcaggttcagttctactacagtattttcttggattatggattctcagttttttttttcttttaattcctagccgcgtatcgcgttcgtaatgttgcggttatatatatatatatatatatatatatatatatatatatatatatatatatatatatatatatatatatatatatatatattagggcattaggcgcgcggcggaggagcaagtcttcggcgaagggcgatcgaagcaggcggcggaacaaggtacgcctccacttcaaaccctagaaaattctcccactaccccttgctcgatcgacatcgctcgcccgatatcgatctctgtgtgtgtgtgtgtgtgttcctgcccttttctgcatgcgtcaatcgcatccaatccaaggcgatgtttataaatcacaaacacataaattaacctgtgtactgtatacagagaccggg

SEQ ID NO: 40000 - DNA, 7663 bp, Oryza sativa
gtcctcgttgtcacacgccttcatcagctgctcgtgccgaactgttcgattcaacataactgccagctggcgaacctaggttttgcactattcgtttatgatctggtctcagttataagttcttagattgaggttgcaattcttcttctggcgtgctaatatatcggttgattattgctcccgtgcttttgatctctttgtgggtaacttcatctatacttattcggtgccctggattgtcttcttcaaagaaaaaaatgcaactggggatgaaaagcacaaatttgatgacttacaggaatgccatatccagggatggtctacttaattgatataaagcaaggcaaagtaaacgaatgaacaaatgtatttgttttatcttttgtctttgtgttagaacttaactaggttccttggaattgtacctctgttgactattgattggcgtagtgacttccatatctctcagacagtgtcttgttatgacggcaatcgaagtttttttttttttctgtttcgtcaccttgcaccttcaatttcatcaatgttttgacgtttttggatatttgttgtagcttcagtgttagtcaagttcataggttctttttgtttaaggttaagtggttacctgtacttcacttttgtagcctagttacctttggacttctccataatgatgttctgcttttcatatatacacatgcagtcgtgtgtagtcagttttatctgtaactatctccaaaagagtccttctaaacatatcaaggaataagtttcaccaatttgccgagttgcttttgcgaccataatgcctactaatggtgactcactattacaattttattctctgtggtccagggttggaaagatgacagataatctaacaggtgattgctcaacaagctcaaagaaaaggaagaaagcttgcaaaagttgaggagagacaggtgagtaataggtttgattttcttaacatacttacacatcttcgtcataacaatcacaataatattgtgcaatgcttcctcatctaggaaagttgcatgtggataacatttttgaagaggagtttggcagcttaaagaattctggtgaaggagcatggagtgaactgagtaaagtggctgtgtcaaacttatcgaaagtgttgtctcgctggtttcattcaatggtgattatgcacgttggcttttaaagtttgtatcgagtcatcactcttaatgatggaaatcatgattttgtgcagggggtatgatgtattctgcatgcacaggcatagttatcaaaagtgatttacatggcataagttacctgacttcagctagcctgattagatctttggatgatgaaagcaaaatcatgccatatgtttgtatagctcctattgtacatttttgtttgcatagctctttcacattcatgcataaggtctctcaccctggatggctagctagtccccgggggtgttctggtcgcgtgccacctttatagggggagtgttctgggagggtccttcggatccctccgttgtatatatttctttcttaatgacatgaagcacagacctgttttttcgagaaaataagcattcaatgcatatatcttggaaagacattttggtccaatttgaccgatctgctggtcactggttattgtttgtggtgcctggtaaaagatattgaggccaaaagataaaatgtatgattgtatgcctaatttgaatagtggattcagagggaagtgaaacataggcacatagtgctcaactgctatgacagaggctatatatccatggctgcgtgcttgcgggggtgttagggatcctcaccactttatttttttcttgaagtgttactccaatatgcagttttccaaaaagtaaatctcaggttgcataagtggggagactaacccacaacctacactgctaactgtatctgtgttatgaaactttgaatgacatcactgaccatatcagctacaaaaagaatataaaatgctaattgtccttatcaattccaccttttctttggtaactactcttgatgaatttactatgtactgcaggggtgagattataccacttgatagcacaattggaaggagcacaaatgagatacaagaatctcctgcaactcccaatgagcagaagatgaagtcagaagatgaagtcatcttcttctagtaattcagaaggtaaatcgggctaggtcacttctaatgttaattatcatgcaaaagttgtcatcatgttttaatgttaattattgatcattactaacacatggtcattaatcgctttaccttgtttctctagattacgatcctgagaatgatccattttttctggaggagacccctttcttcccggttgctgatggtgatggtgagtcattgcttttaattttgctgtcattgttaacacatgatgattaatcgcttcagttttttcaccaggatttgggaaatttttaattaaggaactaacgtctcaaggttatcctttgccagctatcattgatggtgagtttgttgctgactactctcttccattgcacattttgacagttgtatttcagcactctcatatgtggtactacttttctttaaacaggaggcatgcatttggttaatacttttgaaaatgaatttgttgatgatatctggagtaaactcaccaaaaaagttgcttcaaacgtgtctcgtgttgttgtctctcttgcttcattcaaaggtaatcgcattgttataatctcattgcattttcatttcttttttatagatcatcactattcactaactatgattcattatgatcttgtaggagaagaacggatttttgcttgcacaggaatatttataggctgcagtgaatccaacacaaggatcctgacttcagcaagtttggttaggatttctgatgatgaaaacaggattaatgataacttgaaggttggtattgtattgtcctccttgagcttattcatttgagataccggtaaatcctcatattacttctgcagattgttgtacaccttccaaacaaacaacaaactgtagggacattgcaacattatcatctgcattacaatgttgctattgtcagcatcaaaggtttccgttgtcttcgtacggaagaatttcatgatccagggcaaattaagtgtaagaaggtattatctgtgggacgtgtcttcaagtcaggcaaattaatggccacaggtgggatattgacggacaaaccaagcaaacttgactgcaaagaacttatggtctccacttgtagaatcactaaggtacagtgaatctccaaattgaagtcttgcttttcctcgcaaaagaaaggctttaattttcttatattggaaataatttgttgccttacaatatgaacaagagcaatttaatataacactaccaaacattgccatgtctgcttaccaaacctagccaaagggcccgtctaataaattgatggccataccttaggcaagatttgggaaataaatgagtgcatgacatatgtttcctaggattaaaagaacggaaatgaaacaactgttttacgaagtgtggaaagattggcaaagtgtgaaacgctcctgcttctgcggaactacgtgtgtaatcctttgtttttgtgctaggctgggattggagggcccctgattgattttgatgggaatttcgttggtatggtaggaaggagactccgtatttaccaagggatacaattctgaaattattgagctattttgatggagaagggtatgtcttctatgtttatatgtatacctgtgttttcaacttttctatgtcttgttatttagtttccttcaaattttcaacttttctgtgtcttgttgtagggatgtctctgctgagatcatggacagaaacaacagatgccctgtgcccaagatacgttggcattatcctcacttctgcaagccacgcaagtcagagaagtgtggttaatatgaaaagtactagacgagacccctgcgtgttgcagcgggaaatcttgtgtataatattaaaatttgtaaattgattatggtaaacatattagtaaaatattgaaactgattaacaaaggaacttgattgctatcatacaaaagactgaccaatcgaacgaaagagtcatgctccctaagacattttgaatgggcctagccatcagattttgatctaacagacagggagtcttatcggagagggagtaggtaaccgagatatcttctgatgagaataagcaaatccctattttttttgttgaagaaaagaaaagcgtgtccacgtggactggactctgaaattttcctcctcccttctggagtcttcctcatcagaaatcagaagaggagagggtgggcaactcgcagatcgccttctcgtcgcgctcgcgccgcaggggtcgcctgaggtatgcagcttcacctcccccaactttctagggttctaatcgcctctgctcgctcggattatgcgtggtgggtatggctccgattccgccggagtagctggatctgtgtgccccgtgctaatttaggtttggctttcgattcggccgcgcttcggtttgttctcgcgcgtgattgcttcgttcggccatagggctcatctcaggctcgacatgtggacggccacaaacataaaaaatccttgttaaatttacggttcatgtggtaggggggcttttcaggatcggaggtttaggtgatttggagtagcaaaacgattttgctgtgttagagaattcgagaatctgtgccgtcagatgctaattagctggttttgaacaaatgttaagacatcctgatattatttgctgcgtttaatgttcaaactttttgcacgggtgttgctgagctataaaggatatgaggatatagtaccaagttctatcgttttgttctgatacatacaatttgctgtagtttatggcaccatcatactgagatatatatacctgtgcacctttcggcttctgtgcagaacacatagacaatggtgaaggctgttgctgtgcttgctagcagtgagggtgtcaagggcaccatctttttctcccaagagggagatggtaattcacctaaacacgcagcgacaacttgtattctgtccttcccgtgttctttgggcgtaatttgttgccttccgtatttaggtccgacctctgtgacgggaagtgtctctgggctcaagccagggctccatggattccatgtgcacgcgctcggtgacaccactaatggctgcatgtcaactggtacatatgcacttcattccccttttgtttatcaggagaaatggatggattgtggtgtgcttactggggagtttgttctatgctgtaggaccacacttcaatcctactgggaaggaacatggggcaccacaagatgagaaccgccatgccggtgatcttggaaatataacagctggagcagatggtacttttgtttgttctccttctgtgttgcttacattctgttattttggggattacatagttttgcattgatgggaattttgatagctgttctcgaattgtttaatgcactgcagcaatcatgcataaccccactgatagtttttacttattgcctctccaggtgttgctaatgtcaatgtctctgacagccaggtaggaaataatcttgctctctcaatgaacatatgtgctgacctttttcttatcatttcctcttaagacagttaatttgacatcggtaacattctttgaacggcagatcccccttactggagcacactccatcattggccgagctgttgttgtccatgctgatcctgatgatcttggcaagggtaatgctttataaacactcagatctgtattatttatgtaggaatgattatttgtcagatgtcttcttttatcattgttttggatagagacatgaagccgatgtttgtgtaatgatgcctttctgttttatatcaggtggacatgagcttagcaagaccactggaaatgctgggggccgagttgcttgcggtgagtgacttggttttactcatgtccttttggcaaatctgtttaattcgttttcgtccgcggattgtttgtttcttctcttagaactcccatcaaatccgtctgttcttatgatgcttgctcttctctggttcaggaatcatcggactccagggttagacgtctcaactttccaacatacagaagctgttcatgttcgctcgtatggatgttgaaataaaaataagcacctgatgtatgaccagtgtgcagtttgccccagtttatatatatgtgctatactcctgtccgaacattacagtcatttgacttgagtgcatgcgttttaagtatcattggtggacttgagtacatgtccataacccatcatctgggatgctgcgtttgagaccgttcatttttcagcaaggggattgctctgtcaggtaacctaaattgacaaattcaacctaggcctggacttatttggcgctgcacaggtgcattctatctatatgaaccaaactctgatcgatgagtcagcaacttaggattttctgcttgaagagccaacaatgaatttggaacaaatccgatttcaaccaacaacgaatttcagaaagataaacacaatcaacaacaatgcctggccaaacgaaagggaaatgcggatagcaacagcgatctcatcgttttcagggaacgacacattttgaatgttcttgcagcaacattcgacaccacggggaaataggagtggtggaaacgtgaaaactaccattgaattgaaaaataaacattgaagatttgtccacgtcattacgggtaaaaattttacttacaaatttactaatgaataaaaattttatttgagagaaattcagtaaaaaattttactcgtgttagcgtggacgaatatcagatatttatttttcgatccaacaatagtttctaagtttctattacatacatggtttgcgtatattttacccacaacacgcaacaccatgacatacttgtcgatgcacggataagactgagataagcacatgacgggctatgctttgcctgataaattcaagcacctcaagtagagctcggtggatttcggaggaggtctttgcccaccgtgaagccgccgtcgacgacgaggttgtggccggtgacgaacttggcctcgtcggacgccaagaacacggccgccctcgccacgtcttccacctccagcgatgtcccttccagctcctgcatctccctcgtcaccatcctcctcacctcctccgcggtggccgccgggaacgtctcggcgatgatgcctagcgccatcggcgtcgggatggcgtgcggcgagatggcgttcacccgcacgccgtcgcgcgccagctgcctcgccaccgcgcgcaccatgccgacgatggccgccttcgacatggagtacaccggcgacgccacgccgccgagcaccgccgccgagctggccgtgcagaggatgcagccggcgcggcgcggcgccatgacgcgcgccgcgtgcttgacgcacgccaacatcgaccgggcgttgacggccatgacgcggtcgtactcgtcgaggtcgagcgccgcgagcgaggccggagccggtgctcctatgacgccggcgttgctgtagacgacgtcgagg

SEQ ID NO: 40001 - DNA, 3213 bp, Oryza sativa
agcttgacgacgaggagaagaggcgatcggccaagccgttggagaacacctgagcagctatgctcttccccctgcaacttgtttacgtgaaaaatgattgaaatcatcaaaatttcacggtttgcacgaacgttttttactggagaagatgcgaacctgagaagtttgttggctgctgcgttgagcatcatgaacggactcctgattaccgatgcttcacttccaggagttgagagatctcagcagacagtagtctgtactatagatggccatatggcccgcgggccgacggcctggcccaagcatggcacggtctgacaggtgtcaggcccgtgctggcccggcccgatagttgggtcgtgcgcatgaacttcagggaggctaaagtagacttatttcaaccatatgtatggcacggtcccaatacgaatgaggaaaaatatacttatttcagttatatataagacacggcccaaagaggagggacatatacatgtcacagcccaaagaggacggagacgaaatagacttgtatcaaagaaagcacgatgggctgtcgtgcttttgggtcagcacaacccgactcttattgggccatgcctaggccgtaggtggagcacgtgggctggcgttgctcgacccggccgttgagcaggccgtgccaggctgcgcggcccatttggccatctctagtctgtacaatgggtgcggctaaatagttaaaagataaaaaaagtaatactattagtatgctaaaggacaataattagtgagtttaatgtctggaagaattttccaatgtgttagagaatttggattataataatagcactccactattatagtgaggtgaaggtgcatatccaaggcctatatcgatatacagtgtgtgactagaggtgttttgtggtgtcaaggacaggtgatacctctaaggtatcatcccatctgaacgagataccgtcatgtagcattcccctaaacatttgtaaattccacatcgtattccattgaagttattatggtggcaccaatgatttgttatcttggctacgcacgttgtctaacattatgtgattttgtcaaacttccgtgtgtttttaaatcgccatttccattgataccaaattatcaatgttttaggctctatgtgcctatgaggaaaagagaagcacccatccaaatgatttgcgttggcacaaattttaatctatctattgataaaaataaagtaactgggtgtacgaggatgtccatatccaactactatgtctagccaagtgtggtgagtctaacatgcatgtccactccaggaatccccaacggctagtttttttttctgttggatagaagtccaatacaattgggcttagttggatgatttgactaagataagggtctatctgaccaacgtttaaaggccggtcgaactaccagatgaccccaagagtccccaatgaccttttgtaccgccggactaaagtacggtgtgcttagttgggcggtttgactgacaaacatgtcatgaaaagtgtaatagcctcaaataattagttatttgatgtaggctatataagaccatgaattcaagcggtttggctattgctccttatcctagtgccctagtggaggcattacttaagaggcaacctttatgagtctattgtgcatccttgaaattgagcgagccatctgccccttctcatctcctccagtgcataagtacccttagacgtgtgaaccatattgatgatatggaaagtggttattcccttattgatgtacacatcattgtaatatgatacacaatattatattgttgtactttgtgtgaactatatctgatgtacgacatgaattgagttagagctcaattgcacagatcatagaagacactatttttttctaacatggaaatttaaaagttattaaagataatacaatcaaaccgtagcgtttagcacgggcatattactagtctcctccagtgcataagttgcaaccaatgtgcttagtagaaaatagagagattgtttagtcattgtgcatgagattgagccatggtactttgtgagagagtcttggtttactactcttggttgccgacacctagacggtttggtaccagttgtgacctggtgatctctgcaagggagtaatggagaaggtccggtggtttaatgttcaccatcttgagaatggaggaagaacggccactaatgattaaggcttgggtagattacctcggtattggcctcacttgcccatctcttgagtctcgacgagagatttggagtcttgacggttcgagtggtgaagcatcatttgttgatttgatgtactcgacgtatccattttatccatcctttggatgctgaatactactctgtccaaaaaaaaaggcaaactctaactacatatctggacataggattgaactttttttttagacggaggggatatgcatgtaagtcatcaaccagacctccattcaattccaaggcaggtcggcaactcaagatatatgcatgcttactttgaatttgctgttcaactagccaccagaaaccacgggcgaatttcggagagataaacacaatcacaataatacagtgattcgatatttgaaatacttatgcaaacggaatagtccattgagtttactgagaaagaacgacagatttgaaatgacgagacaacaacctccaaatttggccagacttgacaccaactcaagcagagcccggaggatcccggacgagcaccttgcctgccgtgaacccgccgtcgacgacgaggttgtggccggtgatgaacttggcctcgtcggacgccaagaagacggccgccctcgccacgtcttccacctccagcgacgccccttccagctcctgcatctccctcgtcaccatcctcctcacctcctccgcggtcgccgccgggaacgtctcggagaagagacctatcgccatcggcgtcgggactgcgtgcggcgagatggcgttcacccgcacgccgtcgcgcgccagctgcctcgccaccgtccgcaccatgccgacgacggccgccttcgacatggagtacgccggcgccgccatgccgccgagcaccgccgccgtgctggccgtgcagaggatgcaaccggcgcggcggggcgccatgacgcgcgccgcgtgcttgacgcacgccaacatggacctggcgttgacggcc

SEQ ID NO: 40002 - DNA, 18195 bp, Oryza sativa
  unsure (1)..(18195): unsure at all n locations
ctgtacacgaggtcgaggcggccgtgtcgcgccacggcgaggtcgacggccgaggcgacatccttctcgacggtgacgtcgcagtgcgtgtacgacgcggcgtcggcgccgagctcgccggccacggcgcggccgagatcatccttgatatcggcaatgataaccttggcgccattcctgacgaactccttcgccgtggcctcgccgatgccgctcgctgcgccggttatcacggccactttgccatccaactttctggatcttgacgacgaggagaagaatacgtgagcagctatgctcttccccctgcaaaaagtgtacgtgaaacatgcttaaaatcatcaaaatttcacggtttccacgaacgtttcttactggagaagatgctgcgatttttactggagaagatgcgaacctgacaagttttttggctgctgcgttaagcatcatgataatttctgcttcgcttccaggagtcgagagatctcagcagacagcagtctgtagatagggtgtggttaaatagtaagaagattagaaaaaaaagcataaaaacaaatagagtactattagtgtgctaaaggtcaataattagtgggtttaatgtctggaagaaatttccaatttataatagggtttgaattataatacgactccactattatagtgagaggggagagccaaggtccatgtcgatgtacagtgtgttatttaggtgaagttagatggtgttgttttctaatgaagatgaagataaagttacgacacataaaataagaaagccattaacgtttgattaatactcccttcatctacttttgatagttatattttcaaatctgaaaaatttatttttgataggcatatttcaatccaacaacctatcatcttaatgactttctcggatttaatgcatgactcttcattcttccacacaagattggttgcatgggcatcgagaaatgtaaatattaatgaatcgcttgtttacgaggaatgaccagtagcatgtttaaatggatgataagtagaattacttatccttggtctgtgtgtcaagatgaaatatgactatcaaaagttgatggagggagtatcccttaagttttaattattataaaagtaaaaagctaaacttatttgatattttatgtaaattctagatagaaagcttttatatgaaacacaccgtttagcagtgttaatgaaacagaggtcaaatctgtatctaaattagaaacgaataccatgtgttttgtggtgtcaagaacagcagtaaacatttgtaaattccattatggattgatgcttgtacggcatatttgtgaagtgaccccatattcccatggagtaattatggtgacaccaatggtttgtcctcctggctacgcacgactttgacacttttgtccaacttctctgtgttattaaatcaccatttccattggtaccagattatcagtgttttaggctctacatgccaatgatgaaaagtgaagcacccgttcaagcgatttgcattggcgtcaaattttaatctatctattgaaaaaacaaaccagctgaatgtacgaggatcttgtggttagttttctcgagtcctaagaaaaagagaagtgcatatatcctcgcacattcaactggagtgttctttagagtttgggccctatatcctcgagaaaatttgtagattattggacggattgttcatgggttcgatagcccttttaataagctttgcatataatccaaaaacatccaaatccaacactcaagtcattttaagtagttgtttcatagattgtcagtcatgctgaaataagggtttagacttaaaagaggtcgatgtgaccaccaaaagacttcctcagcggctagtttttttttattattattgtaggacataaatgcggtgtgcttagttggatggtttgactggtaaacacgtcgtgaaaagtgctttagactcaaatagttactcccttcgtacaacgaatctagacggagtgttatccagatttgttgtactagaaggggtcacatcccctcttagatcctgtttgattcagcttaggtttattataatctggattactaggagtaagctaaaataaacaagtagattattatgctagattattatactctataaaccagattagtataatccaataatgtaacgccccgacattcattagccattaacacagctaaatcacaccggggtgttatgcattacctgtgatatagtaccagtcccaggatacactagctggtacacacagaataaatgtggaatcaaagtaaactattttattacatcactgggtagtagtccttatataagttgctatcatggacaggcccatagatgagcaacacaacagcacataaaaacataaaaacgacggcgcagaagcgaacagcacggagaactaagcgactacgcactaggcaaagaacctaggcaactaacttattccacaggcgaggcttggggctaggcacgaaacatctagaagtcttcatacttggcttgctcctggagatactcctcggcggtcgggtcgacgtcttcgtcttcaaactctatatattatttataaggggcaagggtgagtacttgacgtactcagcaagccggggaaaagaatggcgtgttggtttaacaaggaggctactgttttatttgcgaaggctgccattttggcaaaatgatttatttcacaaaactcctagtgaatgagtcaagttttagttgtcgggaggaggctcacgcctcaacccattccacaagttgctttgcaacaacttgtcacggttaacgaacaacaaatattttgtttcctcttggttccttctcactttccacaacaacactaatccacacaaaacacctggttatcccagcacaacatcgccatcatcatggccctaacaacacctcagtgtcggacgacaccccaggtcacacagacccgttcctaaccacccaggttagccgtctgccacacaggcggactctggtaacgctcccttttcagtaaccacttttccacaaacctttgtcaaacaaatctacgctatgagaaacaccttacactcgctcttgaccgtgggcacggctgttcgaacagttcattaatctctgcagaggttgcacgctttacccacacgacacgaaacttacaccggtactggccggtaccggaagttcgtgataaggcctttccaaagctaacccatgaaaatcgcatgccacctagttgggctcagatccatagccgagtatcaggcaataacagccgtcatccactcaggaaataccgaggacgcctcctactcctactggtatcacgccacaatagaggcaaaaagacacccatgatgggcaataaatgtgtaacacttcgtctcctcatcctcggcattccacaaccattggcacaccaactcccatgtgataacaatttacttagccagaggcatcccataatacccgtgtggtcgcactataacgtgttcggatggatttcccaaaggaatcggtccttaacgataatacgtagccaaaccacaaaggcatgactccgcatcatcaccactttcacaacacattttatttcacaactcctcggtacaacgtaccggatttttaaacatgtatttggaataacctaagtttcccacacggcaacaacgtaagcatggctaagcgaaactacctcggtaatcgtgtaacgataccggcgcaaacatttgtagagctatcaaaggtatggaaacatcaacctatgtaatataagtgcgactactaggttggtccgtcggacgtataaacaatccgacgcctaacatgttaatcgtgtgaactaagcaatgcacttttcaaacaacatatctttgcaaatataggggcaatgtgatcaaagaggcttgccttgcacagggttggggtcttctccttcgaaagcggcgtccggggcttcttcgaactcgggctcttaacgtgaaaacaaagctaaaaaaaacaaaaggcaataaaacaagctcaaaccagagaaacaatagtgccactgtgtagatctcaattttagaaaaatttaggaacttgaatggggtcaatcggagttacggttgattttctatgaattttcaaaggtaaagggatttttctggaatttcatttattggacggcaagggaatattccgctagagtaacagcaaagagagggggcccacctgtcagcggccaatggaggaaagaaggcgcgggcccggcttgtcagtggcttgagagaggaaagggaggtggggccggcttggcagcagctcaggaggtcttcttcctcctcctgtcgcttgcttgcacggctcggccctgggatggcgacgcaccgcggcgatggggcgcggcgaggcgaccagcggccgagggaggtggcggcggactccggtggggctccggcggcgacggcggcgccgggaggcgaggctcggcttcgtcttcctgctctcgctttgctcggcttgaggcggcaaggtgccgcggcagcggggcgcggctccgcggccggcggccaggagaggcggtggcgacctcgggcggtgctccagcgaggcaccgccggtgacggcggcgctagaaggcgcggcataacggctataggtggcggtacagagagcaaaacgagggagagaaagaggagagagagatgggaatggtgtggggaatttgggagagctcgggctccttttataggcgagcaacgcagtggcgagctggcggtctagacgcggggaatcggaaggtaggcggctagctgctcggccggattcctgggaggaggggtcggcgatgcgacgacatggcgtcatgcaccggtggcgactcgacagcgaaacgacacgaagggacgtgcagagagcgggaacggcggcggaacatgggtgacgcgcggccgacagcggctacggccgggatttggggcggtagggctagagagggttgacgcgagcgacggtggcgacttgacgcgagagagagggagagacgcggctcggcggcttcccgggaggagacggcgacaagacgacgaggcgacggcgaagggacgcgcgtccgcgagagctcgggatgggacggcgctgcgtcagcggtggtggcgacgcgacatggcgatggaacggggatgacgaggggtggcgtcgacgcgacgggcgacgggacggcgaggtgatgcccgcgacatcggatggacggcgacgggacaggggatgacgcatgcggcggcgtggctccgtgtctcctggagagaaaccggagcgcggtcgggcttggcacgacgcggctttggcgcggcgcgggcgtcggtttggtgcgggggaggtgcggcgcggatgttggcacgacgcgcagcgcacgggagagtggctcggtgcaatgcggctcggtcacgatggagaaacagtgcagcgactcggtgagacatttcgtcgaacacttggcgtgcgtgagctggctggcctgaggaaggagataaacagtagtgggccgagttgggccggcctgctccgggagctgaagagaggagggatggaggggagttgggcctgggagagagaagagagaaggaggcccaattcgaacagtgagctttcacaattttccggagatttgtagagtttgaattttggggagaattttgggagggatttgaatttgagtttaacctagggtttcatgggatcttaaaggcaattctaagagaggatttgagatctatttggcacaaaaacaattaagaaccaaattaactccaaatttttaaatgacaagattttaaataaatgaaaataaaaatacaggtgctacaaataatctcctctagaggagctttttccaaattattgagtggctaaagatccactactcctctaataatccagagaaacaaacaacttgcagcttattctatttcagcttattataatccagcttagagtaatttgatttaataatctacactactacaaaaaggtaaataggtgtcgccactataggtgctggcacaccaaaaaccggcaccaataatgccttccccgcccatgcacccacctccacacgccacatattaaaaaaccggcacctttatgtccaaataggtgccggtttttaaataaaaccggcacctaaaacatgtgtcagagaaaggtgccagttctagacccaaaactggcacctttaatcttctgcctcccacactgctgttggtgggccccgcacataggtgccggttttaagacaaaggtgccggttttttaaaaaccgacacctataataaattaaaggtgtcggttttgggtaaaaaaaccgacacctttacagatcgagccgagccggctgagccgaccggcgggccccacaaccatcggataaggtcatctcactcagcctctcctctctcatatcgctctcttctctctctctctccctccctccctcctctctcgcctcgctctcttctctctctctctccctcctctctcgcgcgctgccgcggaggcggaggcagcgacttgacagctggaggggagccctcccctctgccagatccggcgggaggggagacggcggcggcaggagggggaggcggcggcgggaggtagcggcagcagcgggcggcgccgggaggagaggcgacagcggcgggcggcaccctcccctccgccagatctggcggaaggggaggtggtgtcgccgcattggcggccccacggcggaagagtcggcgggggcggtccgatggcccggtggcggcgccctccccttcgccagatctggcgggaggggaggtggcggcggcgggaggtggcgacggtggcttcatcggcagcggtggtggcggcgcctcgtcctctccatccggctcctcatccttctcctctccaatttattcttgatgaatgtgtgttcttgatgaatgtgttcttgatgaatgtgatgttgatgtgtttgattgatgaatttgaggaaattttgggatttggctgtagatgggatcggcttgacggctcaatgcatcgagcctcgagccgatttttttttggctcatgggcacctcaaaggtgccggtttcaaaaccggcaaacagtgccggtttcaaaaccggcaaacagtgccggttgggttaaccgtgccggttggacaccgaaggggggttcccaaccggcatcgtttagagattctgtagtagtgctagattacaataattttaagctgaaacaaacagggccttagattgtcttcttttgagacgaagggagtagttatttggtgtaaactactacctccgtttcaggttataatactttctagcagtgctcacatttatatagatgttaatgaatctaagcacacatatatgtctaaattcattaacatatatatgaatatggacaatgttaaaaagtctggtaatataaacggaggaagtagtatttaagaccatctgttcgagtggtttggctattgctccttaactattgctattgccacaagccactggtgaatttcggagagataaacacaatcacaataatatagtgattggatatttgaatagcacacgcaaacggaataatccattgagtttgctgagaaagaacgaaggatttgaaatgccgagacagcaacctccaaatttggacagacttgtcgatgtacggataagactgagataagcactggacgagctaagctttgcgtgacaatcccgtcaccaattcaagctgagccaggaggatcccggacgagcaccttgcctacagtgaagccgccgtcgacgacgaggttgtggccggtgatgaacttggcctcgtcggacgccaagaagacggccgccctcgccacgtcttccacctccagcgacgccccttccagctcctgcatctccctcgtcaccatcctcctcacctcctccgcggtggccgccgggaacgtctcggcgatgatgcccagcgccatagccgtcgggatggcgtgcggcgagatggtgttcacccgcacgccgtcgcgcgccagctgcctcgccaccgtctgttggaaatcaaagctattcactcactcaatctcacaagaacacaagcacacacacaaaaggactcagaacacagagagtttgcaagtgcgtagcacttctttttgtttttttctcacactgaaactgattacattgatctctatttaaagatgcacatgacctgcttaagcctaaagaaatgcaagaatcctagataacaaactcacccacgtctaacagaatatctcctggtcaatctccgatgcatgcgcccatgcaaacttcgaccgcttcctgctcctgagttgatcccttcgccacatttgcatgcatggctaactaattagctagatgtactctcacctcctggcaacacgatcagccactactgatcactgccaatctctctactcactaagccatgcagcacaaccactaagctagcactcacggcatgcaacacacatacatgtgacttctactcagctactaccatacaaataaacatgctgaaaacaaaacaacaagattatacttctaataccgtctgcaccatgccgacgacggccgccttcgacatggagtacgcgaggggcccgatgttgccgagcaccgccgtggagctcgccgtgcagaggatgcagccggcgcggcgcggcgccatgacgcgcgccgcgtgcttgaggcacgccaccatggacctggcgttgacggccatgacgcggtcgtagtcgtcgaggtcgagcgccgcgagcgtggccggaggtgcgccgccggcgatgccggcgttgctgtacacgacgtcgagacgaccgtggcgcgccacggcgaggtcgacggccgcggcgacatccgcctccaccgtgacgtcgcagtgcgtgtacgacgcggcgtcggcgccgagctcgccggccaccgcgcggccgaggtcgtcctggatatcggcaaggatgaccttggcgccgttcctgacgaactccttcgccgtggcctcgccgatgccgctcgccgcgccggtgatcacggccactttcccatccaactttctggagcttgacgccgacgaggagaaggagcgatcggccaggccggaagagaacatcggacgaacacctctgctcctccccctgtaacgcgtgtacgtatgaaaataaaaagatcaaaatcatcataatttctctagagaatatgaagaagacgatggcaacctgagaagaagttgcccagctgcgttgatcatcctcaacgagtgccaccggcgtcgtgctctcgtgttcactggttcttcgattccaagctcgagtccaaaggtcacagtagagaggggctagttaaatagtttgaaaaaactgggggaaaatggtactctctccatcccataatataagggattttgagttttttcttacactgtttgaccactcgtcttacataaaaaattttgaaattattatttatttttttgacttactttattatccaaaatactttaagcacaacttttcattttttatatttgcacaaattttttgaataagacgagtggtcaaaaaatgcaaacaaaaactcaaaatcctttatattacgggttcttaaaaaaaacccactcctaaatttgaacatggacacaaggttttttttttttacggagagagcatatatgaagggccaaatgaaggacaataattagtgggttttgtgttgcgtaaatttttgaagtacaggagggttggtcttatcgttttagataaggatacggtcttaaaaaaataactttaaccaatatttttaattataatatgtatagaaacgtcaacaaatatatgaatttattgaaatattttttaagattaatttatacatttgacatatttctaagacaaaaagatattagagattagtcaaatatttttaagtttagcatcaagtttatctaaaacgacaaatattatcaatctagaagtaccattggagcatgcacaatgcgatgaagtggtcttagaaagatcagcttggacattaggctccacattggacatgcacgggcccttacgagagcgcttgtggccctacctgcgatgagagcactcggcgcctttcatgtgcgttggtggagccacattttaaacatgaggggaccaactgttggacaataatgtccagaaaaataaaaaccacaatagtagtccaaggttctcagaacttccttttggatatcatattgcccttcgcagaagatgacaaaacatctcaaaatgcttcacaaattataacttactagtaatgtgcccgtgcgtttcaacgagaaatacaattcgtttataatatgtcacttgcatgtatagttgtcggagaacgatttcatctacctttgaggaagaatcgatggacccctttagtacccaaagaccaaagttgtcattttaaaagctgaagagtgtggatcgaggatagaactctctgtcatgaagtacaaccggggattaaagcgataggcataactgatcaaacttgcatttgaagactgcatcgacgatagaactcttcgtcatattcattgatatagccatgctcattgatagtatcagattatcagtgttctgttctaggctctgcgtctgatgagaagaaaagcatccgaaatgatttgtatttatgccaagttttaatgttacggatgtgtttagttggatccaaagtttggattttggttgaaattggagatgatgtgactgaaaagttgtgagtgtatgacaggttgatgtgatgaaaaaggactgaagtttggatccaaactttggatctaaacacagccgtagtacctgttgaaatagcaagaagtacacatccaaccactctggatggaacagaccaacaaccctagtaaaatgacttaaacgaagacatatggactgtttggatacccaccttaatttaccacagtttttataccaaaggtgtggcaagatgcaaattgtgtggctcaaaatttgatggccacacttgtggcaaactttggctaagaaaagggtctatgactagtgggaccaaaagagtaaaagtgtggcatgccaaagttatagaaacaaaccaaacactagccacatttggtcaaactaacataccacaagtgtggcaaaatgtggtactaaccaaacaggcctatagagaaaatgcaggattgtgataagaatgtgtaaaaaacagagaattgtaaaacatagaaaagacatataaatggcagtttgattggactgcagaaaaaatacaggaataagatggagagagactcaaaggataatttttcaagagattaaagcgtgcgctcttgctaagttttcttcaaaatttctataggattatccattacataggattttcaaaggatactatagaatacattcctttgttttgaaaaccttaatgaaaaattttcctatagaattaaaatcttccaaaatcttaatctcaaaaaaaaaatcttccaaaatcaaaggacccttaactcggcatgtacaatatggagattccaacacgagtaatttatggctcgcatgatacaaccgtttttaacactaagattagaattaaaacatcatatattaatgatcggagcaactacaatcgtcgcgttaattgttaaacaatttactaattccaatccaaattataggacttccgtaagaataagaaccacggacatacacatgccgaggtatcaaggttacatttgaaacaaattattgaccaaattgttacctgatatataattctattttagcatttcaattcgaaacgagcacctccaagatgtcaagcaaagctcggtggattccggaggaggtccttgccgaccgtgaagccgccatcgacgacgaggttgtggccggtgacgaacttggcctcgtcggacgccaagaagacggccgccctcgccacgtcctccacctccagcgacgccccttccagctcctgcatgtccctcgtcaccatcctcctcacctcctccgcggtggccgccgggaacgtctcggagatgacgcgcgtcaccagcgccgtcgggatgatgtgcggcgagatggcgttcacgcgcacgccgtcgcgcgccagctgccttgccaccgtccgcaccattccgacgacggccgccttcgagatgcagtacgccggcgccgccaggtcgccgatcagcgccgtggagctcgccgtgcagaggatgcagccggcgcggcgcggggacatgacgcgcgccgcgtgcttgaggcaggccaccatggaccgggcgttgacggccatgacgcggtcgtagtcgtcgaggtcgagcgccgagagcgtgggcggggccgcggcgccggcgatgccggcgttgctgtagacgacgtcgaggcggccgtggcgcgccacggcgaggtcgacggccgcggcgacgtccgcctcgacggtgacgtcgcagtgcgtgtacgacgcggcgtccgcgccgagctcggcggccatggcgcggccaaggtcgtcctggatatcggcgaggatgaccttggcgccattcctgacgaactccttcgccgtggcctcgccgatgccgcccaccgcgccggtgatcacggccactttcccttccaaccttttggagcttgacgccgacgaggagaagaggcgatcggccaagccggaagagaacatcggacgaacacctctgctcctccccctgcaacacgtgtacgtatataaaagaatttaaatccgaacaaaatttaaatttaaattcatcacaatttcacagtttgcacgagcgttttctaccggagaagatgcgaacctgagaattttgttggctgctacgctcatcatcgtgaaatttggttcgcttccaggttcctcggagtatacagactgtagtatgtagagagggattggttgagtagtttataaataaaaaatctgaaaaaagaatggaaaatgtacggattactattattgtgctagaggacaataattaaattattgactttaatctatgaaatagttattaaaacgtgcggttgggggttataataaaggtactattctattagagcaggtacaatacggtggtagatgctgacgataggagtatcatgtcagcgtcgatgattaatcggaggtgaaaaatgtagtgagagagatatggttcaaaatgaattcaacaaaatactcttcaccttcgtggatcagctactgaagcggaagtgctagcctgccttgaaggtctcaggaatgcagctcagtggatccatatgccaatcattctggagttagacaatgctgaggttgccaagctctacagaacgaaatctcattgagatcaaactggctggcaataatcttggagataaaaggtcatgcggtgtctccagcagatgcaagtgcataagataaagagaaaagcgaatagggtgactcacgatcttgctcgaatggcaacgagtactaggtctagtgctgagtggaggcggtgtgctcgagtacaaattctagacttgttaaactaagaatgtaaccctttattcagtcactaataaagctctctctttagtgtaaaaaaaaatcaaaatactcccagatctacctcggacatatacgaaacaatctaaactttggcatcatcaaagagacacggcatgtgccatctcacgtggaaaaagagaaaaaaaaaacacaccacaccccaataattttgtaataagagtccaacaagatggcatcgcgctgctgttgctttgtgtgtgtcatctgtcctaaaatataagatgttttaaacttaaatacaaatattagaaattaataaaattacatggaaagatattgtgattcctttagaagattaggtatatagaaatttaaatggtgaaaggctgcgattagttgaaagagaatgtaggcgaatggtctactcaggacgattctaaccctctattttagctagttttcatagcaattaatatatcacgtaaaaaaaatatatgcaagccaactctacatatagcaactacgaataaaaacgatgagaaatgtggatgaaaggaaagagaagagatgtaattgaataataatttattttaaagaaagcacctattaggtacatatttctatatatgatttttatgacatgtcgagtataaaaactaattgatagtttctggattaagattatccttatttccctattaccaaatctaaacaacaaactggtaatcaatacataaactctgaattattaatcaaataaaacaaagtccacatggaaattaaattttctgattttctaaactcaagcacgcgccacgttgagccgcttcccgacggtgaacccgccgtcgacgacgaggttatgcccggtgacgtacttggcctcgtcggaggcgaggtacaccgccgccctcgcgatgtcctccgcctccagcgtcgcgccctctagctcgttcatgtcctcctcgatgagccgcctcacccgctcggcgtccgcccacgccagcatgtcgccgaacccgcgcatcgccagtggcgtcgcgatgccgagcggcgagatcgcgttcagccgcacgccgtggcgtgccagctcgccggcggcggaccgcaccacacctatgaccgccgccttggagacgttgtacgcgtggggcatctcgccgcccatcatgcccgccacgctggccgtgcagaggatggagccggtgcgtcgtggtgccatcacgcgcgcggcgtgcttgatgccggcgagcaccgcccgggcgttcaccgccatgacgcggtcgaagtcggcgaggtcgagggaggcaaggtgccccacagaggagcttgtgatcccggcgttgttgtacaggatgtcaaggtggccgtggcgcgccacggcaaggtccacggtcgccgcgatctgcgcctcgtcggtgacgtcgcagcgggtgtaggccgagcccgggccgagctcggcagcgacggtgtggccgagatcgtcttgtacgtcggcgatgatgaccttggcgccattgcggatgaactccttggccgtcgcctcgccgatgccgcttgcgccaccggtgatcacggccacctttccagccaacctacaccgaggtaatccgtgtattaattgcaagctcacataagctgagaggaaagaattgtttgatgtggcatttgagttatttcaaagcattcctaggataaatcttggattcttggagcaaatccattggtgagatagtcagaggcagagtagtactactactccatccgtttcatattaccagatgtttgacttttgttttattttttaaaaaatactaacatttgtaatataaaataaacctattatcaaaatatatattcaattttaaatttaatgaatttaatttggtgttgtagaatgtagatgttgctaagttgttttgtaaatttgatcaaatataaagaggtttaattaaaggaaagtcaaatgacatataatataaaatggagggagtactttatatactagatcctcccatcaatgaaaaatatttgacatataatataattcagtcaaacttttctaattctctacgagaaagatattgtcgtaagagtgaagccgttaattatttgagttaagccattaattatttatgattgaaacgagtactaattgataatctcaatggcgtatttgaaacataatattttttaaataaaaatagtttgtttcctttgaattttcataagaaataaaccccatttgaaaggcctaaaaacatagggaacattgttatggatgtgcatatatggagtagacgtgtaaacctttcgggtcttgacacagaggagaaactgttgacgaatccagtcaacatcgtcaaccctgctctgttcttgcccctgccacaaagcacaaataccacgtcatccataaaaatctcgtcttcattccttcctccaccccaaaaacgccgttgacttttttttaaaatgtttgaccgttcatcttattcaaaaatttaagtaattattaattcttttcctattatttgatttattgttaaatatacttttatgtatacatatagttttacatatttcacaaaagtttttgaataagacgaatggttaaacatgttttaaaaagtcaacggcgtcaaacatctagggaaggagggagtattttttcttaatgatccttaccgcctgccactgacttatataccatcaccatcccaaaatagtcgaattattgtaaaacaaatggagtacgtagacttttctacactacaaaggcacttaaaaaatagtattgcgatatttggtgagcgatacatctcatgattaatcgcaatatatgttaactcgacatgataaaggaagagctataggcgttatttggagagcttaaaattttaagaatccgctagttgatagccagcttatgaaaatatggccggaaagctgagtttttaagtttctgttttttaattcattttctaaattctataactacaaattcttagaatttaggtgacaaactatattgtttggaagagccagagattccacgagaaactgtaactgatagaaactctttccgacaggcacataagaagagatagtgtagtgtgtagtgggcagagtccatgaaggtctgcattcgaatgaaccgccgaatacatttagcctcttctcaatacatatgaatatgaaaagcccctcttttcatatccaaattatttctaaaatgaaatacagagtgaggagaaagaatgcacagtacctctgaacgaggtgaatggcgctgtacatcctgccttgctcttcagctgccctcctcaaacctcaagtattcaggtgtggtgtgcttctccttgaccgatcagtggtggctgaggtccttaaaaagggacagacatctccccacgtttctcatgaaggaacagggataagtggcccttatcaatgttggtagtatgggcattgggccctgttctagaaggaattgtttgcttggtggctggcacacacctactggatctatcagcagtggcgtagctagaatttataggtaggatactccacttcaacataaaggagatggagaagagaatttatggtctactttggaggattctaaccctccacttgagctagttttcatagcaattaatacactatcacacgaagaaaaaaatgcaagccaactctacatatagcaactaagaataaaaacgatgagaaatatggatgaaaggagagataaaaacgatgagaaatgtggatgaaagaagagagaagagatgtaattgaataataatttattttaaagaaaacacctattagatacataaatttctatagatgatttttatgacatgtcaagtataaaaactaattgatagtttctggattaagattatccttatttccctattaccaaatctaaacaacaaactggtaatcaatacacaaactctgaattattattccaataaaacaaagtccacatggaagtcaaattttcggattttctgaactcaagcatgcgcgaagttgaggcgcttgccgacggtgaacccgccatcgacgacgaggttatgcccagtgatgtacttggcctcgtcggaggcgaggtacaccgccgccctcgcgatgtcctccgcctccagctttgcgccctccagctcgttcatgtcctcctcgatgacccgcttcaatctctcggcgtccgcccacgccagcacgtcgccgaacccgcgcatcgccagcggcgtcgcgatgccgtgcggcgagatggcgttcagccgcacgccgtggcgcgccagctcgccggcggcggacctcaccacgccgatggctgccgccttggagacgctgtacgcgtgggggacatcgctgccgatcacgcccgccacgctggccgtgcagaggatggagccggcgcgccgtggcgccatcacgcgcgccgcgtgcttgatgccggcgagcaccgcccgggcgttcaccgccatgacgcggtcgaagtcggcgaggtctanggaggcgaggggccccacgtaggagcacgtgaccccggcgttgttgtgcaggacgtcgaggcggccgtggcacgccacg

SEQ ID NO: 40003 - DNA, 1513 bp, Oryza sativa
taatccgtgtattaatttcaagctcacataagctgagaaaaaataagtgtttgatgtaagcatttgagttctttcaaagtattcatagcataaatcttggagcaactttatactagctcctcccatccatgaaaaatatttgacttttagaactagattcagtcaaacttttctaattctctatgagaaagatcttatcgtaagagttaagccgttaattacttatgattgaaacgagtactaattgacaatctcaatggtgtatttggaacataattctttttctcataaaaattagtttgtttcctttgaatttccataagaaataaaccccatttgaaaggcctaaaaacatagggaacattgttatggatgtgcatatatgaagtagacttgtaaacctttcgggtcttgacacggaagagaagcggttgacgaatccagtcaacatcgtcaaccctgctctgctcttgcccctggcacaaagcacaaataaaatctcgtcttcattttttttcaaaaaaaaaagatccttaccgcctgccactaacttatataccatctcaatcctaaaatagtcaaattattttgacacaaataaagtatacttttctacactttagtatctatatttagacactaatttagagtattaaatatagattatttacaaaactaattacataaataaaaactcatttgcgagacaaattttttaagcctaataaattcataattagagaatgtttactgtagcatcacataggctaatcattaattatgctcaatagattcgtctcgcgaattagtccaagattatagatgggttttattaataatctacgtttaatatttataattagtgtccaaacatccgatgtgatagggatttaaaagttttagttccatttaaacagggtctaaaaagacacttaaaaaatagtattgcgatctttcgtgagcaacacatctcatgattaatcgcaatacacgttaactctacatgacaaggaaagaactataagaaagaaaagatagtgtagtgggcagagtccatgaaggtctgcattcgaatgagccgccgaacgcatttaacctcttctcaatacatatcaatatgaaatgcccctcttttcatatccaaaatattttctaaaatgaaatacagagtgaggagaaagaatgcacagtacctctgaacgaggtgaagggcgctgtacatcctgccttgctcttcagctgccctcctcaaacctcaagtattcaggtgtggtgtgcttctccttgaccgatcagtggtggctgaggtccttaaaaagggagagatatctccccacgtttctcatgaaggaaacaggattcgtggcccttatcaatggtggtatgtatgggccctgttctagaaggcattgtttgcttgttggctggctcagctcgcacctactcgatcttccagtcagctgaaatgctgaatgactgaccatacttcattcagacttgcatatgtatcaca

SEQ ID NO: 40004 - DNA, 935 bp, Oryza sativa
tcaaataactaatctaaaattcactcctataaaaactcatgatcttaagatgctactcagatcattgtaaccactaggctacatgcgatttggtagatccggttggatatagaggccggataaaaaataaccttataaaaaataataaaaaaagggcgatctctcccccacgcatgatgaaaacaacaagaatactgtttgtttgtttttttggttgcatttgcatgacctgatgatggtcctcatcaacggtgtcacgtccgtcggcatcatcccctctctgctctaactggccactgttgttgaaatggaaatgttttacctaccgatcatcaaatattcaaatgttaggttcgatttctctgctaaacaaaaattgtaggccatgtttggataataggaggggaaatcttatcccaccttcccaccttctagaagggtaacttttaatcctagccgttcattcttcatatctcgtttcatctcaaccctccactcatatccctatcccaatccccccccctaaacccattatccaaacatagctacagtaaatttgaatccatggcagtgaatttgtagggcgcgagggtccgattgctggatcgcgctgtgagtttcatctctatttattttcatttctaagttgatatgaatacttgtaggatagagggattagtggctgtgataactgaaaattcgcatctatctcatttcggcaaaattcactgtttgcggttagctcaaacgttagcttccttgttgctgtggcttttgacaaattgtgcaggcaagcagagccaaaatgcccttcaaattactgtatgctgcacagaacaatcagatacactttccagatcagcagtaaaacaactacattctttttcagtattctgttgcaatggccgcacagctgagtaaccaatggtcttgtt

SEQ ID NO: 40005 - DNA, 7945 bp, Oryza sativa
gccataattgccaatattataagtttcctatatttttacagtctatactagtagtccataataaaaagtaatcttggtgagcatgacactgtccaaaagtcacttatttgtggccacagggagtatttattatattagtattgtagataaataataaactaaacggcattatgttatcttctaggtaaaaaaactagcatcaccaacagtttgcactctttgtcaggagattttttttttaccaaccaactcggcacatctcacacatttttgtaagtggacaattttttagtttctttgtaaaaataaatggggcctatatcccgaaattgttttttatagttactgtaggagaagtttttgtggtacaatcttatatatagtagtaaatttcataaaacatcacttattatggtccaagtttcgcaaaaccatatataggaactttgacgtggcacataaccccatgtattatgattctaacatttcacaaaagcacagtaataattattttgactttgatctaccacacttttaaggtctacaagaaaatctcaaatttataagcattttatccattatatatatgtcatatctattttttctattttttctattttgatataggtgtatgacaaaatagttaacattgtggttttatgaaactttagaaccataatacctagggttatgtgccatatgccaacttggactataatagatggggttaatgaaatgtactctatatatagtataggggataagtacatggaaaataaaggggaaaaactctgcatactatgaaattacgagggaagcccatgaggaaaacattggtctagaggaaactgacaattacccccccccccctcctctccatttgaaactatgaaaatatacaaggtctactggtaaaaaatataagatgtgtttgttttccgtaaagtcaatatttaaaattctgaactaataattaaactaaaaatatatgtgtcaagtgctatgcatgtagtatcactatattggtatttgaaaaatatttttatataatattaatttatagttgttgataatatattagaaagaaaatattggcctaagtataatgttggaaaatttgtataaatctattacgtcttatatttccaaatggagtactccctccgacttcatattagttgtcggtgaagcaatgcattgtgtggatgataattcctacgtttgagcatttctgtggaggtttatgacgaatttcaccctgttaattaaactaattaatgagttaatgatattgttgtttgcaatatcaatattgcttccactaccatggtgcataatatgactaggatggtgtctttaaaattaaataagcagccacctaaaatgaaaaataatgtggtaagtgaataaatgaggaaaaagaagaaaatcatgtcttgcatgagacttgatttctgtacaatatccaagacatcatgtaagataagtagcattaaatttaagtatggaatagtgataatgtggagtttatggaaactatttatagtgtcttgtgatgaaatggcctaactaatcagctccattgcaagggcagcatggtgtggtcttctatttaatttaatatgggtaatgtaggaatagttaccctaattaattataacttgatatgtgagattatgataaaaatatcaataaatatgtaaagttctagattcctatgaccatctgcatgacgaccagctggcagctgattaactaacggcagtacgatctatcaacctgaaaccaattaatttttaacgagtttgttaacttatttttcttccttcttagtacgtagtaggagtatatataatatatacaaatagccggtcaattttgatctttcaaattgagaatacgtcctctcgacctatactggtcggcgttcaaacaaaaatccatatgcatatgcatatgcatatgcacacgtaacgcggctatatctagccttcttatattaaggaggttcgtagtatccatctttgtcgatcgagctagagccaacaacgatcagctccattctgcttctgctttatttctaccttgctaattttattaggatagtaattaagcttgcttaattattcgttctaccaggatgttcagatcaacagcgcaacgcctcctcaggtatgagtttgaatgttaattaattagatcaagatatattgaggaagctaatttgatttaaacatgcattttacacaaatctttgtttgctgtcttcgaaattgtaaaatgcatgttttgaaaccaaattgacaatacatatagttttttcatatatttcttcacaaacatagatttgtgttctcgcctatataattatatttgcattgccatttctatttcttagtgtgtatatacatagataacatgataacttgttgtctgtttttgtaatgttaacatgcaagagaaaaaaagtgtatttacgatatgtataatacattaatactttaggtttaaggccagggtataaggctgctagtaccgcgtattcgtatacgtacatgtgatctgaccgcgtattcgtatacgtacagggagacgaagagagtggttggcccaaggatgacgacgatgacgtcgacttcgcctgaaagtctaatcgccggtggattctccacggcggcgagctcccaccagaggttggccggcaaggtggccgtcatcaccggcgccgccagcggcatcggcaaggcgaccgccgcggagttcatcaggaacggcgccaaggtgatcatcaccgacgtcaacgacgacctcggccacgccgcggcggcggagctcggcccggacgccacgtacgcgcgctgcgacgtcgccgacgaggcgcaggtcgccgccgccgtcgacctcgccgtggcgcgccacggccgcctcgacgtcatgcacaacaacgccgccatcccggggaggttcccgcaggacgacatggcgtccgtcgacctcgccgacttcgacgccatgatggcggtgaacgcccgcgcgtcgctcgccggcatcaagcacgccgcgcgcgtcatggcgccccgccgcgccggcgtcatcctctgcacggccagcgccgtcggcgtcctcccgctcccggcggtcgccacgcactccatcaccaaggccaccatcatcgccatcgtgcgcgcagcggcggagcccctggcgcgccacggcctgcgggtgaacgccatctcgccgggcgccgtcaggacgccggtcctgcagggcaaggtgtcggtgatgtcggcgtcgtctcctaccatgagcgacgagctgaagcagatgatcgacgtcgacgcgaacgacatgatgatggggccggaggaggtggccatggcggcggtgtacctcgcctccgacgaggccaggtacgtgaccggccacaacctcgtcgtcgacggcgggtacaccgtgcacaaaggagctgacacaccggcggcgcgttgaacgcagccagacatatctaaaataaatcaacttagtacgaaatatagtatatctagattcgtagtatcaaaatgtgtcataagtttattttagaattgagtaattaagtagctagcatgaggtgtcctccatgcataagtacccaacctcatcattgttggaataaaggatagggtgtgaaaaaattctacgagatcagatttaagtttagacatatttctcaaaacaaccgcgtatgtacatgttttataattaattaattcccatagaaaatatagtggcattaccatttatttgtttatttttcagccgagcgttgaagtggactaattttgttctatgtacttgacctcgaataacgaattgaatgggctagcagctaatcgcgcttgaaaagtagagctttgacaaaaaggaaaaaaaaaacatgaagatccttgtttgagtccttgaacaactctccggtctgacaatcaacttttcagaagtgaaattttcttcttcgagagaaagaggataagtatagacaaatgtctagatcgatgtattttccattctagctacttcggtatactcatttattatcggaagctttgcaatattaactcggaaatagttaataatgcagtataagtttaagggaaagcttagcacttggaagggaaaaaaacaatctcatatggtggaagattagtccttgtaaactatgttagtttaattcttcccatgttatgttctcattctttgaaattccaggggtacttcaagactagacttttaatcacatatcactttttttaaaataatgacaacaacaaatagattaatcaaattacaaacaatatatcgatcaaaagacaaaggtgaactaggtgttgatcagaaccttactatcaagaataggtgtgtttgctaggcaaatgattattccgactggttttgggctcatcaactcaggatatcctagttttgggctagtttaactttattgtgaatgaaagatcaacctttttgtttctggtgtagatatggcaaagggacatatataagattaaggaagtgtcctctcaaagatcaatacctttatggctcgaaagaaacattgctttcaaagatataacaccgtagaatgaaaatgattgctttatttgatcgatgtataaaaataacaaattttcggttcatttgatgtataatgtgatcatgaactctaatgtgtggatccataagaggatataatgggagttaaaaggtgcaactaaaaatcaatttatgtgttttttcatcagaaagtaatcgtaacacacaagataaccttgcaaaaagttttttaaggaagggtgataagcaatattaatagttttagtgcgcaagagacaattcagcaccttttatttgaatgtcaagtagctctttttttttggcaatgtgtcttctttgcctttaaaattcctcctcctcatggggccaaaaatatatttcaaaattggccaatagtaatgcctaggtaaaataaaatggttttattcgagggcatggttttatttgggaccctttgtgttcttttattttatattgaagtgcatatctgaacaggtaaatgatttaagataattattcgactgtataaatgaatcaacaaactacaataaatttgaaaaaccgatttaaaattatattaacgaaatttatgtacataattttttaaaagaaaatatcgtttgtgagcttagaaagcatgcaagtcaatccattcagcagaacctatatcacggtgattcacgcttggtctgttttaattatttcagtccctgacaattagaggatgcttcttattgatctattactgtttcattaatcatagcaggcttcattgattccacacacaaccaccaaacaagatcagctatcaaattaagaaaaaagataataacgccagtttatgtatgtggagatcatttctctcgaaaaatatctgttcagaaattaactgtcgaatttgaccttgccaccatgcatgaggttgtcaaccttcaagaaaattcaaccacttatatttgcaagagtcatgcatgcatcgcgcgtcagggaagcatgcatatttatttctaacaagctcttattcttcttccgtcctataatataagggattttgagtttttcctttcactgtatgaccactcgttttattaaaaaaaatttagaattattatttatttttttgactttatctaaagtattttaagcataactttttgttttttatatttgcacaattttttttgaataagacgagtgatcaaataatgcaaataaaaactcaaaatcccttatattatgggacggagggagtatgtagtagtaacagttatatatgttctctaattaagtcaaatcacgcggtgttagaaaactcgcacgtgataacgtatgactttagggatatgaacaactatatgatcctatttggtggtatctaagatccatgttgaatttatagtttcaaagcttggatcaatttgtacgttaaattgtagtaatttgaaattttagatattttctataaaatacgaacaaaatgaagcgcgggaacaaaaatcatatgagactaagagtaatatgtttagggccaactcaaactcaaagacgcaaaacattaactcagttataaaattgaatacattaaatggtaacgatgcctacatgtacatattgttttgaactttttgatgagggtctcgagatctcatagatcaattttcttctctaagtactacgtaaatactaaggaattgtccaagcctatacatgacagaaccaatctattttataattttatcctgattattatcacagattatatacttaattataggaaaaataaatatggtaagaaataagcataaataatactaccccaatttcaaaatatatgacaccgttgcttttcgcataacatttgaccatttctcttattcaaaaatttagtttaaatatgtacaagtataagttaggcttatatggtttctttgataataaaacaatttataaaatataataatatttttatctttttaaaataagattaatagtcaaatgttatgtgaaaagtcaatggcatcgtacattttgtgatgggtaagtactacctccatattttaatgtatgacgctgttgactttttttcaacgtttgactatccgtcttatttaaaaaaatttatgtaattataatatattttattatgacttgattcatcctgaaatattttttaagcatgacataaatatttttatatttgcacaaaaattttgaataaaacgaatggtcaaacgttggttaaaaagtcaacggcgtcatacattaaaatatgagtgagtactagcttatcacattaaaatagaagcatggatctattaatccgttgtaataattccatggacaggatgaaccaaatatggttggaagaaacgaagaaacatcgtattaaaagattacattgacttttcgattgggggaagcaccaatgtggaagagcgcatgacttcatcgaccatcaatgattcaaattttattgcccataaatattagagtaaaatacaccgccggtccttgaacttgaagcgtggtgtcacttaagtccatgatcttgtaaaatcgacattaaggttcatgaacttgtttaagtgaatcattgcggtctaaagcacatttgaccggattgaccgtcctacatggctgtacagcgtggctgcatatttgctgttagacccctccgtgctcaatccaccctcttcttcccctaaatccttttctttttcttctctttctctcttttttcacggccctgcaggtaagctggccggcgagctcgccccggtcgtcgtcaccgaggtggatcatgcctgcgagcccctcgagctcttgccgccactgtcgggcttgagctcgacaaggtggccgtcaggagctcgacggagaagaaggcaaccgcagtcatggcctggctcggtctcccttcctgccgccccacgcccttgccggagccatccctccaccgccgccgaagagaggggcaccaccggggagaaccacgcctcactgacggccagatccgccggtttcgcttcccgctggtcgtcggcaccggatccgcgccgcgacgcctcgccaccggagtgatggatgtcgagctccgcctagttgccagcgttggatatggcctttttgccagtcgtcggcgccgcatctgaccttaccgccagatccgcggcgcgacaccttgctggcggcgtggagccagggagaagggcggcgacagcactggcgggagcagcagcaacagcagcagcgaggaggatgaacgcgatgtggcggcgcagaggatgagtgacatgaaccagtgcgcgtgccacaggaaggcgaggacattgatgcgatgcccatcgtccgcgcc

SEQ ID NO: 40006 - DNA, 17204 bp, Oryza sativa
ccatcgtccgcgccttcgattcgattagcgtctccgatgacccgaagcacgtcggcgtcgggaagccggatgtggacgtgccgaacgacccaatgtcggtgtcgggactgtcgtggctggcaaggtgcagctggtgatgcagtccatcggcaccgcgatcccaggcgtcggcggcagcttgcaatcataggccaccacgcaggacacggacgcctccactacccttgccttcggcgagccgacgactgggcagtagcaggacaagggggtgacgatctccggcacggtgaagcggcggaaggaggacgtggcacaacgcgtgccgacggtggcggcggcggcggtgccgggcgacatgatggcgaaggtccgggaggcgcccgcaggtgctgaccaaggcgcgggaggccgtcttgtcgctcaccggcgagaaccgcgtctccggagggaaagggaaaggggagagggaaggtggtgaggaggatgagggagagggcagagccgatggcgagcgggtgaagccagcggcggtcgacagcaacagtggagggttggatcggtgtgtaggggcttaagtgcaaatatggggccacgctgtacagccacgtaggacggtcaatccggtcaaatgtgctttggaccacaatgattcacttaaacaagttcatggaccttaatgttgattttacaagatcatggatctaagtgacaccacgcttcaagtttaaggactggcggtgtattttactctaaatattattcatatgaaggtgatcttttaacaggtttagacattacagatgtagcgttggtttccacccttttaaacatgcgttagattcttagagcaggccgcacaatagcagactattagccagctataaatatattttaatgagaaaaagataagagagaagagcagcgggctacagatctatagccagctgtagcacagactccaagacgcaatgtgcgtatgacaggtgggaccatatattaatagtataataagcaactatcgtatgaattggctatcagattggttataaataaattggagctaatagtgggctatactattaaacttgctattaaggggtgtatattcacggatgtgtgagtatggtgatacgtgtctagtggtgtgcgtgcttagttttgaacgactcgtaatagacagtgcgaagctctattgatagagcaggaaaaaaattagaagattacaatcttgtaaggtcgtaaccaggaaaacggaaaaagtatactaccacccacacaccaatagcaccaacacacagcagacccataaaaaggctagcatcgcactggccgctgctaggctaacaacggaacacagttgctcatagactttgacaaactcacttacggagaccaagaccgaaacgagcagccagcaggcatttcctggccttcttaaggaggcttgcatcaagggcattagccaactacgacgactagttcgatcaggtcgattctgctctgcatttttttagcaggatgttcagatcagcagctcttctaaggtactactagtctatatgagtttgatcaagatatatattactatataccaagaattcactatatattttttatactatcatagctaatcatatatgtgtagctgagtactgaataatgggtatggatgatctggtgtcataatagggagacgaagagagtttttggaacaacgagtacttggacagctggtttagtcgtcaatggcttctccacggcgtccagctcgcaccagaggttggccggcaaggtggccgtcatcaccggcggcgccagcggcatcggcaaggcgacggccacggagttcatcaagaacggcgccaaggtcatcatcgccgacatccaggacgacctcggccactcggtggcggcggagctcggcccggacgccgcgtacacgcgctgcgacgtcgccgacgaggcgcaggtcgccgcggccgtgggcctcgccgtgaagcggcacggccgcctcgacgtgttccacaacaacgccggcatcgccggggcgctgccgcaggacgacatggcggccgtggacctcggcgacttcgaccgggtgatggcggtgaacgcccggtcgacgctcgccgccgtcaagcacgccgcgcgcgccatggcgccgcgatgcagcggctgcgtgctctgcacgtcgagcggcgcgggcgtcatccccgtcccggctgtcccggtgtactccgtgtccaaggccaccgtgatcgccatcgtgcgcgcggcggcggagccgatggcgcgccacggcctgcgtgtgaacgccatctcgccgggcgccacgaggacgccgctgctgctgcggcagatcccgctgctctccgagatgtcccctagcctgagcgacggcctgaagacgacggtggagaaggaggtcggcgagggtggcgccgtcgtgctgctcgcgccggaggacatcgcgagggcggcggtgtacctggcctccgacgaggccaggtacgtgaacgggcacaacctcgtcgtcgacgccgggtacaccgtgcacaaaggagcgtgacaggtagacgacgccgatcgagcaggtggcgtgcatgcatcgctgcttggttttcaaagtcgtcgttgttgtaattggaataataaggacgtccgtgacaaaatttaagtatttgaagatgatgatgccgtttgaaactcatatagatgttgataaaaattaagtgttttacgcataattatatagtactaacgtatgattaattaagtttaattattacaaactttgaaaaatatatttatatgatattctagagcaacatccatatacaaagttttcgcacgaaatacaccgtttagtagttcggaaatcgtgccacgaatatctaaatttttatccaacttttattggagaaaagaacgaggtctacatctgaacatctgtgtgttgagatttctggctaaaaattactatattttaggacgaatgtagtattaatttatatgcaaattaaggatcaggatggagtcattattaaaaagaaggatcagcgtggagtggactgcctacttttcctctgtatagtaggtggattaattagtctaagcatgtgagggtgtatagccacgtgcgtatcatttgtttccgagaattaatccatatgtcaacaattcttcatccctggaatgaggcctttggttgttttgttagtctgcatgtatgctgtaagaacttagtaatacatgatcatttacggtaatactccctttgttctataatataagggattttgagtttttacttacaatgtttgaccactcgtcttattcaaaaagtttgtacaaatataaaagacgaaaagttgtgcttaaaatactttggataataaagtaagtcacaaagaaaataaataataattctaaaactttttgaattagacgaagggtcaaacaatataaaagtaaaaactcaaaatttcttatattataaggatggagggagtagaaatgagggtttatgccctttaataaaaaaattgtcaacaattatattatgtcgtatgctattcacatggagtacttcacatgtatgagacctggttttctaggattatttagttctgcggagtgcaacgcaacggtgtttttatttttctcatttctagaagtattctttccaatgagcagtcagacatctgatttgcaaaaaggaggaaattggtacagtacacttagttggtaccaggcattttcagaccacacaggcgttgcctgtctatacagtatcaattgcgcctatggtccagacatgacccaataagactcgggtcgtgccgtgtcgatgcgaaggcatggcttgcctagcatgctcatccttagaacaagtctaatttatccccctcatctctttggccttgtcttatatcgatgtaataagtttattttgcatttgtcatatatttgggccagttagggttatgaactcataatcatggaatcgactcgatcatcagattataagttcattccataccagaccagaccgtacacattcttattatgagcaaggatcgttgggccatgctggaccgacatatcgtgccaaagaataggcccagccacggtcgaacggttagattaagccggcatgaatccgacaacagttcgggcatatcgtgcttggatcgggccaaatctctatgccatggaaaaaaattctctgcggcagtgccgcacaccacagcccgtgcgacaccccgcagaatagcgacgcgtgtttaatctcctgctgcaggccgagccctctttggttggtgtcgagccgagtccatctcttgccgctgcttattggagtcaagctgtccagggcacatgaatagtttgtattaagtctggaagtttttgggttccctatgtaagggtggtgtattgcctctctttttatttctacaatatagaccaaatgattttacatgctgtataaatatgatgtcgtgaacgtgccaacctgatttcaacaccaggtgtgcttttaagttgtcaatgaatacatgtattttttacttgtcaggttgggtatagtgctagaattggtttgtgtgttgcaaactttcaaactttcatgtggttggtattcctatatagctccgcacctatacaattaaaaattttcggagctactactctatcccaacaaaaaagacaaactctagctacgaatctagacaatgtgttcgtagttaggattggactatttttttttgaaacggatggggtactctttaaatgttccgtgatttgttatgtcatcaaaatgtaatttctgagcacctgagatatcttgataaagtttaggtaaatgacttatatattacactagaaaaatctccacgcatatacatataccgaccaccttttaaggaggcttaattgcagtggactcttcaccactccatcagctcagttcgattcagctctgcatttgctacattctgagcaggatgttcagagcattccaactcctcaggtatcatgagcttaatcaaaattggagtatattatataacgggcctaggcttttacaaattatatatatatatatatatatatgacactcatatggggctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagaaatggcacgttagccctggtcagatttataccaggcttcatcctaaccattacaggcaaggtgttacacgaagaagggcaaacatgcacgttgataagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagaggggggactttttcccttttggaaggcggaggggaaaggaagttaatcctttgtaacttgtccatacacaaatccacaaaaacacaggagtagggtattacgcttcgcagcggcccgaacctgtatccatcgccgtgtctcgtgtgtcttgcgggcgggtgatctttccacatacagagagagagagagagcttgggattgcaccctaagcccctggtcgaaccggcaaaggggggcttgcgcagtctcccggtgaggggccacgagctccgtcatctggcgcgccaggtagggggctcggcgtgtgttctctgagctctcatactcttccgtgtgcgccaagtttcccttgttcagcctaatggccgagcaagcaaaggcgcacgacttctctccgagtgtgagcggcgacgacggggagccaaacccgcgtcatcgagctcgtactcccccacctcctccgcgccaaagtcctaagcggggggaggcgctcgagagggttgaaaaacccacagcatcaccagtcgcgggtggtgcaggagaacggcgagatggggagcgtcgcctcctcgtctacggcgacggcagcacgccccagggagtgcttcaggctgctggcgcgctcctacgtcacccgcccgtcgtccctgacccggagtctccagcccggcgatggctggacgacgtggccaacttggtcatgacggcacagcagcgcctgggtgctggtggacggtccgccactaccaggacccccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccactcagacagggcggcgtgacaggaggaggaagaaaaggtcggtccattccggcgacgagggtcacgtcctcgccgtcaaaggcgctccgcgggccacccgaaaggggaggcctgcgagcgacaaaaagaaagaggcaggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcaattccctccggtaaacggcgaagtgaggccagacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccgtgtgttgcccggggagggcagattgcgatggtggtttcccccaccatctgcaatgtgaagttggggcgtgtcctcatagatggaggagcggctctcaacatcctttcccccgcggcctttgacgctatcaaggccccggggatgatgctccagccgtctcaaccgatcattggtgtgacgccggggcacacatggccgttaggtcacatcgacctgccggtcacctttggtggatcagccaacttccgcacggagcgggtgaacttcgatgtggcggacctcagtctgccctacaacgcggtcctggggaggcccgcgttggtgaagtttatggcggcggtccactacgcttacctccagatgaagatgccgggccctggtggccccatctctgtccgtggcgaccttaaggtcgcgctcgcttgcatggagaagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcagtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggctccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgtactactcgaatttctttgggtagccaaataggacgtaatgttgaggcgtatgtcgatgacttggttgtaaagacgcgcaaccaagagaccttactctcagatctagcggaaacttttgaaaatctccgctccgcccgcataaaactgaaccccgataagtgcgtgtttggtgtgcctgcgggcaagcttctcgggttcttggtctctgcccgaggcattgaggccaaccccgagaagatacgagctatagagcggatgcgcccccccagcaaacttagggatgtgcagtgcgtcactggttgcatggccgccctaagtcgttttatatcgaggctgggagagaaggcgctacccttatttaagctcctcaagcgctcggggccgtttacttggacggaggaagctgaaaatgccctcgcccagttgaaggcgtatctcagctctcctccggttctagtcgccccggagccaaatgagtccctgctactttacttagcagcgaccccccaagtagttagtgcagcgttggtagtggagcgcgatgaggacaatcctcattctacgcacccccactctgtgccgacttggcccgggagcaggcagggaggagaggcccccgagtcgaacggtggcctaaggcccccgacgaccggagtcggccctctgcccgcttgtcagacggtgctgggtgcccccgaccctcaggaaggccccgaggccactgcgggaaggccgcacctaccaccctttgaccccgaggctaaccctgtgctgattcgacccgggagagagcagggagaagaggcccccgagccgaacggaggcctgaggcccctgacgaccggagctggccctttgcccgcttgtctgacgacgccaggagcccccgacccccaggacggccccgaggccactgtgggaaggccgcacctgtcatcttcggaccccgaggtcatcagtgcaggagacgagtgtgccccgagaggccacttggacgaagagcaccccggggatacggcccctagcgaagaggatcggccccgccgaaaggtgcagcggcctgtttactttgttagtgaggccctccgggacgccaaaacccgataccctcaggcccagaagatgctttacgctattctgatggcctcgaggaaactgcgccattatttccaagcgcatcgggtcactgtggttacgtcctaccccctcggccaaatcttgcataatcgagaaggtaccggacgggtggtaaaatgggcaatcgagctttctgagttcgatctgcactttgaaccacgccacgctatcaagagccaagccctcgccgattttgtggcagagtggaccccggctccggagaccgtctcaatccccgaggccagcgcggacccctcacagctgcctcacgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccggactcagagtagcagctggactggggatccgccgcctcttggtgttaggcgactcccagctggtcgttaaccaggtctgtaaggagtaccggtgctccgacccacagatggacgcctacgtacgccaagtgcggcgtatggagcgccattttgatgggatagagcttcggcatgtacccagacgggacaacgtggttgccgacgaactctcaaggctcgcgtcctcgcgagcccaaaccccaccgggcgcctttgaagaaaggcttacccagccgtcggcgcgacccgaccccttaggggaaacggatacgcctgaccggcccccgaggcccgtcggagtccaggcctcgggacccgaaggaagcgcttcaagctcccttagattgattgcgtggatctctgagatccaagcatacctcacagataagactctacctgaggaccgcgaagggagtgaacgcgtccaacgcatttccaaacgctatgtgctggtagaagggaccctctatcggcgcgcggctaacggaatccttctgaagtgcatttctcaggaacaaggcgttgagcttcttgttgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtacctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccattcgagctcaccctgaggtctcctcgggccaccatgtactgcgaggctgatcaagatcagcttcgcagagatgacctcgaccacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggagggggggggtcgggtgtcaggttttggctcaggccaaccccgcacccccctcgggtgtgcagggttggccgggggctaccacacatgcattactttcttatttctcttttttcaacatttcaatagaagcagtttcaatttcctaaaggttgtgtctgtgctgttctttccttttgaagaatcttgacttaaaataaggtcactcgtactcaaccttgccctcgggggttcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatggcacagatacatcctcatcgcgtatgtatagcaaaataaaactaacacaaaaattttttcgtcatttctgattgcagattaagttaatttgtacacaaaagaggcatgaaggccttcgaagaaagaaaaagaaaaaaaattggagattggcgggggcctgggggctcattccaatgcgcccgggtcgctggccccgtcgccaccgtcatcctcgccgctggcgtcgccctcctcgtcggagctgggggcgaacgcgagccgaggggccgacccctcgaagctttggacgatgtggttggcggcatcccggacctgcgcgcgcgcatcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgagagaccgcatcccaaagcatgtcgggcccaatctcgcccgccaagcgaagggcctcggcctccccggtggaggagtccagcgctcgctgcatatcggcaacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcggagggacaggctgtccgccagccgttgtgtcgcggcctcggattcctcaagagctcgctcccgctcagcaagcgcgtcctcgcggagccggagcgcggactcctcttcggcgcaggcggtctcgtgcgccgccagcgtcgcctcccggatagcggcggcggcctcgcggtccgccaagctggtctccacggcgccggcatgatcttccagcgccatggcacgggcttcaagggcctcttcgcgccgccgggacgccgcttcagcctccgttgctcgctgctctcgggcagcggcggtgtcaaagaccccctgggcggcgtcgagctttttctttagctccgcctcccagctcccgtgttgagggcggagggagtcctgcgcctcaatcatcgcggtggtggcgatgagggcggcctctcgctcctcctccacctctcgggcgatctccgccagcgccgccttgcgtgcttcaagctccgagatgtggcggcggtgagccttacggcccacctccaccatggcgtccaccgagcgccgcccctcctcaatgcgtgcccatgcggcctcgagctccgctcgttctgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtccaccggacccgtttgatcctgggcgtcgcccggggaggtgggcccaggcgatgtgcccgcggcctcgtcgcgagcctccccggaggctgtcgcctgagggttgcccgagggagtgggcccagttgacgcgccagcagcagctgttgcctcagcctggcgagcccgggcggcctccaccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccgaacttggggtggcgggaggaatgcgacgggacatcgctgaagcagaagaaaaaaccagaagacgaacaaaatgagtaagaaaaaaacttctttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccctgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacgaagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaaaatggaccgccccgggtagtctggtgccgggcgcccctcgcccagcatcactatctcccgaccggtggcgggctccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtgggtatgcggttgtggcaatcgaaatggattgtatcgtgcgcgcgttaattacgctcgccgaccgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcactaggctttaggggtggcgtcacgcctgaccacttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatacatgggataagtgagcacagctgtgctcacctaacagcatttattgcagtctggtcaagcgtgtcacgctg

SEQ ID NO: 40007 - DNA, 940 bp, Oryza sativa
gggactttttcccttttggaaggcggaggggaaaggaagttaatcctttgtaacttgtccatacacaaatccacaaaaacacaggagtagggtattacgcttcgcagcggcccgaacctgtatccatcgccgtgtctcgtgtgtcttgcgggcgggtgatctttccacatacagagagagagagagagcttgggattgcaccctaagcccctggtcgaaccggcaaaggggggcttgcgcagtctcccggtgaggggccacgagctccgtcaggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccataattacatacctaactaattatatgtatggatactatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatagtgcccgggcaccatggagcaccaaacaaatttatatatatatatatatatatatatatatatgtatgtatatatatatatatatgtatatatatatatgtatatatatatatgtatatatatatatacacatatataggacactcaccatggagcaccaaacaaatttactatatatatatacatatatatatatatatatatatatatatatatatatatatatatatatatatatatatatatatacacacatatatagtatatgtatatacatatatatatatatacacacacacacacacatacatacatacataca

SEQ ID NO: 40008 - DNA, 5298 bp, Oryza sativa
gaatatatcgttagcaaaaaatgtactattgttgatagatgcttgcagaatctcatcctcgatcgcactgtcatcatggagggaaaagttacgtgcaatttagtaatttcttacgataagaacctcattttttcagttagcaaacaatttactattgatttaattagtgcacagcgatgatttttgcccttatttacttatggttttttaatatattaattgagtcggtagtaaaatttttactggacgttaaaattactgtttctggaagctttgacagtgcattgtgcgctgtaatttctaaggttattttaaatgttacttttataaaaaaaaatatgggaatgtagggaggtagttatggatcagtggactcccgatccggaaaaaacgcattccatacaatactgaggaggtagtgtgtttattcctcccagtcagcattcaaagtcgagtgaaaaagcttcgctgaagacttgtgtaatgggatctccagtgcatacttccactacctcgccatcgtcccgtttaggtgttgacggtgatcattggggggatcatcatgtgaatgccgggcatccaggcagtccgtcaacaccgtcaggatcccatgaaggtgtggatcgacctccttgtgttcaggcatgtgagatgaatacgcctgagaaggatcgtgtgtacagacatgtaagtttccctgaacgacctttgcaataattagaacttctgtttcttccttaattgctgagtgatgtttgacacggtagttggcgttgttttgcgatttattccatttaattactttagtaaattatggcgtctgtaaatgaatttttttctgtgtcaatatgatatcccatatcgtcatgttgacagattgaaaaataattgttgacaggactccaaacttagagaagaaatggtaccaaaagtagggatggtttttgattcgtacgaagaggcgtacgatttctacgaaagatattcatatcatgctggttttgatattaaaaaaagcaggaataaacctacttttagagagatatgctgcacccgggaggggaagaacaaatataggggagatgaatcaaagcgtgagcggatgcgtgggtctgctaggattggttgtaaggcatatgtgaaggtgaagaatgttattagagaaggcgagtttgtttccgtacggtttgatgatgtcataatcgaacacaatcacccattgacgtcgtctccatcggctgttaagctgatgcgttcgcacaagcatcgagatgaaacactgatggagttcgttgacacgatgcagcaaagccgtgtccccaattcaagtattgtaggagtactttctgatatgcacggaggacgtgagaatattcctttcacgacacgagaccttgaaaataggtattttgtgttaaaacaaatattgttttctaaatcccgttgttcccaacagcagcaagtatagttatctaatctcgctatatgtgcaggaaagctgctaatgttcgagcagagaatgcagatgacattagcaagctgctagagtttttcaaagaatgcatgaaagaaaatccaaagttctactgggattaaaggttgatgaggaagggattgttaagaatgtttttttggagccacgcgagtatgcaagcaatctatggagattttggagatgctattactttcgacaccacatacaatactaacatttatgagatgcctttggccatgtttgttggggctaatcatcacctgcagtcaacactttttgggtgtgcgttgattcgggatgaaagggctgagtcattccaatggctattggaaacgttcaagaattgtatgggggacagcccttcaccccggtgcattctgacaggtatttattgttcactttttgaaaaacaaataaaagggattattgataaatcaacatgactactcatattgtatttgtcgattttgtcagaccaagaccaagcaatggcagtggcggttgaacgcgtttttcctgaagctatccataggttgtgcatgtggcacattatagatgggcactcggaccatctgaacacaattttttctagaaacgatgacatagagggggagatgatggtttgcattaaccagacatatactcctacggagtttgagaatgcatgggatcgtttcattgataaatatgaactacgtgacagcgtgacactacgcaacctgtatgatcttagggaaagatgggttccagcttttttcaagaaacattactgtggtcgtatgacttccacacagaggagtgaaagctttaacagaatggttaaaagtaattttgtagatcatcaaactgcactacataggtttgccagaaggatgctcgatgttgtggtatctaggaaggataaggagtccgcggagacccgaggttgtgaggtaattgcatcttaatgtatatcctttttttaggatttaatctggtaaatgcttatatcgatgatgttatagggtgtacccattgtgaagaccccttggccatttgcggagcagttatctagggtgtacactcgggctgtgttcaaggtgtttgaggattccctacatgatagtgtgtattttaggattgaactagagggatcggatggcattcattgcgttatttctcataccaaacgctcggagaagcatgactggtgccaaagacagttcaaggtgatagtggatgttgataacgggaactttagttgtgaatgcctgcagtgggaacatacaggtaaaatatccctggtgatatagcataaatgttttgaaaacctggttttaaaaatttccgtgtttattttgcaggaatgttctgcccccatctgttgcgagcctttgttcatgcgcaggttgagaaaattccacatatgtatgttcttcgtcgatacacaaagcaagctaaaagtgatgtgaactatgatcgtcgtgaccgtcctatggctggaccagacggtgttaaagaatcctacagaacaaagttgttgtcatatgatgccatgcagatcgtcaagttggggcggaggtcaaaggtagcttttgatagggcaactgctgtgctgaagggactgaggaagcaacttgaagagataccaccagattcagatgttggggttggcaatgcagtgacaagtggtaaagacgcggaaagtgtggccgataccatgcgggctggacaatcgatgtcaatgagtgaacatgattgtgaaagagtgagcagacgccctcctcctcggtcaatgacaaagggaagggcaagcgagcctaccgagaaggtaagctaggggctcgtggcgataagaaatgcaccagggggtgcgggtggtgtggtctgaaagttggtcacaatagctctacatgtcctaataatccagctaatttcaagcgtattgcggaggccaacaacaagggaaaacgtaagagaggtcgcccaagaggaagtggcgttggaggtggtcgtggacggaaagctgtgagaaggaacctgattgacgaatgggctgaagggcctgtgggaggggagtgtagcatgagaagcgaggagggtgatgatgactgtagcgtgcaaagtggtggcgacaccgaggatctttcagaatgaatgtactgaggggtttgtttcgattgggttttctcgagtttcattttgtgctttgtagatgtccttatcatagaaacattacgttaataaaggttttggtatatttatttctatgttgttagatatggcatagcccggattgctgcgtttttttaatttctttactggcactgaatggaattgttttatcgcttagtaaaacaattactcatatattacgagagagttgtgtttttttcaggcaacgatcattatgaaattgaaattccgatcatgtagtgtggaacttaaaaataacagacaagagggtagtaaattgattactatttagttgttctgtctgttagtaataaatatacttataagctggggagattattatttaattaggttaatgaccttggactcccattgagtatgcatttttaattcatggcattgtttgaacgcactttttgaataattactttgcattctaaaattagtcgattagttattagattagcagtatgaaattttattacagaatgttgccatataagaaataacattggtaaagaatttgcatatcggctaacattgcattgaattaatgaaggtggcagcaataagactatctagcattttttatactaactgccttcattactacaatagatcacatttaagcagttttttcaaagattatggagacaaaatattaataagcatagtattatgttctggaaaaacatggacaatagccctttacttaactaacagcacaaccaggcgatgcaaaatactaaagttccggaggagtggactgtataaaatacgaaatacaatccaggggcaaaagtgaagctaacagctaatgaaacgtttcttcatattaaacataattattgggcattgtcgggtacacgaaatgtctcgatgtcctgatggagctcttgtacagagttgaacctgttgaagattaggtggtgtagtatttgcgcccgtagcttgtccgaaggaaccttgcaatgtttaacatttgtcaaactgtgtggcaccaggttggttgggggtagggggtggggtgggggtgggggtggggggtgggtgcgttgtctgtagtatagtgtgtgtgtgtgtgtatatatatatatatatatatatatatatgatcagtgtaattgggcaaaaatcgacttctcctgcaaatttagtcgttagtggcttcttctccgcggcctccgactcccagaggttggccggcaaggtggccgtcatcaccggcggcgccagcggcatcggcaaggggacggccacggagttcatcaagaacggcgccaaggtcatcatcgccgacatccaggacgacctcggccactcggtggcggcggagctcggcccggacgccgcgtacacgcgctgcgacgtcgccgacgaggcgcaggtcgccgcggccgtgggcctcgccgttaagcggcacggccacctcgacgtgttccacaacaacgccggcatcgccgggaggctaccagggcggcgctcgccgccgccgtcaagctagcacgccgcgcgcgccatggcgcctcgccgcacgggcctcattcagaacataagtaggcccgatcaagcatgaggcccaagtagaacccactactctcaaatacatggcattcggcgagcaagga

SEQ ID NO: 40009 - DNA, 1773 bp, Oryza sativa
caaaccatacacctattttacgtcttccagattggagaggatgttgtgcagtatgtgccttgtggccatatttctagattacaggacaataatatcctgactacactgaacccataaatacaaacaaacaaaaaaaccataaccttgtgaccaactgaacatggtgatgtataaactacacaactgacagcgatctgcttagccgcctggaaaaagaactaagcaactttgagtcattgctactttgatgtcaacgaaagagagagagaactaatacaagcaatagtgttgcatgtgtcttacgtgtcaccgccatgtatgaaaattgacgaaaggttcttcggagtaaaagaggcgacaacccatcaaataattaatcgaattcaggacgaattgggttgttggagtttggccggcgcaaagcacattataatattgttgagataaggtgaaagttggactgacgtgtatgtttgcaatcatgacgtgtaagtatgtttgcaattagaaatgtacagtttttcattttctttcagcttttattgtgtacttaaatcccttctattagtataacgtcgagcaacctgtttggccgttccaaaagaaagattagctcaaagtccacagcgagagatgctcagtttcagagcataaatacactctagaatgctgaattgaccattatcggatcaggaggaccttatgatgcagagaacaatgcagctcgttctcaggtttgatcaccttattagagcagagttcatgtctgttcttgattgctcactaagctgtaaagatgatttggttttctgtttgcgttagggtgaagagatcgtcgggtttactacaccaattctccactgcggcgaactcgcagaggttaatttctttcatgattttctgatcattttgtgttcatgtgtgtggatcatggtgatcgattcgatgcaggttggccgggaaggtggccgtcatcaccggcgccgccagcggcatcggcaaggcgtcggcgaaggagttcatcggcaatggcgccaaggttatactcgccgacgtccaggacgacctcggccgcgccgtcgccgccgagctcggccctggcgcgacgtacacgcggtgcgacgtcacggacgaggcgcaggtcgccgcggcggtggacctcgccgtggcgcgccacggggcgctcgacgtgttctacagcaacgccggcgtcctgggctccatcgcgccggcgccgctcgcctccctggacctgggcgagttcgaccgcgtcatggccgtgaacgcccgcgccgccgtcgccgccgccaagcacgcggcgcgcgccatggtgccgcgccggagcgggtgcgtcctcttcacggggagcgtgtcgggcgtggtgggcggcacggggccgacgtcgtacggcgtgtcgaaggcggccgtgctgggcgtggtgcgcgccgtggccggggagctggcgcgccacggcgtgcgggcgaacgccgtctcgccgtgcggcgtcgcgacgccgctgtccatggtgcaggtccttgaggcctaccccgggatgagcttcgaggagctcaagaacgccatggcggcgtccatggagcagatggaagctggcccgttgatcgaccccgaggacgtggcgagggcggccgtcttcctggcgtccgacgaggccaggtacatcaacggccataacctcgtcgtcgacggcggcttcacggtggggaagcgctcaacatccccaaggagtagacagtgatcaagagcagtgcaaca

SEQ ID NO: 40010 - DNA, 1136 bp, Oryza sativa
aattcctgcagcccgtatacaacatcccggtgagcatatgcagtggcagtactctcaaacaggtaggccactgtcttctccatgtctggctcattgtagggccaaggagtgaagctttgcctccacttaggcctaccaaccggtagtcttagccacatccacatctgaatcaatagcacacaaccactcatgacgacaacagacctcacagagctgtctatatgtccacgccaacactgttgagccccaactgaaacggcccagatcaccaaggttggcgacagaagcaatgtcacccccagcatctggaaacagaacccctcccaacaagtgcaagatgtatgcacgggcatagcactcaacacgccatggctcagcatcgtcgtcaagatgtgagaagttctggctcagctaacacaggggtattccattctgcttcttcttgcccccttgcccctgctcaatgttgagtggaatgccaaacagctgctccacttgtgcacgccatccaggattctctgtcctgcccgtcaccgcatgcccccgtaatgggagggctaagatcatagccacatcctgaagagtgatggtcatctcaccactggggaggtggaagctgcgtgtctcaggcctccatctgtccacaagtgctgtcaacgcaggagcgttgaacactagcattcctctgctcacgaccaaggccaccccgagcaacccggccgcccttaggtccgggatgtacctatcgtcaaacactggggggcatgagctctaactcagagcggttgaagtacctgcattagcaattgtaaatcaattagttaatataatgtcaaacacacgctaccgatacttaggtacaagtgaatcgatgccgattcataccctccccgcctcgatcgcagccccgcgatgacgggcctcgtagtactcctccaaggctaggtaagtcggcggttgtctctcctcggccatcctacatgaaaaagtaataaattcaccgttagttaccaacatgacataacttaaaagaaaatgaatgcgagaatccaaaataaataaatagacattaaatagacaagaataaaacatgcattgacttaagtaggaaaacaaaagatttacctccttaacac

SEQ ID NO: 40011 - DNA, 6219 bp, Oryza sativa
  unsure (1)..(6219): unsure at all n locations
cacccctctctgtgacctcatatgtccttttttgcttatcgaaacaccttgaagtgtgtttgttcgccttgcttttttgcaccatcatcttactagcaaccttggcggaccaacgctcccctgactagactcgcttcactgcttcatcatgtctgttcacaaagtaatcattgcacttcatgaaggtaaatgatactatggccgtcactggaagcttatgaacaccaactagcacgctattgaactgttcggccatgttggttgccatgtaaccccaccggcggccatttctatcgtatgcacgagacaacttatctttatccaacaactcatcttcaagccatttacgaggaccttcgggaatacgctatcttagtgtctcaacatccctctcaaatatccacttctcgtcaatctgacatatccttaggagctcttctgtctgatgcttgtccgcaccggccttgtggaaattagcactgaagtgcctcatgcaccatcggtgatgaaccggtggcaatcctggaacaggagtcttcatggcattcattataccagcaagtcgatctgagataatacaaacctccctgtgcagcccaaccacaacccgtcggacaagattgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctgcaatgcttaaaagcctcaatggaaggaccaaagcaccagaatgcacgcataaaatttttcttggtcactccatcaacgttgacaaccctatcaggatgagtatcgatgtggtagaccatactgggatttctctgcttaatggcttgtagcaaagtgggcaaacggacgtacgcttcaccccattctccgtaaatgagcttcatagcctcctctcgtgccctccaagccttgtcatacttcaccctatactagaaaacctcaaatatatacaaagctaacgcagaagctgagagtgtaggttgcaattttatggcattgcataacctatttgctatgaacttagatgtcagctgccgatggctccctgaaccttcggcagtagcacaactatgtgccttaccaacctgtgatatcctccatgtgccactagacctcttagttgcatggaccttccatttgcactgtgggttttcatatttaacagtgtacctcctatttgcggcagaattgacaacacggtatggacgatggtgcacgatggcgtactcctggagccatagcttcaatacgaccatggatgggaactctaaaccctttctgagaccatccacctggaattgttctggcaactgatctaggttgatgccgccatctagtattgcaccatgggcatgtgttaggtccctaaactcaggaatgtctggcttcctcccaaacaccttctcaaacgcacgacattcctctaatgctaacttgtcattgttagttagtggagggaatggacggtcatcatcagagtcttcagcaaattcaacatcatattgctcaacacttgcttcctcgtcaacctcctctctattgacttctactgagacagaatcgtgaccaccactcaattcgacaacaaagtaatcatctggattcacatattggcctgctacttgcgtcgggtattcagggttgccttcgtacgatgaccaatgtacactctccgataaatgttcacttagatcaagcccctcttgtactaactcccttttcatctccctcgctacgtccatatcatcactaccgcaatgtatctttgatggtcctgcctcccctaaatcatttccaaataaaggtctcttcttctctccttccccctctaagtcttctcgtaccaactcagtcttacttgcaccccctccatgacgagaagaatatgtcacaaaattcttctcaacgtaatgataagaaggagatttgtttagatccaaattttctacggtacgtaccaactttgatgcaaacacctctagagatctgaactgagactctttttccaaatcaaagtaaacctcccattccaactgacctatgacatttaatatatacttatgcccttgaccaacatcgtatctcccataaaaacgaatctccacattatcctcggtccatccaagaacttctttcactcgtgaccttagttcatctagagttgggtgggtgggaaacaaaatggtcttcaatgacatatcctcaaactcaacatgtgcaccaacgtagggttccaccactctaccaccgtagtaaacacgaacaagtctatccatctacacaaaaaatcaaatataactttgcaataaaaattaaatcttccttcctaaacgtagtccaaacagacatattataaccaatgcataacttaaattgtcccaaagctagtactccacaaaaaatatttaatccacgtacaaatatcaacaagtttactagtgcattacacatcgaaatattacaaatactccgtcatacaacccaacctagttctaataactataatcaatttctataatgcaaccaaacttgtctccccttcttatagttaatggttaaaagtttaacctataggctatagcatcaagtccatcaaattaaatttactttcatgcctcaaccctaatttttcatgcatccatccaaccaaaccatccaaaaattaacataccacatatatggttcaaaaattcgtgacaccaatgagtacattgcaaacatgtagcactacaacaagctaatcccaagaacaaatgataaaatcacaaatttgggcaaaaaaggggttctagggttaccctccgatctacaaattcaaccaataaaaacgaaaaaaaagaggggggaatggaggagtctacctttctcttcgattttcacaaaaaatcccgcgaaaaacgagttcaaatggagtggatttgaggtggagaggtgagggggagagagagggggagagctgctgctgctctgctcgggctggagatgggtgcgaatgagggtggggagaagaagatggtggggcccacgcaggttaaagggggcagcccacactgaaggggtgcgccagccatgctggcncccctctgtgtggagcggcgccagtgtggctagcgcccccccttcgttccgtcagcacggccacgtaggccctagtgccacggtggcacgagcatggcgccagtgtgactggcgccgccatgttgggggacggcgccagccactctggcgccccaaaaaagatcatttctggtttaagtttttctaggggtccatttgtaaaataagttttcaaaaaggaccaaaatgtaaaaatttcagctttaatttctttaaatgcccttttctttattctaaaataccattttaaattttatttctttaatctatttaaaacccctttttgaattcaatttcctttgatttctaaaccattcatataccatcctttagccactaaatagccgccgtggaactttatgccttctatggggacgctcgtatggtctgacgaccccgacgtcgaactgaaggttgtgaaacccgacatgacctattcctcaggtcgaagtgttgctcttcgcaccccacgcctcaacgcgtacagtggtcggagcctcactactccctcgacctccacaatacgccgcacactagtccttgagctatgtgcgaccctagccgctctactgtcactcacgactgtagagtaacattgttccgctccacataaatctcccaactcactagtcgttgtgatgcttgactgtagcatcgactagacgagccgatatttagccgacatgctacccaatcttagcaccggctaaccaacctagataattagccattatgccttagcatcggctaaccaactccaaatatctagccgtcgtgctgccctactctagcaccgactagaaaccaaatccaccaaataaaccccacctatccaaattatccttccttcgattttattcaacttttagcctatagaaaccatcacctctcttttattttttttaaattaaaaagtttattttaaacccattcctttttcctctcgcatcgctctaattttatttattccttggttttatcgtttctttatagcaatttgcttataggctttatttgctatcttttcgtattcatacgttagactgtacaacaagttttatcagcatccaaggagctgacgtggacccagatggctacgctgaagccgcgggaaaatcttaaggcgcaaggcaagacataactaaaattttgatcatatagaaaacttattataatcttcatatttaatttgatgcataataccttagtcttttaacatctcgtgggtagatgttaaatgcttttaagcatgattacatgatattattgaaagatacatttgagatcattttatgtggtttattattcaaacatctttacaaacttaggaatccggttaaaatgggcatttatgaattgagatggtgaatattatgattatgaacgttgatggatgatgaagttggtgtagggagtttggaaagttttgggtggtttaaccagattataattacccccttattactcctttactttatcattgttttatttattcatatctcttcactaattatttataatatgtcttgctgagtatataagtactcattcttgaataatttaacatatagaggatcgtgctaaccggaagaccagaggatagcgaagtctacggcaacgacgagtttttcttctaggctagtctacactcgagctattgcctgtggagttctttggagtttattagttgtagtttagtaatttagaagtttggatttttcttgtattttcaaataaggatattttagtttggatcttttcaacctttaacagttgtataattagcctgtataaataaatttgtgtaagtaatcgaaagctattctgtatatcaatctatgcgtgatcgaaatcctggacgatcacgagtggattttcggggcaccaagcctaaattgggtgtcccctcagagggagaggcggggaggtggaggcgcggagcgaataggagtcgaaacgagagcagcgtgtgtccctagccggctaaccctaacctctagcaatggacttttttcttgttgagacgtggggtgccaccatagcgctgcccggtgatagtcctccccgccgccacctcgtccgcacccattgccgctcgtctgtgccaggcgccaccccgcgaccgaccgctgcagctcaaccactgctcctctcaaatccaggagccgcctcgcctccgtgaccgccgccgctcatccgcgacccgcctccgcccctcctccactcgcaccgacgagctcctccgcctccatgctcgccgctcactgcgccccagctattgggagccagacggcactaacatccgtgcaaagctgtccatcccatcccacctcagtcccttctaccaaacaaaaaactataaccatcccataccataaactaaacagataactggaatctttccatccaaaaaactaagataggtctaacccatcccacttggtccccaaaccacacacgccaatggatcgaaatggtggcctttcctgacggtggttttcaggggtaattaaaacgcatatacattacagacaggtgagtggttcaatgcgcacacggaacaccaggacctgccctgcatacgggaatatctccacgatcacacaaattatttttttttgaacctttttaatttttaattttaaaactaaaccatttcaaaatttatttttaaaatctgaaccttttagccacgccagcccgcctagcgtgacaaaatactggcacgccacctgcagtgggtgtgataatacacgccagtgactccggcgtggccaaataacgctatcacgccggggtgacaatattgttttgccacgccaggccaaaaggtttatatcttgaaaataaatcttggatgggtttatttttaaaattactagaaaaaatacatgtgcgttgcaacgagtaaaaatgttttgggattgctatacattatactccttgtttgtttttttagttgaatactccttggttttaggctgaaagccccattcatttcttttca

SEQ ID NO: 40012 - DNA, 2449 bp, Oryza sativa
agactaaataggcatggatataaattactaatattttatatatctgcgcggctctatcttgcgatggctggagaaggaaggataatgccaacgtaacttgggcacaggccatctgttgttgaacaagtcgctgaattacttccgtgaaacaaagtgagtaaatatcattgaaccgcttcataattaaaaaacacacatacctgttttggttgtccataatctcaggagagatgtccctacaacaaagacacaaaacagttcagcatccggaaataattaacttatagctttataaaagacaaatgatcacacaagtcacaattgtaaaagaccaagtgatcacataggtctacatataagacatacccttctccatcaaaatagctcaataatttcagaattgtatcccttggtaaatacggagtctctttcctaccgtagaagttcataccaacgaaattaccatgacaatcaatcaggggccctccaatcccagcctagcacaaaaacaaagtagcacgtatgaaaagatattttaaatgccttacacaagaagttccgcagaagcaggggcatttcacactttacaaatctttgtcacactgtaagatagttggttgtttcatttcctagggaacatgtgtcatgcactcatttatttcccaaaccttgcctaaggtgtggccatcttgttagacacccctttggctaggtttggtaaggcatggcaatgtttggtagtgttatattgaattgttcatgttgtaatgcaacaaattgtttcactaagaaaattaaagcctttcttttacaaggaaaaaaacaaaacttcaatttggagattcagtgtaccttactgattctacaagtggagaccttaagttctttgcagtcaagtttgcttggtttgtcagtcaatatcccacttgtggccattaatttggctgacttgaagacgcgtcctacagataatacctccttacgctcaattagccctggatcatgaaattcttccgtacgaagacaacgaaaacctttgatgctgacaatagcaacattgtaatgcagatgataatgttgcaatgtccctacagtttgttgtttgtttggaaggtgtacaacaatctgcagaagtaatgtgaggatttaccggtatctcaaatgaataagctcaaggaggacaatacaataccaaccttcaagttatcattaatcctgttttcatcatcagaaatcctaaccaaacttgctgaagtcagaatccttgtgttggattcatcgcagcctataaatattcctgtgcaagcaaaaatccgttcttcgcctacaagatcataatgaatcatagttagtgatatgatataaaaaagaaatgaaaatgcaatgagattataacaatgcgattaccattgaatgaagcaagagagacaacaacacgagacatgtttgaagcaacttttttggtgagtttactccagatatcatcagcaaattcattttcaaaagtattaaccaaacgcatgcctcctggttaaaaaaaagtagtaccacatatgagagtgctgtaatacaactgtcaaaatgtgcaatacaagggagtaatcaacaacaaactcaccgtcaaggacagctggcaaaggataaccttgggacgttagttccttgattaaaaatttcccaaattctggtaaacaaactgaaatgattaatcatcatgtgttaacaatgacagcaaaattagaaacaatgactcaccatcaccatcagcaactggcaagaaaggggaggccgtctccataaaaaatggatcattctcaattgggttttctagagaaaaaaaggtgtaggcgattaatgaccatgtgttagtaatgatcaataattagtgttgaaacatgatgacaacttttgcatgatatgtcatattagtgacctagcctgattcaccttctgaatcactagaagaagacgactcctgctcattctcaggtttcctactggagttacctaaaatggaaaagatgagaggaatgagcagattggacaaactgaaatccttgggtaaaggacacaatactagattttcatgcagaacatccatgtatgttagtacagacaggtaaaagcataaaatcaatcttgcacaaatgctgacaaacctacaaatgatgaatagtttaaaataaatgataatgatctgcttgacaggcgacatcacagtttagtagtctttaggagtttttgcacacttacgtaactcaaaagagtccgaacatccttccaagccttccaaataggacttggaggttgcaggagattcttgtatctcatttgtgctccttccagttgtgctatcaagtttcttaagctcacccctgcagtataacacagtaaattcatcaagagtagttaccaaagaaaaggtggaatggataagaacaattggggg

SEQ ID NO: 40013 - DNA, 1295 bp, Oryza sativa
ggccattttaaaatttataaatgtactctgtgtggctgtgccaacatttaaaacatgaggcttatagttcagtctgaccattttaaaagttaacactaagtgcagtcctaatttaacttttcttttacaaaaaagtattccatgtgcgctgcataccaaatgtctaagtataaaatagcgatgtataggaaagtagaggctagcgaaacgagaaaccatatagctgacagtaaaaacttaccggtatgtcttgaaattagccatgcattcggtaatagtactccttggcaggaatggtgtccttttcttcgcataaaagttcatgccaacaaagttcccatccaaatcaataagaggccctccaaccccagcctagaaaaaatatatataaagactgctataagcctaccacaaaataaagcgatactagaaaataattatatacgagaaaaatgcaactttaaggcccaaaagataaagttaagtgcatataatgatatatttaaccactgataccacgccaatatgccataattattcatttccgcaacacatgaaagtaaagagagatcagcagggcaccatggtgatttcacacgtggagatcatgagttctttccgataaactccgcttggatcgtcagtcagcaccccactggtggccattaatttgcctgacttgaagcagcgccccacagcaactaccttactgtgagactcaaattgcagctgatgctcaagatttattgctcggagaccagggaagaacttggtttcaataacagcaatattgtattgcaagtcatacttgtataaccacccatgggcaacttgtttttttggaaggtgtacttcaatctgtaataataaatcaagaaaaaggtttacaaattaatagttatatcgcaacatatgcaagtgatagagatgagataaaatagaagaacttacagacacaaatggcatgatcttgctttcatcatcaaaagatctaatcaggctagctgaagtcaggtaacttgtgccaaataaatcagttttgataactacgcctgtgcatgcagaatgcataatatcccctgcaaaaaatcatgatttccatcattaagagtgatggcttgatacaaactttaaaagccaacgtgcataatcaccatcgaatgaagccagcgagacaacactttcagataagtttgacgctactactttactcagttcactccatgctccttgaccagagttcttcaagctgccaaactcctcttcaaaaatgttatcttcatgcaattttccta

SEQ ID NO: 40014 - DNA, 2345 bp, Oryza sativa
tatgttgattttcaggaggagcttcttagtgaaggcctatgggatttcgatagaatgagccgcccttatattcttcaggaaacactggaggtttgtctttcttgttcctaaaacaatgatctatcttttttttttaacaggaaggaaaacagggcaccagcatgacatttctattctgttataggagaagtttgggtccttttggacagtaattgcagctaactttctaaatgagtacaagaaacaacattacgaggtaatgcaatcagttatattctcttttcatgtttgttgaacgtatcacctacttaaaaccgcatggcatgagtagatttagcttaggctttagtacagaagtctccatttcaaaatcagctacgtgcactccttactgcatttttccattacatttcgtcctctaatttcccttgcaatttattgttttgcacgtgtatagttcaaagaggactgcaatacagagaaaaagataattgcaaagcttaagaacagttctgaaaaatcattatggctggagaaagaagacagcattcggcgtggtttgtttgatctactacaggtaattcatatcgagtgcatataatccatgctacaactttctcttaacctatcctgatccttttcaatccacataaaaatattatttgaaattctcaacaaaatatcattgaaatcattagaaataaaacatactgtttattctgcagaatatagtccttattagagatccagaggacagcacaaaattttatccccgcttcaaccaggaggatacttcaagttttaacgatctagatgaacataggtaatattgattttatttaactccaattgtttccttctctatgttcaggtcggacaagaccttgatctgcacttttgcgttttactctgtaaatttacttcaagctagttaatgctgatgaagtatttactttttagtccaacaggttaacagtgcaggatccttgtgatattgaactttgttacatactgctcctttctgtccaaaatttgcttagttctactgctatcgccttactacatactctaataatcgatatttttcactatgcatctctagtaggcatcaagaaaaatgaaactagtatattcagcagcagtttcttcccaagaaaattatgaagtacagtagcacccaacgttttaggtcttgctaatagcactcccttatttatgcaatgagcactaactaaattgttccttgtggagtacgaactatttcatcctctcatgaaaaacattgttttacagcaaaaatatcctcagaagattgtactatgactattattttgctcgccaagagaatctctggcgtcaaaatgcgctcaagactctgcctgtgcttttgaactcatcggatatgttggcatgtggggaagatcttggccttatccctgcctgtgttcaccctgtatgatgttttcctgcacatgctagtaaacagctattgcttgttctatgcacataaatgacagaaatatattatccaggttatgcaagaacttggattgattggattgcgtatccagagaatgcccagtgaaccaaacttggaatttggtattccatctcagtatagctacatgacggtgcgtttcccttctgtttacttgggttcaatatgttcattgctacagatgcacacatacttaggttgtatatggcaaactaaaaatggtttggagaagctattcagtttgatgttcaattttgtgtcatatttttttcaggtttgtgctccgtcatgtcatgattgctccacattacgtgcttggtgggaagaagatggaggaagaagaagccgtttctaccagactgtaattggtagtgatgacgagccgccatctcgctgcaccccagaagtagcgaactttattgttaagcagcattttgatgctccatcaatgtgggcaatcttcccactacaggtatataggttggcttgttaacttatataaaagatcaatacagaataaagtagattaatgtacttggggtgttctatttgtcaggacctgcttgcacttaaagacaagtacaccacaagaccagcaaaagaggaaacaatcaatgacccaactaacccgaagcattattggagattccgtaagtcaattttccaatattattattttccttgcttcatcaaaattaggtattaagagtaaacaaattcaaaaagagaattggctattcttgacataataataccttcatacgagaaaattcccatacaattaattggcataaagcaatatgttcaccatgaaaaagatatgaggcgatcagatgatgtcacattg

SEQ ID NO: 40015 - DNA, 5787 bp, Oryza sativa
ttcatatgctaaagtgacgtctctcaagtcccatataaaatttgcgcattccctgttgtaaatttggcaacccataattgaaggtgtttgtttttccttgcatctaacttctcccctctatttctttaagggctacatgtgacattggattcgctgttggacgataaggacatccaagcaaccatcaaggaacttgtcacaagtagtgggaggtcatttcctggtaaggtggatggcgccgaagaaagcggagagaagctagctaaagtccagttgaatggtaaaccatagaaaattatcccaagaacagccgaagggtatcacggtcaaaagtaaatagaataaggcagcgtactgccaattggcatgccagttcagctggtgttgtttcagctagaattttttttacgccaacttaattccatttaacactggaaataattagtatcattcatcaagtcggcatgtggaataatttatcccctgttctttgctaataaaatctttttctgatgaatcatctgtttgctagtactgaatatctctacctgtgtctactttggtgtttaattcaatctgatttctgccgacgagaaaacttgcttctcttcctgaaccaaaaccctttctttctcggtttcttttggtaatgagcaaaagaatctcaagagaaagaaaaacaatcatgttgcttttgtagttttggttgtaccagatgccaattaatattacattagtagctggcaagctgccctgctcctcaatgtggtcctagatgtgaaggttagcttgggttagggcactctattatattcagcctctgctctcagcttctcaggctcactgaacacttctctctgaaatctgaaaagtttctaacctctgtttgctaattttaaagcaacaatgagaaggctgcaatgaaattcagaaatggacatgctcttgtgccttctggctcagatcacaactggccttctttctgcttactttgtccgaggtgtataattagaaatagctactactttcgtccctaaaagattttattttttagcctatcttatacggggcttttaactatttgccacttttagatttggcaaataactatttgccacccccatctcaatgtcatgtgggtccacatgtgtctatgacatgtaggtccagtgacaaaagttaataagttaattgccacatctaaatgtggcaaatggttaaatatctctatcttatacataccaatacagagaagaagaagaagaaaagaagagagactagaatgccttttatttctcaaattccaaggcatttatttcctactttttcaaactcaaatacattaattgctttaaaaataaagtctctttgaagtctttgtgaaggtaacatttgttatcggtgatagtaatggaaattgatatggtgtcagcaaacattaggcaaattagtgctgaattttgcaagctcagaaagcttgatgctgctcttttctaccacaagcagtgataatgctcacatgtgtgaatcacaaactttatttctgaaaagctcagaaaggacctcaacagctacctctactaggctcattgctggccactaatttagaaagagaaaaaaaagagaaaacaaaaagattctgattgataaaaaaaacccttcccttttctggacaagcaaccactttacaacctcacttagcctttaattaggtcgctttccacaccaaacccagatctgagcaaggattacagtaaaccctagtggtaatttgatagtactatttgcttaattagttagttactgcagttactgaaaaatctttgaccacaggagtttccagtcaacctagtagcttaactaccaggcagcaacgcactaatcaatcagtaaatcactacgtgattaattagtgcatttggcgaggcttccactaaaaaaaaagcaagtctttttcgccatttaatcagcagatggacatggaaagcgagtttcaccttgttgtgtgttggcaccccactacctcacgaagaattcttttttggaaaaataaatcagtttcaattgtcctttttttttgtgatttgtacatttaattatttttttttctaaaaaaacaattcgaggagtataatattcatcagtgaagaatgcacaaattgtttcaactcgagatatagagctgaatatttgacttgaattcgaaattgattggaacgctctaccgaatttcagatagaacaacaaatgttgaaaaattcaatggctgtacaaggaaatataattcgaaaaagaaaaaaaaagaaaaaaacccatacgttttgtgagtttgtgttcatcgatcacaagctcgtcgtcgtcgtcttcttcgtcgagctcgcgttcatggatacccggaggcgaggcaatcctcccagaacttgcggtcctcctcctgcctcgccgccgcgcgcttcgggtcctcctcctcctcctcctctcgccgccgccgcagctcgcgctcgccgccgcgggcagccgccgccgccgccgctagctgcgcccaccagacgccaccctcggcgacgatggcctcctcgccgccgacttcgtcgccgtcgtggcacccgtctccttctacgcagctgctgcatccgtcgtcgtcgtcgtcgtcgtcgtccatctccacgtcgccgccggccgtcggcgcagggcggcacgtgtacgggcacgactcggcgacgctctcgctgtcgctgtcgtcgtcgccgaggacgacgacggcgccggcgcggggtggcggcgggagcgcgaactgcggcggcggcggcggcgggtgtacggtggccatcgtcggcggtggaggagagcagacgggtcgcaatggaagcagttgatatttatagctgaacacctcgcatgcacaactagtagaaatgagtacactatttttacatagaatttgagatcaatttgaaatttgttcatatttctgcctgctgctccaatgctgctactcttttagagctgataaattatgctttggttggttgagttatgacgagtgatagactcagaataaaaattattgagatccaatacatacttaattaccttatttataatataatataaattaactagtatcgaataatttactcggagttatgcgaccctcgtaactactccctccattctaaaatataaggcacaatcacccttaatccaaagaccaagaaataattattatcgtcttgtagtgtgtatcatcctcataaatataatgcatgcatccaatagaattagataatatgagagtggatgatttaaaaaagttataatttaataaagaagatgtcatagttaattgcatgcttacatgcatgccttatactatagaacatttaagaaaagtggttgtgccttatattatggaatgtagggagtactatgcacgaacgccactggctatgaccgataagaaaaacacgtgtaaaaattttaccaataaattatattttctcttataaacaactaagtgaaactacgaggcaaaagtgatttaaaaagctaatgttgtaaataaactataatagaacatctataataacctctagaatggaaaattttaaagttcggatgcggcagataagccaacaaatcatcgataagattataatttgtttttcttcatgcaaatacaaagaagacataaaacgagatgtgaatacgttcgtttaacacattccaatttcactgtaacattttactgctgttaataaagtcatatttttttccttaacttacatatgattactccatatattatcatccagtaattaactaatcgaatcggcaacattcacgcggaaattaatttaaccagtttcatgcctaaaattattgccaagtgcagagcactacgagtccaccattttctagaaacacctcgtttgaccggtattaaggactgctaatttccgaccgagtcttgaatcacctgaaaaaagtcatgccaacgtagtacatattgtacgaccaaatacggctcaatttcggtcaaaaactaaaaattaaggttatttcttttcagattatttgtcatactattaaaacagacagattactcgtttttcgattcgaaaaacacattttcttaagaaattgttcttcaactggattgttattaccatttatttcaagttatatgtttagtttattaatgaaaatatttaatttgtctttgtaactaagtgtataatataatccgtagtactccctccatttatttttacttttgatagttatatttcatcttgtcatacagaccaaggataagtaattctacatatcatccatttaaatatactactagtcattcctcgtaaaaaaacgattcattaatatttacatttctcgatgcccatatagtcaatcttgtgtgcaagaatgaataatcacgcattaaattcgagaaaatcattaagatgataggttgttggtttgaaatatgcctataaaaataatttttccagatttagaaatatagctgtagggagtatcactcaataatctgtttgatactgagtcagatcaagtcatggattagtcgtttctttgagagaatttagtttcaaatgcatatatatgtaattaattagcaggagcagatcgacgcgggggagattaggtggatggaattatggagcagatcatgaacgcatcagtcctggtgggtttctagaaggaacaagttgcattgaggaacacgcggcctttgctgtctgctgctagctttagccgttctagaagctttgaccttggcctctcacccctcttctagaagccaaaatgacgtccattaaaatttcttttcaactttttggctccatgtggttaattggctacagttcaaactcttctccctctaggctagtagtactactagagcgacttcaatcgagatagtacaattttgaagctcctaaaaaaatcccatttaaattatataaatttttaagctcctcgagaaaaaactctcgtttaaattctagtctcgttcctttcttacgaagaagaaaattttacgtcggtttccattatcacgttcttcaaactactaaacaacatgatttgtgcaaaaactttctatacgagagttgctttaaatatcaaatatatcatttttaagtttgtaataattaaaacttaattaatcatgcgctaataactttcttgttttgtgtgcccgtgttttaatatgaatttatctcatatttcttagcacactctaaccgatcctctatttttttttacttctcaccattttgttatattccaactttatcagtggtacattttaaaaatgtgaagacaaacaagtatggagaaaaggatgagagccaatcctacagtcgaggagtggtgaaggaaaattttcacgctgtcacgtcaaatatttagacacatggatgaagtattaaatatagaaaaaaccaattacacatattgcgtgtaaattgtgagacggatcttttaagcctaattacgtcatgatttgataatatagtgctccagtaaatatttgctaatgacggattaattaggcttaataaattcgtctcgcagttttctggcggaatctgtaatttttttattagactacgtttaatactttaaatgtatgtccgtatatccgatgtaacaaccaaaccaaatttttttcaaacaaggccttattgggcaaatggttatggaagaggaaaaaaaacttgaaaatttggttgaagtccgctgggctgcaggaat

SEQ ID NO: 40016 - DNA, 1696 bp, Oryza sativa
ctttcctataaaccggtggacccaacattttaaatcattagattattaattttcaccattaaatcttatcttccaaaaaaaatctgtacgttcccccactccgatcataagttcacgtaatacattttaaaacgaaaaaaaatgtgcacatgtatgtacgtactccctctctccccctctaaccctccccttccatatttcctatttttttggctaacaccaaatacgtgtagtataaaaattaattagatagctaataatctcttggtacatatgtttctatataaaaattataatacgtcacttggatgtatatacccttaattttcaggggtgaactcagaaaaaaaaatcgggacatcacttggatattatcagggacactacacatacaaattatttaattactgagtgatatgttaattaatatgacatgaattatctattattatatactaaaaatccattagatatcctacaaattctctcaagctaccacgtggcttcccataaacgttcctaatcaccacatgacgccctaatatatctttatataaaaaattttgagataaaaacatcttactcaaaccggtggaccttattttaaaatgttagatctatatcttaaaaataaaacctaccgatcgatcaggccgtcaaaatccatatgtacaatgcacatatccacttccctcctcacggatgagacgaacccactggctttcgcctcttttttcttccttacggcaattaagttaaccactgaataaaagaaaatcctaaaaaaaatttaataaaaatggtgggctcattactttataccattagacatctaacaaattctactaacttaattatatctctcaacatgtatacgaggtctatttacctatataaatatgtaaagctaaatcaatctacaaacgtacaaataaatccgtaaatccatctatgaatgaagctctttttaattactatgtctgtcctataatgaatcctaaaattttataggaattaaggaagaatgaaaaaatatactaagattcccctctctaaataagtatgtgaagagttagaagatggttagagtactgttggataaaaaatgaataatggatggttggatgggatgagtagtattaaaatcggataaaatttgaatcctttaatttatggatggaggtagtagaagcaaatagaagtatgtgattatgtctttaattagataaagaagtcatattaccatatttttaataggaaatttcttaaattaatatatcctaaaatctataaatgcatctttagtatacaagaaaaagtattacttaaaagtttaaattaagatgctaattttttttaaaaaaagaaacacatatagtataaatgatagtttcatatgaaccgtatccattgttgcgatatttttttctcataaatttaagatgacatgattcatgtaattttagtttacaatttgtaacaatccgttctctagaacaacacatcacagcctatttaaccggcactcccacttacatatatcaccccacttacactttcgttgtcgcttcatgtaaaatagtcaacacgaaaatgatatggttagagggacaatgccttacaagttagttgcactctttcttaactagcaagatggtactactgaagtgcacacaacacaaatcacatcctttaa

SEQ ID NO: 40017 - DNA, 4706 bp, Oryza sativa
cagggtgaagacgcctcgccgtgtcacttctctgaatcttacaaatcgaggtttagtagggaagatttctccttcacttggaaacctcacatttctgaagtttctgctcctgccaacaaactcgttaactggagagattccttcatcctttggttacctgcatcgcctccaattcctctacttgagtaacaacacattgcaaggaatgatacctgatctgacaaattgttccaacctgaaggcgatatggctggatagtaatgatctagttggacagatacctaatattctccctcctcatcttcaacaattgcagctttacaacaataacctcaccggaaccattccttcttatcttgccaatatcacatctctgaaagaacttatctttgtttccaaccaaattgagggaaacatcccaaatgagtttgccaagttgccgaatctgaaggtcctgtatgccggtgcgaacaaattagaaggtaagtttccacaagccatcttaaacatttctactctcaccggtcttagcctcgcttataataatcttagtggtgagttaccatcaaatctcttcacatatctaccaaatctccaagatcttggtttagccgcgaacctctttcaaggacatatcccaaattcacttgcaaatgcttccaaactatatatgttggatatagcactgaattatttcactggaatcatacctacctccattggcaaacttaccgaactatcatggttaaatcttgagcaccaccgactccaagctcgtagcaagcaagattgggagtttatgacaagcttagccaactgcagtgagctgaacattttctcgatgaaggacaatcttctggaaggccatgtgccaagttcattaggcaacctttctgttcaacttcaacatctgctcttgggaacaaataaattatcaggagattttccttttggcatagcaaaccttcctggcctaacgatgttaggattggaagataacaaatttaccggcattgttcctgaatggcttggatctctacaaaatttacagggaatagagttggcaaacaactttttcacaggacttattccatcatccctagcaaacatatctatgttggaagaactctttctagaatccaaccagttatatggatatataccctctagtttgggaaaactcaacgttcttagtgtattgagtatgtccaacaatagtctacatggcagcataccagaggagatattcagaattccaaccataaggaagattagtttatctttcaataatttagatgcaccccttcatgatgacattggcaacgcaaaacaactcacatatctgcagctttcgtcaaataatataaccgggtatattcctagcactttgggtaattgtgaaagtttggaagacatcgaattggaccataatgttttcagtggaagcatccctacaactctgggcaacataaagactctaaaagttctcaaattatctaacaacaacctgactggatcgataccggcttctcttggaaacctacaacttcttgagcaactagatttatcattcaataatcttaagggtgaggtcccaaccaaaggcatcttcaagaatgcaactgctatgcgggttgatggaaatgaaggactttgtggggggtcactggagctacacctactcacctgttctaacaagcctttggattcagttaagcataaacaatctattttgctgaaagtagtactcccaatgaccatcatggtgtcacttgttgctgcgatctctattatgtggttctgtaagagaaaacataagagacagtctatctcttcaccctcatttggtaggaaatttcccaaagtttcttatcatgatcttgtcagagcaactgaggggttctccacatccaatctaagtggcagaggaagatatggctctgtatatcaagggaaattatttgaagggagaaatgtggttgcagtgaaagtcttcaatcttgaaactaggggagcaggaaagagcttcatcgcagaatgtaatgccctgaaaaatgtacgacatcgcaatctagtcactatccttactgcatgctccagtattgattcagctggaaatgatttcaaagccctagtctatgaatttatgccacaaggggacttgcataatttactatactcaactcgagatggtgatggatcttcaaatctgcgcaatgtttcacttgctcaaaggtaagcattgcagtggatgtgtcagatgcattggcatacttgcatcataaccaccaaggaaccattgttcacagtgatataaaacctagccacatccttctaaatgatgacatgacggctcatgttggagactttggactagcaaggttcaaatctgattctgccacatcatcttttgtcaactcaaattcgacctcttctattgcaataaagggaactataggatatgttgctccacgtattgtgaattatgcattgacatttcttgctattcgactgacacattgcaattttttcatattcatgtgagcatgtgaattagtgggaactaaactcttcctttcttgatctactcaatgtgctgaggatggtcaagtttcaactagcccggatgtttacagcttccgaattgttctactaaatatattcattctaaagaacccgacggatgacatgtttaaggacggactgagcattgtaaagtatacagagatcaacttgcctgagatgttgcagattgttgatcctcagctgctgcaggagttgcacatttggcacgaaaccccaacggatgttgagaagaatgaagtcaattgcctgctttctgtgctaaatattggacttaattgcaccaggttggtcccaagcgagcgcatgagcatgcaggaggtggcctccaagctgcatggaatcagggatgaatatctgagaggagactgaagattgaagaaacagatcactgatgattccatctgagattgaagaaacagatcactgatggatacgaggggaaaattatctgagatcagtactttttccctggataatttgtgaacgaactataatggcatgatttttgtaccatcataaatgtagttgatgcatggagtaccggcatcacatgccactgatgcatccggtacataatttactgtgttccaaatgtttctgtaatgatatcagttcttgttaatacagtgttccatctgctatgtcaagaaaacggaaactaatattgttgcttatcaaattatgctaatgaaataactcgcatgacaaaatactgaagtgtaaaacaattgccttctcatattttattttgatcaggtacatggcatttaggggacatcaagaaagatcaacaccaggattgaagtcgaagtctcagggggagtacaaaggtgagcaaagaatagacagtatcataaaacatctgggagcacatatcacggttttgtaagctaaaaacaatacaaggctacacaatgatgttcatgtaggataatctctactgcctgtcattccaactcaaacaaattgacaacaactgacaactcatgaaaattgggagtagcaaaaattgagttcggatgggcctttgtaataatttgatatacgtgtgacgtcttcgtcacagctcagttaactgctgcctcccttctgtttgagggtgatcttgtcgcctaagctgagggcgattccttgggtcttactccgtattctgatatagccactcagcttgccatcggcttgcttttcaacgctgatgttcaccaatgcatcctcaccaaaaacactcttggcatagagattagcagcgataaacccacattctccatcaagcgcagatctgatgttatcatatacaagtataatagggtcagcggtattagcaaccaagcagcagtggcattagacatgctatgaagaacccagctttgatgttggaaaaatgtaaatatgacactcagataaataaattggtgagggaaaaagaacatgattcaaccaattcactccatcaagacaaaagaggggttcttgcagtgagattattctgtttagctacaccaaactaaccaaccatgtacttactacaagccatgtacagatattttgaccatttgggttgttctagtttctgatatcctataaaggtgtctcaaaagaatagctgctaataaaatgattaaaaatagattcagcatatttgatttattacgcgtgcaatgttggtttggtaggatggaaactaaatcacgtgtctagtttgtgagaccctacgcccagttctcaatagcaaaacaggtccacaaccatcccattctagtatataaaccaaagcacctggtatatctttattaagtaactaggaaataatgcagaagctactcttggcccaagttgaccagccttatatgcttaatgtacagcgcaagtgcacaccattactctagtttatctggcacatgcataagagaaaagtgggcgactttccaattaacagttgtgtatgtacaaggctgtacccatggagacaaatgcagtatatcaaagaagaaataaccctaactgcctgttaatgtggaagaatagtttcattgtaacttacggtggtgttagacacttcatatttgtcgatttgatgatatgatccaaaaattccttctcatcctgaatgggggtgcagg

SEQ ID NO: 40018 - DNA, 5546 bp, Oryza sativa
taacccaccaccagtcccccacaatgttacctcttcataacacaaatagtgaattacaattttggtgttcacaagctaataacagaagtaaaagaatatgttaataaagaggagccagacaaaaagatcacagtgaagaagaaaatctagcagctgcaaataatacatgaaagaatcttgtaaaacaagcatttgcaaaagctgaagcttgagaaagaaccctaccttgttttcccactcaaattctgcccacatgttccggaaagcaacatcggcacaagtagcaggtgagatataatccatgatgtcaatgtgaatatcgtttaggaccaccactgatcgctccattacatttgaggtctcataaacaatgttaccgaatataactcccgtctctgttgatgaaaccttgatgttggcccgaatttgcttgcttgactcaggagccagcgtgtaattctgggggcggtcaacaagtttgagatcacccattgttgctaactccaagcacaagttctgaagtgtttcctttgttcggtttatgactgtaacatcaagcacaatatcatagtggtgaacagttacatatgcttcagcatacacaggatcactgaaccctgttagttgaagaatgcgattcagtctgtttgcgtcatctgcatcttttgtaaattcaccagtagcagccttcaaatcatcttggactgcatcttccaactcaagttggctcattccctgcaagaatgaatggcatgttttagtgaagaaagaaccgcaggccatcttttcaaatactagacaggaaaaaacagtaacatagtaacacgtcagtccatgtgttaccatattaaacaataacattaaatctctactgtacaaacaaaatgttccatgcccatttctgtcagaatagtctacacaagcctatccaaatattcttacagagaatcaagttttctgcttaattattacctttaaattttaaaagcatgcagaatatttggataatttgattcctgaaccagaataataacaaatccaacagaacacttatgtagccatcaattgaagtatttaactatccatgttaatacttactagtactacaagacatattcagtttataatttgatggggcatgggagtattgggaccattcactgaaacacaaaacagagaaggaaaatgatattgtctatcgggtataatattcgtggaacaataaagtaaacacccacacagaacctgttaatgacatctgacatctggttaagtaaaatctaattgagacaggagaaggatattgataggcctttttcttttgaatgtttagaagttacttgtagcagtacactcgattgtacacaattgttcaaattctatgtctagcactcaccaataggaaatgcttcatttcaacctgaacactagacttaatcattctttcatttgttaaggatatgcaacatcaacagatgaccgataattggcattatcaatgcacgtgtcattatgtggtttgattaagctttggatgtttgtaaacagctgatacccactattagccaatacatatggatgatgtggattctataaagcaaacagtgaaataagcttaccctccggctcttcaggtggtagaaatcaatgagatcatcaggctgggcatgagagatctgcgccttggccttcatctcctcagtctctcggaattgtttttcagcaagcatctttgtaaagctctggcggcatgactgcaaccagaccttcctcacatcatcaccagtattgcaaagcaacctcacacagagcacaatcctatcatatgagtcattgtcaatagggtggggaaggtacgaggactgccccaactgcagtatggacaccatgatcagcaaggccccagtagaagccttgtttgcttcagcctttgatggctggacctcctccagcctcagcacaagcttggtgagggtacaggcaacaacagcagctaaaaagaaatcaccagacagaatgagagatctgagattctgtgtggaactcagtgaccctggagcaacagctggagacgaaatggcagtctctgtggcagcactctgtgtggcataagtaccatctgcaagaacaacaggcctcctagaagatactgtgacagagttcaccacaggctgggctggctttgacgcatcagttgattctccttcctcagagacagtgtagaatggcagatcaccaaggcactgcttgatggtggaaatggcactctcaacctcagatagtgaaagggagtactccccaaggatccagagagcacatgagcagacacgggatgcacggatctgataaaatgtatcaatcagcctctgaatcattgacacacggagcttggggttggtctcaatgatctcgcgcacaaacaaaacaacatcaaccgctgcagcaacattagtgtcaccaaggaagtccatgaggaggtggaccaccgatccagccacctctgggtactcgacagcgcaggaatggatcgcctgcaccagcatctgccggtactcaccacccttctcgagatccccggcctgtgtcttaacaacctccttcttgaggtacatcaccacctcctccacatttcggggggtaagcagatcaagcaccaaatcaagcaccttcctcctgacatccacattggggctagatagcgcacgcagcacatccatgaccacatccaccatgacatcacggtgcgaggcacgcagctcgtgcaggcggtcaaggacaataagcttcacattgttgtcgctctgcgacgacagcagctggcagtaggtgttggcagcagcacgcacggcagtgggcgccgacgacagcgacacgagcgcgccggcggactcgtacacgacggcactgttgggcgcggagaggagggagatgataatcttgatataccttcccttgtcagcgcggttgggcgagcggcagaccttgcggatgagatcgacggcagccatctggaggagatcaggccactcggcgacgcgctcggcgttggtgagcaggtacgcgacggcgcgctcctgcgcgcaggcgcagagcatgaggaacccgttccggcgcgcggacgcgtcctgctccccggtgagcgcgcgctcgacgacctcgggcgcgtcggggaggagctggtcgccgtgcgggaggcggtagatggcggagatcgcggagagcgcgtgcctgcggatgaagtggtggcggtggtcgaggttggcgaggatggacgggatgagcggctcgagcagctcgggctcgttgaggcggcagaggaagcgcagcgtgaccccgcggatgtactcgttggggtgctggaggttgttgcggaggttctggcagatgaggatcatctccgggagtaccttgccggaggcgacgtcgcgcttgtcgacgatctcgaggtagaggaggaggagcttctggatggtgtggtcctcggaggggaggacgtagcggacgacggtgatgaagaggtgggggagggtctcgccgttgaggagcagcatgatggcgcgcttcatggcgtcgaccttggcggcgacgtcgctgccctcgaggtcggccttgatctcgttggccatggagggggagcccttgtcgaagtggaccaggagggtgcatggcttctccatggccgccgacgccgccgctgcacggccgccggtggggggtggatctgggggagtggtcggtggatctgggctctgtgcggggatcggatctgggggggagaagcctctctatgcctatgcggcacggggaagacgaagacgaagaagagaaaaaaagagtgggctgttcggtgcggtgcgggggggcacccaccggtagacgcgctctctctcttcttgggccgaatgaaaaaggccgatatattttggcccattaaaacaaacggccttctgcagcctggtctttcggactattacgccatacgaacaacgggccggatgcaatcgggtaagggtaaggttgtcattatccagaggaataagttcatctaaggtcccttaacttgttaacgaatccaattttcatccttcaaagaatccaattttcgtccttcaaaaccagatacaacgggtccctcaactgtcaaaaccagtgcagatgagatcactcggtggtttggacagcggttttggctgacgtggctaatttgactttggtcttcatctaatgtggcattgacatgtcgattacgtggtaatttgattcgaaaaaataataaacctcatgggacccacatattagcttcaaaaaaaatatataaatggtggggcccacgtaagccccatgtgtcattctcaaccctcctcttcttcctcctctctcccccctctcttcaacagttcatctctctcccctcttctctcacttcctcctatctctctctttctcacttttctccttgttttcaaaaatgacagggcgaggcaggaaagaacgggcagcgagccaggcgtaggcgggcaccacggcggtgggcgcggaggaggggggtcctagtcggcgcgtacgcgtcagggacgcacgtttttttccacacttaaggcagttaactaatctagttagagataatgacggtagtagttaggattttctttttttcgtgagattttttaactaacaaattgaaaatgaaatttatatctgtagtcaaatttttcaaaattttaaacccaaatttgaaaactttcaactcgaaaattgaattttttaagtcaaaatttgaaaactttcaacttttcatcttaaatttgaaaaactttcaacttagatttaaaaactttcaactcagattttgaaaacttttaacccagatttgaaaaatttcaactcaagattcgaaaactttcaagttcaaatttgaaaacttttaacttgagatttaaaaatttttaactcgacattaaaaactttcaactcgagatttgaaaactttcaagtccaaatttaacaatttttaagttcaaattaaaaaattactagtaaactaatcactagtaaaaataggaaactaatcactactaaaactaattacaattttttctcctacccatacggcatcaaactgcgagaaaaaaaaaaagaaaacgacgataggttagcgaaaaaaattgcgcgcgcgccctacgtgggccatgtggaccgggagtgcgcgctgccggcgcgcgaacaaattaggattctggcggaggaggcggagccgggcgccgcggtaatggacgcgaaggtggaggcaagcgctgtggcaaccgtcaacgagcttcttggcggtgacagataggctaataggcatcggaggagcgggaggacctctggatcgaagccgaagccatggaaggccgcaccgagaacgactccgccacctacgccgactctggcaagtggcaaactggcaacccctgcctcgacttcttcttccatgtcgcagtcatccatggagctcgcggtcagagcaaccgccgcggcctcctgctcctacggcaccgcacctc

SEQ ID NO: 40019 - DNA, 1971 bp, Oryza sativa
catctaggttctaggaggttgttacatgcacaattttattggatcaaactactgaccgcaccatcccacgttccgattctggctccatctctctactacttaaaaaatccgtagtggtggtattgattcctgacatagcagacgcgtctgacagacacgcgtaatctcaaccatccaattgccatatccaacggcgtcaatcgtccatctcctatccatcacgcgatcactcctctccccatcacgcgctcgctcctctctcggatcgatctcctccccacgcccactcctccttcccccacgccgcgtccttcgctctcctccctgtgtcgcctccttgccccgccgtctcgtcgcctcctcaccagccatgcccgccggcctcctctccagacctgcaatcgccgccgccctctccaatctcctccgcgcctccacctcgcatcggattgatcctccaccttcgccctcctccctgcgtcgcctcctcacctcgccgccgcatcgcctcctcagcagccacggccgccggcctactctccagacgctccctcgctgccgccctcgcaaatctcctccgcgcgctctcatccctcccctaaccatcaccggccgcctccccttccaacctcccctagccatccgcccgtcgccccctgcccaccgaagacggatttcaggtaatgtgcctcaaaccctttcaggtaatgtgcctaaagctttacgaagcccgccggccgccggtctgattatctcgatgggcgtactgaaaattctgaattagttgtcttggatgtgtagttagcgttagtgaggtggaggctttgttcgagctgttcaagagcattaatggttctgtgatcgacgatgggcttatcaataaggtgatcatctaactgtagcttgttgtggaattacaaaattaaaccttgccacattcgaatgtatatctccacatagaaaattaaagcttgtggtggatgcctttttctgtgaatcgttttgctatgcgggcaattctattcattcatatttgaagtgagcatggatctgtgtattatgtgtttgccttctaaattgtttaactttctgtgtaccaatatatgattttttttcctcaaagtttaataggaagatcttgttcccgatataaaccatctggctggacagatactatcacaatataacaacacaatgatagctcaaagtttgagtcactttcttcctgcaatgttgttccttttataagggagttaaacagtttagaagaatatgggtcagaattatgttattattgatctgtttctgttgtttgctattgtaccacctatgcatgattaagtaccatcctattctgttaatgtacagtcaattgtgtattttttatgtaacaattgagtccatgtacttgtgagaaagataattttctggttgaaattgatggctgagtgtacataacatgcctcactgccagtggctactatttcagcgaaaaatagagcattttaagaaagaaaatgcagatgcaacacttttgtagtctagattagagtaaaatctacatgcatgcatgcaccttttgtagttatttgcaagttaatgtgtcggggttagattttacctgcgatttgtgtaaatgaatgtcggttcatcacttcatctttaagaaacatatgctgtcccggggaaagatgaaatggaaatattgtggtctactgttcagtttggataaaaatatggtggtctactgttcagtttggataaaaatatggtggtctactgtttagtttgaaaaaaaaatgttcttttcataatttattattgaaacctactgatattataaaggggcaattgcaaatttacccctattataaattgtacaaaaagctgattctgacatctaccttttgaattattattggtcattctgaatataggagtagatcttctgaattccaagagggatctttg

SEQ ID NO: 40020 - DNA, 3890 bp, Oryza sativa
tcataacaatttattcttggtaagtattaaggctggcccaatcagatcagtttattcttgattccatgttaacaagctggcccaattaaccattgatcaatattttttttggaagataaacttcatttaataatgccatgaattggagaaggatgagaaaacaaattactagacaatattcagtggtattatttgggatgaaatgttttaggctaatatatttttatttacattccccttttctaccctctaagtaaataactgaaaatagacgtcttagcttcttttcgattctcagaaatttcgctaatttgagcaagttcagcagatcgccatgcataaccccgcagatcagagatctcatgtgtccatatcctgttgtttccggtcgacatccttggttcatcattacctcaattgaaggtaaaagcagtttcttctctcttttttccctgttttccttgagtggttgatatgagaagataatatttttcctgttttttttttgcatgtgctggaatttagaataaaaacaattgctctcgttcatcacaaatctttatctattaagatatcatggttcagaatttatcgtggtttggttgttagaggggtttcagactgttactccgttagccattctaacgggatagaagcactacaatgttgtgtagttgcctggagaacatgacctaaaattgataaaatgatgacaaaatgaaggacatttcctttatccagaccatcatccctttatctgaataactctggtttttttaatttttttaatccattcttgacatttggtatggtttgtggagttgttcagataacagctcaaatctggactctgctcttcttttttttaaaaaaaaaaatgtaataagtttgaagttctgatgttatatccccaatccatgcatgctgtgttgctttcatcactaggcatcctagcatcatggattgagtaactacaattttggttgcggcaagtatttctgaaataacctattaccctgaatagggtttatctgtacaatttagttaggtagcaaagatacagaatgcaatctactactactaacttgaaggcctgcacttcttaacctctacatttttggatctgcaaatcttgcactaatttgcctaaggacactcaaacaacattataatttgctgcacaacaccatggacattaaatttgaatactattataagaatggtatcttgaatattttgtagtattgaaaaccacattctgaacattagttcaagttcagaaatccgcattcttgcaatgtatcttacctatttcagtacatgcaccatgtgtttttttcttcattttctgcagtacagtctactcatctactttgctggtagcttttgcatgtcattatccccacatcatgatgtatgattttcagttttaggtgccagttttggtgtgaagaactaaattgaaaccgaacaatgattttccacagttgcggttaacttctaaacaagttagttctgcaatggataacaatggtggcggttcagcaccaatatcgtccaaaagatcatgtcattgtttcatccatccagccatggtaatatccattgctcaattgatatatttttgcttcctaattttacgtacactcttcctttaggtctttttgtggatataactaatgtgattaatgccaagttgacaaataagcatgccgcggttatccaaagtgaaatcaatgttccaaaagaccgtgagaactatcaacagatcaacaagaactctacatctaagattcagagagcctcaactattggatttggtatcatacttatattggctttcttttttttttaatatatgagatatttgttttaggctaacatcagcattctgattttgtggtgcaggcaatgaaaataacgcttctgtcattaggcatgtgcggctaccatgtacagacaaagccgaattgtcgtacggtacacccaacatgcatgaagatgttactaatctcagtacggctgaactaaaaaggaagcgtgctagagagaggtacgcatcattgacaaaagagctaaaggaagatggaaacaagaagagacgtgattccagaaagcggaggaaggatgaatcaataggtttttataaattaacacatctattgttatcaaaatttggactttttgaacacaacaccttattattattgaattaattcaactctttcagatcattgatctcaagattccacgaccaaaatggctactcctgtgtcctcaactgtttcaggttgatgtgtaatatggtaacatgtagaaatttgttaggtgtttcgtaccaaatacgttctaatctgtttggatatgagcagccccgcttggagatattacaaatgtacgtgctgacagattgcttctgatagtttaacaaattttcactcaatttcttttcacttaataaaattacccgttgcaatgcacgggcaccttactagttttctacgaaaacagaactgaaaaactaagctatatgaccggttctgaaacaaccaagtcgtttttttgactaactcactggggggagagattccccacctgaattgtcatttcataatagggagaatatagttctgttacactagattgagagattgaagacaggaggagaaaatttgtttccacacatctattacagttctatcctgcaccactagcaattctgcccaaagacctgcttcgctaacagcacgataaagggaagcagctaaagaaggttgaagccctctgaaaaccacatcatgcctgtgattccacagcacccagaagcaaagtaggtagaatacatggaagtgtttggccggcagaagctgcgatggacttagccgataaaaaagtcgaaggtcttggattgagggatgaattccaatacttagtccagaaccttacagcaaaaggacaagagaagcataaatggtttgccgtctcgtccgcacagttgcaaatcgcgcaagttgctgactgaacaatctttttcttcaatagatttgactttgtggacagtctatttcggatcagcatccaagcgaaaagttttaccttcaacggtgctttgcatgcccagataatcttccaatttggtgagataaactctgccgggaattttgcctcatatatctgcttggaagtaagaatgccagaacgatcattttgcctgatgtcaggttcctcattcagaaagcaagctgcaagcatattctctaaattatgaagatcagcttgggctgcttgcgatagtcttggtaccaaaaacgataagattcccctgctaagcacttctttgacatttgcatgaccgcttgttgagtgcgagtagagtgccgggaataggtttgcaagttgctgaatacctagccaacggtcatgccagaaagaagtcctcgagccatctgcccatctccaacctttactctcgtcagattttgaagggcaggtaagagtttttgcatagagttccagtgctggcccagaggtaaggttttcatcaaagattgcccatcaaattctctccagatccagtctgcccaagatgattccgcagaatccaaagctaacaaactgaatgaaaaacatgtgacaaatgcgcaagattacatcattttcctcctttgctatacgtgcataggaggccatctgcctacaagaccagccggccggtgttcgagcgggccagagtcccgccgccaccaccgacgcagccactcggactcggccaacggcacgccgtcctccgccatcatcatctctaccgaacccgcgaacgcgccagggagcctcctcctcctcgggctccgtctcggtggctcgtctcctctctccaacgaaccggtagc

SEQ ID NO: 40021 - DNA, 14368 bp, Oryza sativa
ttccctagcatctgcgtggccgccgccggtggtggtggcggcggcgcacacacttcgtttggtcgccggcgagtccctgcggccgtcgtcgaagctcttggggggctcgacggggagcgacacgtactgcagtcgggggctctcgtcgaacgggttgcagagcatgatgccacggtgcaggtcgacccagcacagccgccggtcgccgacggggacgaccatgtcggtttcccacgctgacagctcagcgccctagccgccgctgtcgtcgcggtggatgatcggtgcccgcttgaggctccactcgccggagcggaggaggaggagtttggcctcgttcggcggcatgtcgtcgtcgctccccttggtgatgagctccgccaccacgagctcgtcgtcgccacggcgcaggatgccggtggcacgtacatccatgtctggatttggctcgtcctgctctgtcgcatcgacatagttgtgaggcagcagcgtcaacgacggcggccgcgcggcgtcgccggcgttgtagacgaagtaatcaagtaatcgagcgcgtcgtcggcgttatgctcgtcgtagtattccatcttgatgagcacggagtcgccgtgggcagcggcgacaaacatggaggcatctagatctttttgctccaagtcgaagaacatccgcgacgccgccggtggcggctcgaggcagaacgagacgcggacgcacgggccgccggagaaggtgcaggcgctcgccgccgtcttggggtcgccggtgtagccggcggcggagtgcttcctcaagctcctcacgttgtgacctttgtgctcaagcatcacccaccgcgggtaactgccgccgccggcggtggccatcaacgtcgccggtgattagttgcttgcgccttgcggttggctctagttatcggagttatataaaagatcgtaacagatgaatgtatgtctgtgttttctgttaagatttaacagggtataaataaccgtcacgtttatcgttagagatcctatcgtgtcatcaaaaacactctagcccgaatttactgttaattgtgtcgattttttttttttgtgtgggttgtggaggacttttattttcttttttttatccaatccccaatgaattttattatgaaaactaacgatccaaacacctatttagagcacaaatttgctacatatctatcttgtgattttttaaaaacgattttttcacctttggcttttgccgtacagatttgattttggaccgatcaaatatgttaggttaaatacattgccgttgagtgatttatcatatattaatctattttttgattttttttaacaaaaatcataacccatttgaatgatatgcaaataacgagaggatattccctcgagattagaatccactctcctcactcattcatattgttgccgtcagtttctcaaaaaaaaaaaaaattgttgccgtcaggctataaatggccaaaaggcccgaggcccgatggcccaacccatggcacggcattttggcccggcccaagcacggcacggcccgacggaggtcgagccgtgctagcccggcctgaccaccgagccgtgcctgggcccctccaccggcacgttgggccggcccggcacgatgggccggcagctaggcccaatacacaaaaaataggggagtaaaaatagacatattatattccatggatgaaagaatagggatctaaaatagacttttttttatctatacatatgtcagccgaagaggagggacggaaatagacttattttagctatgcatatgtcagaccaaagaggagggacggaaaatagacttattttagctataaatatgaaatagcccaaagaggagggaagaaaattagacttattttaaaaaaggaacgatgggccacccatgccttcaggccggcatggcacgtcgggccgtgcctgggcgggaggtgcatcccatgggctggcacgaagtgcctatcgggccgtgccggcccgatggcttctgggccgtgcccagccgtgcctgggcagggctgtgccaggcgggccctttggccatctatacatcaggctatccgcaccacattggtttcactgtaaaaaaaaatagcgattgaatgtaattatagtatttctgttggcgtctttttggctaacagtagtagtgaagttcccactccgcgtcggtcggccgccatgaggttttccgaagctttgactacaaggaacttatctatctccttctcaaacttgatcgccgtttttgggagaacaaaaggacaaactttttccatttttttctctctgggccggcttcaaatggccttttcttggcatagataaacactttatgtcctacttccctacaaaatctatttccttatgctcccttctgcattccgtgaaactcatctaatgatttgcggtgttaacggagttaccaatcacctcgatccaaaattagtgtttcgaaaatgttttcaaaagtctccgaaacaaacccatcaatcctttgaagccgacatactcgcatgtaaccacccattgtagttttccccctcccctgggaagacaaaagtaaagttgaaggttagggtttccttcctaatactaaatctttgcttgtggattaggtctagttgcgctaagtttcgctgctacttctctaattatcgattatagagcttgcagtcatgttccgaatatgtgacttccaaaagatatagtttatttattggaatgatgcatctcagtactgccgaaactagtgcttgtgcctatcgacatcgtggttctgtgggagtcggttcacaccgatttcctgtggcgcaccctctccggtgtcattgttaggtggtgctaaggcagggtgtggcaataaacctgatgagtggatcagcttgtgtcttttttctttttttttttgaaaaaaaaattacctgcttgagtttgtagctgacacggcaatatccttgagataacaaaactacaaaaaaatatgtctactagaaattaccatacgttacgtttaactccaggagatatctctcgtgctggcaaaatacattagctagatggtggtatatgccattacagaaaacaataaaaatgcagtgtaatatattccttcgtactaaaatatatggcacctatattttaaataaaaattaaattctaaacctttgatcgatgtacatgtttagtttttcagagaaagaggtaattaaagcctctccgtttccattagagaacaaaactacagagttcaaacgaaacatcaaaagttttacggcgccaggacgttcctctcatctaatttatgctaaaaatgatgccatccccagttcccaccactagcacaaatacaagagcaggcacttaaccacattgcatcgatctaaaggaacaataaaacaaaagcaaatttcatgaaatttaaggagatgaagacatgtagtccagcagcaatttcatgcacacacttttgcccctttttcttgcaaatttagatcaagtacagtcttcataaaactcgagagagatgtttgctcagcacatcagagccttggagttcagcttcagcccccatccatgttgtgggttgggttgtgcatgcggagcagatggaacaagcctggctattcttcacttcaatcagcagccatttcttcctgagacccattggcagcaccaagagagacctgaatcggcgtccactgccatcgttaataagaaggctatacgcctcgagcaaatcgtcacatcccaaatcaggtatctcttcaagagcagccaagatctcctcaggagaagccatctctgacacattggtggacagttcatgtgatttcttactgatgacggcagtcgtcgtcgtcgtcgtcgctgcagctgcaggtagtacgtcgacgacgatggctgccggctttgttgaatcgctgctgcatgaagtgaggaggtaaccggagatctcgctgggaatgcaccgtaaacatggcgaagactgatttttgtaggcaaagactgatggcagcgtcttgttcgtcgtgtcaagcatgatcttccaaaatttctctttcacgcagtaatcgtggtcgtaaaccaggaagcagatgatgtgagagtcgcgtgtactcacgacggggtagtacggtcttttgtgtggtgggatgccggcgtcggcgtggagggagagggaccagagctcggtggcgtcgacgatggcgtccatggtccatgtcatgtcgctcgtcctcagtgtccaggtgttgatgacgaaggcggagctggaatggtcgcaggtggtgacgccggggcctccgcagcagcagcgggggaagatgtcgacgaacttgagcgtgtcgccgccgccgccgccgccgttggtggcgcagacggttcgatctttcatcaggcaaagccgagggttgcggccgcggcgccgccgctctcgtactcgtagtaacggtagccgtagtcgtcgtcgtcgaattcaccggcggggggctcgacgggaagtgacacgtaccgcggccggagaggctcatcgtcgtcgaacatgtcgcagaggatgatgccgcgatacaggtcgacccagcacagccgccggtcgccgacggggacgaccatgtcggtcttccaatggaatagctcgtcgccttgccgtcgtcgtggatgatctccgccggcgtgacgctccactcgccggaacgaaacacgaggagctcggcgtccactccgtcgtcgccctccgtcacggtgagcttcgacaccacaaggtcgttgtcgccgcagcggcggcggcggcggcgcaggaggccggttctagcgtcgtccagccggttcggcgtcctgtcactcaacccgtagtgaacccagtgaattgggagcagcgacaacgatggcgggtcaccggcggcggcatcgccggcgctgtagacgaagtgatagaggccgtactcgccgccgcggcgcgcttcgtttttatagtgcatctggaggagcacggagtcgcggtgggcggcgacgacgcacaccaggggccctcctccttcgtcgtggctcggggaggaggtgtaccacatgcgcgacgacgccgggggcgcctcgcggcacagggagaggcggacgacatggccggcggagttgcggcagctcgcctcggtctcggcgcagctgccgccggcggcggagcaggggttggaggagtcgtcccggtctccctgatcatcgctacctttcttgtgcttgcgtcggacgtcgcgctcgagtaaagcccaccgtgggtcgtagcagccgacgcgtcggagagtcgccggcgtcggttgggtttccatggtcggcggcgatggcggcggcgactggtggaagcttagggtgacacaaaatctgaggccatatataatggacagtaatcttctttaaattgcaaatataacctcgtgtatgacttgcagatcatcaatgaaaaaaaactactaattgctgacttaattacggatcgatattatggggggaaataatctgaataatagggagaaggatcagctggatcgtaagctgatcttgcagaaacagaaatgccctcacaaatagtgtaaacgagctaatcacggatagtccggccgtcaattagtttctctagcttgtcagcaaagatcagctaatcacgttcacagatgaggcccggctcagactcggctttgcggtttacgagtacaagttttttaaaaaaacgacacgacacctataaattagtttgttataatgttggtttatcttaaagaaaatactactccatccgtcctaaaatataagtatttttggattctaacacgatctccgagatgctattttggtcaacgatatataaaagtaagacgttttgaataaaaagagttgcatgttattatagtttgtgtaatgataaatctagctagtaacatcaattttacatggttgatctttttttctttctattaatagtcaaagttaaaactgtttgacttgtcactatgttaaaaatgcttatattttgggacggatggaatatatgtttttatggaggaccagcacatattgatacttatatataaggaaactactctaaactctcgatgggatattctctcgttgtttacatcactcaaatggttatgagaaaaattgaaaaaatatattaatatgcggtatatcactccataaacatgcaagttcaaattaattttttacatattgcaacaaaatgcaaattaaactacagctagtcaaatttgcttttttttctttgcgatatgtaaaagttaaattttaatttgtatttttttggagtgatatatcatatattgatacatcttcttaattttttttcctaaatatttaagtgacatgcaaataacgaggggacattccctcaaaagtttaaaatccagtctccttataggtgccctttttttacctttagccttctatggatgtttggatggatgggaaaagctccatatggattgtttttaaattaatcgggacatatgcgccacatgttatggattagggcatccacaatgtggtgtaaaagtagtacataagcaatataatattccattcagccacctattaccattgtgcaactagtccatatagaaaaaatagcaaaagatacccatatgcatatggactacccatatgaaataaattatattatctatctcctctctcttctcctaatgataccttgtatctgtatacgttatggagattgccataaggataaactatttatgcgggtcccatctatatggatcactttaccatatacattggtgatgcccttagagatttgctcaagtcaaaaaaaaagtatctcaaggtgccggtacctcatggtaccaaatcgtttatgatcattgaaaaaaaaaacctaaagtacccaagcaattgtacaattaagcacaatccgactgttaagcagtaagcacatgtatactatcaataccaaagcaagtttacaacaaagtatttcatgcattttgcaagtctgtcatgcaaccacagcagacagcgcaatcttcgcacgtctgaatttccatcaacaaccaagtcttcctcaggctcatcggaagccccaaaagagatttgaatcggcggccattatcatgacaaagcatgctataagctcttagcaaatcatgacgagacaactccggtatctcttccagggcagcaaagatctcatcaggagaagctactgatcctgacactctgaaatgtttagcaccagatgactcacatgaaattcgcactgaatcaccgatgatggcatcatgtgttggcgccttgtcgatgatcacagctggctctgacatcgctccgccattgctgcagcttccattggaggaagtgaagtagctggagaccttgctaggaaggaaattgcgtccatggctgcaggagatcgctgacaagagtgtcttgctccttgtgtcgaagaggatcatccatgtttctttgatgcggcaatatctcccctcggattctcgctcatccaccatgaagctgatgaggtggggatcgtctatgctcacgatggggtgttctggaatggcgtgtgggaggccggcgtaggcgtgggatgaccagagctcgctggcgtcgaccatggcgtccatggtccaggccatgtcgccgctgccgtcgtctaccctgagtatccaggtcttgatgatgaaggcaccggtagaatggccgcagtaggtcgggccggggcggccgcagcagcagcgggggatgacgtcgatgaacttcagcgcggcgccgccgccggtgacgcagacgcttcgctctgcgatgacgtatttccgcgtgtggtcgtcgtagtcgtcgtcgtcgtcgttggattcatcggtgagggcctcggggggaagtggcacgaaccgcagctgcggattctggtcgaacacgtcgtcgacgtcgcagaggatgatgccgcggtacaggtcggcccagcacatccgccgctcgccgacggggacggccatgtcggtgatccacgacggcagcttctcggctctaccgtcgaagtggacgaccggcgcccgtgtgacggtccactcgccggagcggagaacgaggagctcggcctcctccagctcgtcgccctcctccatcacggcgagatccaccaccaccatgtcgtcttcgccgcggcgcaggaggccggtggtcctttcatccagatcgtggcgcggccgccaggtttcactctcttcttcatccgcgtcggtggtgacgtaggcagggagcagcgacagcgacggcggccgtggcgggtctgggcggcggagccggcgttgtagacgaagtagtcgagcacgccgtcgtcgccgtaccggtatccttctccttggtaactcaaccggacgagccggagtcgccatgggcagccacgacggccaggctggcgccccgccccccgccgatgcgcgggaagaagtcgaagcatacgcgcgacgacgccggtggcgcgtcgaggcagagggagacgaggacgtggtggccgccggaggagaagacggaggccgcctcggtcttggcgtccggtgtggagaagggcgggaaggagtcgtcgcgctcgtagccctggtactcgccgtagcggcagagtatcacccaccgtgggtagccgccggcgccggcgccgccgttgccgccttggtccgccgtccgttgggtttccatgggccgccggtgagaggccggaacaaacgatttgatctgtctcgtaacgtaagcggagagatcggttcctcggtttacgaaaaaaaagaagaaggtgtttgactatatagaagagtttgattatgaaacaaactaatgaatcgtataataggaatccgcctcgttgtacgtactcctacatgtctttcataagagcaatttaaattttctttttatttaggattaaataatttgaattctttccccttgccttaattgacctgttctccggtggccgacggtagagcactctaagaggggaaattgaaattttttttagcaagatagatttatatggaacatatcattagtaagttattctaccaatataagacacgacccgaaaagaaaagagaagcaaagtaaatatattctaaggacgagcataataatttggtcgtgactttgggctgacacaacatggtctaagtcttattgggccataagtgaagcccgtgagcgggcatggctgccaaccgcagccttggtcgtgcttaggctgggtcatgcccaggcggcctatttagtcctctataacctcaacagaccagccaagccaccctcttcccttgttatcctctctttttctctctgacagttcatccaaaacgtcacattccttctatggatttacgctaatctaatataaaaggcaccatttaataaatgaatcattaaatagcaccaattaaaaatgggacaagtgcatgcatgcccttacttcgaaccccaaatgttgttttatcctactttttagggtttacaattttgccccatctttttgaaaacgaacccaccgtttgccctcacttttaaggccgttagttgggtcccacagttttgggttaaaaaatacaaatacaaatagaaaattttcttttctatttgtatttagaactacgggcatatatttagaactgtttttctctcttattcaaccaaaaataaatattttaatgggtacgatatccatgtgcccatgtacatgcttatttgaaaataatttaatttgcataaaaaacaaattctcaaaaatttggttaaatttggaaatttcggttgacataattgcttgctggggggcgaaatttcgaaccgaaattgacaacccttgaatttagacacgaggctatgtccaaatttacgtctaaaagtaaatttattttgggatggggatagtagtagactattagagtactagagtcctcttcttaacaagcagcaatagtacaataattcagaacaatcaaacagctggaaacactagtatttcatacattttgtagctctgctctgcatgcacaccaaacagaacgagcttcactggccttgatttccatcaacagccatggcttcctcagggtcattgggagccctaaaagagatttgaatcgacggccaccattgtcagaacaaagcaagctatacgctctgagcaaatcatcacgagacaactccggtatctattccagtgcagcaaagatctcatcaggggaagccactcctgacactctgatcagatgtttgccaccagcagatgactcggaagaagatcgcaccgactcatcgatgacagtatcatgatcaaccacatgtggctctgatgatgtcgcagcattgctacaataacttggatcatcaaaagtgaagtagctggagatcttgctaggaagagtgagctgtcacaccccaatctggcaccaccgtacaacggcacctgacaggagcgtgtcgtaggaaaacggcgtgaaccgcgtcctacgaaaccgcgatctcagtaccagtcctaggacatagcgctggtacccacggtgacaaacatgaatcattgcaaatccttataattaatagaggacttatttaccttaacttaggttgcagctcagacagcctgagaatgcaaccggcgacacggacaaggcaaacaccaacaacagcagcagcagcagaaccaaccaacggactaacaccaaacgccacaggcaacggcagggaactaggacgaaaccctaatcttcacttcacttcaacttcatctttggagctggcagaactatatttatatagagagcaagggtgagtacttacgtactcagcaagccaggggaacttaggtggttaatgcaagcttcaagggaaggctgttattttgcaaacagttttgttttcaagttttcaacaatctaagtgtgtgctttccacaaccagagcgagacaagtctcagctcggtcgggaggtgagaagtaacaaatttatttatcaagatttgcacaactcctagagttggcttcaaatttggttttcccaaaccaaaccaattttccaaacttcccgataatagtggtccccaaacgaccaatcacttccagggactcccggtcccgctgtcccccggacagctaaatgcttcccaagcattaggtttcccaaaccttaacaccttttcataaaacagggtaaaacaaaaactacgctaaggaatcaactcacatccgcccatgaccatgggcacgactgttcgaacagtttgataacctctgcagagggggtacactttacccacacgacgttactaacctgggtcacccagcctgtgcagaacagccacgtctggcgactttgaggctttcacgacaaggcatttctaaagccgacacagggtttccatatgccaacgagaggggtcccaaaccaacaacaggttaggtcccagaccatacttgtcacgccccgaactagtaccgaccggaactagcccgtgacgctccaaattaacctgttaatcgataccagtcccaggaaacagtgctggtatcacaggaagacggattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagtaggatccgcttcatcttcttcagcaactgggggggattatttatatagagcaagggtgagtacgggagtactcagcaagccatgggaaataagtgtttaatgcaggcttcaaggaaaggctgttatttttgcaattgattttatttgaactcttttctaaaaacaactaagtgagtgcttctcaaacgacacggatgagacagtgcgtctcgtccggtcggagtatgtgcaatgtatcagtctttagaattgttcaagattggcacccggccaacaactttcaaacggccacccgggccaacaactttcaaacggccacctgggcctagctgatcccatcagcagcagatttttcaaacatcgaacccctttcaacaacagcaatctcacaaggcagtagtcaaacaaaactacgctaggaatcacctcacatccgcccatgaccgtgggcacggctgttcgaacagtttgttaacctctgtagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcatacttgtcttatgtttggatgaaattccaaggaaacggtccttaagtgcgagagcgggaaaccgtacacccggtacgtcccccggtccgcggttttggaaattcatttagttcgcaagcaccgacccaggtgtcgggttttccaagtcttttgtaaaacccaagttttacccaagaagtttttcagattttaagtttgaaggcgtccgtcgatactcgcacagggtgcacgaatatcgagacgcaactagatggttacaaggggacacgatataacaattatcaaaggaaggatcaaatgcaacaaattaggtaggtccgccaatctgccttgcagacgggacaacagattaagtgcgatcctatcaatgcataatatttttcaagcaacataactaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggtgaaaataaagccctattaatgacctctaagcgtgccattagatagatctcgagatttgagaaattttggaagttgaacggagtcaaacggatttacggttgggaagatattgaatttctaagattattggatttttggtctaaaggaaaaggatttaattaaatcctttttggaaaagaaaaagaaaagtaaagaaaagagggagggaatatagactttcctcgggcggctagggcgcggcccaagggaaatggagcggaccggccgagctaaatgggccggccggcccaaggcggcccaagacgcgcgcgcgcgggagggaggagagagagaaccggtggaccgggctcaccgtgcgcggtcccgggtgggacccgcttgtcggtgacacggctcaccgtgcggagcgagcacgcggcgtacgcgcgcgggcaggggagggacgcggtgcatgcgcgtggttcgcggtggacgcggatgcggcgggcccacgcgcagcctcacggctcgcggtggaacgcgcgcatggggaggggctgaccggggtcggctcgacccggtcttggccgagctggcgccgacgtggcgcctacgtggctgccacgcgggccggcaggaggtagacgacgacaccggccggaacggacggcggacgacagcggcgagcggtggagcgaaccacggcgatacaggcgaaagcgagcacaccgggtggttgcacgagacgaggggagacgagccaacggctcggattcgccggagggagcttgacggcggcgaatcgcggcggcggcaaccggcggcgggagaagggggaaacggcgacgaggtcacgaggggccaattcccggtggtgagagcatctacgtggctacgggaatccgttgctagcgtcggattgggcggagctacgccgagcgaggccggcgacgagtgggtgctacggagctcgggcggcgacggcggcgagtacacggcgagcgacggcaacggtcggggcggcgccggctagctacggggaggctactcgtgctactacccgagtctaaggggaggagatggaacgaggagggagaacgggaagatgcactaccgtgcgggcaggcgcagtgacgagaggctgacggcgcgggagtaatctctccggcctcgggccggggaagaggaggaagacgagcgcccggagtccccttccgcgtccacgaacgcaccggctcctccgaca

SEQ ID NO: 40022 - DNA, 1981 bp, Oryza sativa
cggcggggcggtttggagcggcgcgacgacacgggcggcaggcgcgggcaggcgcggcagaggctgacggcggcggcgaccaggcggtcggccaccacggcacgcgcgcgcgggaagcaacgggcgacgcggtggttcgagtggcgcggctcgggcacgcgcgctggctcgcggggccgagcggctgcgcggctgcaggcgcggcagggcagcggggccgggcggcgaccacgcagctctcgcgcacgcgcgggcagagcgagggaggggcgctcggcgcggcgcacgcgcatgagcgcgcggcgcgcgggcagagcggaagagggagggggagagagagagagagcgccggggagggaggaggagatgggccgagagagattcggcccatcgaacccgggggaggcaaaatagacttttgcggaggaatttgatttggaaggatttggattcggaattgatctcgacgatagatcggggatttgagatcttgagatggcacggacactagacatcaagcaaagaaacaaattttgcaattagggtttttaagagataattttcccgctaggcgccacgacggaacgggcgctacaatactgtgccaggaagcccgagggttctccccgacaccaccccgttgaatccacatgtctcttggcatcatggttcccctgattagctaataactcagccaggggcgtcccattacacccatgtggtcgcaatgttgtatggtcggatgtaattccgaaggaatcggtccttaaatgcgaccgcacaagtattccacccaggaatggccttgtgtcgcgagtttcatttttaaaactcattttctttcacaaggcaccgactcaggcatcgggttttccaaagcttttgtaaaccaagttttacccaagaagttactcaaattttaagttggaaggcgaccgtcgatactcgcacagagtgcacgaattatcgaggcgcaactagatggttacaagggaacatgatataataatttacaatagaagttcaaatataggctcaatattttcaaaggtggcttgccttgctcagggtcttcacgaagcttcacaaatcttcgagaattccgcttgaagaaaaatatccagtaaccgcaactaggcgcaaacaatcaaaaacctaaaaaaagaccaaataaaatatcctatttaggctaattaatagtgccattagatatatcacaatttaatggaattattggaagtggaacggaggcaatcggacgaacggatcaagggatatgaattttggaagtttaaatgaatttttctgaacaaggagatgatttgtcggaattttctggaatacgggaaatggtttatggaatttatagaaataatattctcaagaatattattgacatccactgacatgcgggctcgaggggacgaattattggaatctccggattaagacattctctagaatatctttgactcattgacacgtggggccagcaaacggtggggaggatagatggacttttgtgtaagagaagtgatttggtggagggaggaaacatagacttcggttcatgggtggctgcaaggaaatggcccatggcctggcgggagagagtgagagaggatatgggccggctggtaggccgagctcacgagcgggagagggaagaggcggctgaccgagtcaagcagggccgggtggctgaggtggtggccacgtggttgtagcgcccgttccgtcgtggcgcctagcgggaaaattatctcttaaaaaccctaattgcgaaatttgtttctttgcttgttgtctagtgtccgtgccatttcagatctcaaatccccgatccatcgtcgagttcaatcccgaatcccaatccttcccaaatcaattcctccgcaaaagtctattttgcctcccccgagttcgatgggccgaatctctctcggcccatctccccctccctccccggctatctctctct

SEQ ID NO: 40023 - DNA, 13744 bp, Oryza sativa
tccaagggacggaggcagagcccctcctccctctggctcgtcgcccccgctcccctcctccttttcccaaagaggcaaggggcgagccccctttctctccctccttttcccctttttcctcccgccggcgtcatcctccctccgccctgtcgccgatttggccgctagccggagcgccagctcgctggcttgaccgtccaaagtcggttcccctctcccaaaccgacattgccatcctataaagcccaggcgccctccctcccttctcctctcgttgtcccatcgcctccactccattgttgctgcccctctgtttcgccgtcaccgttcgtcgttgcgcgtgtcagaggagccggcacgagcgaggacgcggaaggggactccgggcgcgccctctccttcctcttccccggcccgaggccagagagattactcccgcgccgttggcttctcgtcactgcgcccgcccgcacggtagtgcctccctccgttcttcctcctcgttccatctcctccccttagactcgagtagtagcacgagtagcctccccgtagctagccggcgccgccccgaccgttgccgtcgctcgccgtgtactcgccgccgtcgccgcccgagctcggaagcgcctctcgtcgccggcctccctcgatgcgtttcctcctaatccggaacaagggacggattcccgtagccgcgtagatgctctcgccaccgggaatcggcccctcgtgacctcgtcgccttttccctcttccctccccgccggttgccgccgccgcaatccgccgtcgacgcactccctccggcgaatccgagccgttggctcgtctcccctcgtcctgagcaaccacccggtgtgctcgctttcgcctgtatcgccgtggttcgctccgccgctcgccgctgtcgtccgccgtccgttccggccggcgtagtcgtcaacctcccgccggcccgcgtggcagccacgtaggcgccacgtaggcgccacgtcggcgccagctcggccaagaccgggtcgagccgaccccggtcagcccctccccgtgcgcgcgttccaccgcgagccgtgaggctgcgcgtaggcccgccgcatccgtgtccaccgcgaaccgcgcgcgtgcgccgcgtccctcccccgcccgcgcgcgtgcgccgcgtgctcgctccgcacggtgaaccgtgtcactgacaagcgggtcccacccgggaccacgcgtggtgagcctggtccaccggctctctctctcctcccctcccgcgcgcgcgtgcttgggccgccttgggccggccggcccatttagctcggccgaaccgctccatttctctcgggccgcgccctagccgcccgaggaaagtctaatttccctccctcttttattttcttttctttttttttcaaaaaggatttaattaaatccttttcctttagaccaaaaatccaataatcttagaaattcaatatcttcccaaccataaatccgtttgactccgttcaacttccaaaattcctcaaatctcgagatctatctaatgtcacgcttagaggtcattaatagggctttattttcgctgtttgttaagttgtcccgtttcgcgtgtagtttcggagcccgaagacccgcagtgcgaggatttcgaggatcaagctcaagatctcgagcaaggcaagccacctttgaacatctttagcctatatttgaacttaattatgttgcttgaaaaatattatgcattgataggatcgcacttaatctgtttgtcccgtctgcaaggcagattggtggacctacctagtttgttgcatttgacccttcctttgttaattgctataccatgttcccttgtaaccatctagttgcgcctcgatattcgtgcactctgtgcgagtaactccttgggtaaaacttgctttactaaagacttggaaaacccgacacctgggtcggtgcttgcgaactaaatgaatttccaaaaccgcggaccggggaatgtaccgggtgtacggttttctgctctcgcacctaaggaccgtttccttggaatttcatccgaatataagacaagtacgaccacatgggtggaatgggacacccctggctgagtaactagcttatcaggggagccttgatgccgggagacatgtggattcgccggggtggtgtcggggaggacccctgggcttcctggcacagtatggtctgggacctaacctgttgttggtctgggacccctctcgtcggcatatggtaaacctgtgtccgctttggaaatgccttgtcatgaaagcttggaggtctcccgacgtggctgatccccacgggctgggtgatccgggttagtaatgtcgtgtgggtaaattgtaccccctctgcagaggttaacaaactattcgaacagccgtgcccacggtcatgggcggatgtgaggtgattcctagcgtagttttgtttgactactgctttgcgaaattgctgttgtggaatgggttcgatgtttgaaaaacctgcagctgatgggatcagctaggcccgggtggccgtttgaaagttgttggcccgggtggccgtttggaagctgttagccgggtgccaaccttgaatcaattctaaagactgatacattgcacatactccgaccggacgagacgcactgtctcatccgtgtcgtttgagaagcactcacttagttgttttcagaaaagagttcaaataaaatcaattgcaaaaacaacagccttccttgaagcctgcattaaacacttatttcccatggcttgctgagtactcccgtactcacccttgctctatataaataatcacccccccagttggtgaagaagatgaagcggatcctgctgataaggagttcttccaggagcaagccggctacgatgagttttagggtttcggcctagttcccaagtcgcgcctgtgttgtttggcccaagtcttggcttccgtttcccttttgtaatgcagttgtgagctcaggatctgtccgcagcccaacatgactgtattcctactctataataaagagacctctgttgctgtgatattccgtcttcctgtgataccagcactgtttcctgggactggtatcgattaacaggttaatttggagcgtcacgggctagttccggtcggtactagttcggggcgtgacagtggtcgtcacgctggcaggagatagggggagaggaggagcgcgtccggagatcggacggctcacggcggcgcaacggcgccagcgagcggcagcgagccagagggaggggacggcgccggaggcaaaaggaggagaaggtgaactcattccacggctcggattagggcgccggggtcggagggggccggcgacggcgtccggcggcggcggcgggagcggcacggcgcgggcgcagaggccgaggctagcgactgcggcgacacttctgggaggtcccaggggtcacggggatggcggcggcgtcgggaatcaaagagaggagggaggccaacggcggtgcgcgaccgtgcgcacgacggcggtggaaaggacggcacggcgcaggagcaaaagaggaggccagcgggcggagcgacggttttggggtggctcaaggggactcaaggagggtggcggcgcaaggtacggcgagaggagagagaggccgacagcggcggaaaatagagccacggcgaggtgagcagctagaagatgtaggggaaggatttaggctcggggctcaccggcaagaggaaatgacgtcggcggcgattttgtggtgggagagggaaggccgacgggggagtgcggccgggatttccgaaggcggcggcgaatcgggaccaacgcggtatccggaaatatggggacagggcagggcggcacagacgggttttgcggtgaggtggcaacgaccgtcgttcggccaaggaaggagaaggacgcggcgaggatggaacgactcgacggcgagatgcctccggacatggagctcgacgcggcggccaggagttcccatggcggcagagcttcgccgcttgggggaaacgaagcaaggggaggaggaagcacggggtggtttttatagagggggtgtgggagcgtcaaggtcggttcgggggagcatgcgagctggcgctcggccggcgttcactggcgacgtcggcgttttcgtgggcggcacgaaacagcggatggcgcggatgcgttgggcagtggaggcggtggatcgtgcggtgggaatcgaaccgcgagcacgggctggcacggctcggcgtggtcaaggtggggcatggcgacctggcgcgcggcgtcaggggcactcgctaccatggcgctagatgccaagcggtggaggcaggacgtcggttcgggagagaaaaaagggaaaaggagggagaaaaggggagcttgctccatgccgctttgggaaaaaggtgaaggaggaagagagggcgagaccgagcgctggctctcgcccttggacgcatgcgcgcagagcagcggggccgagcggcagcgcgggcacgggcggcgtcgaggctaacgcggcggcgaccgagcgtcgagcgcgcgcgcgggggaaaccgacgggcgaaatcaaacggcggcggcggaaatcggcgctagggagaggagttcgacgagagagagagagagaggaaggagaggagagaggcgctgcttctctcgctcggcgcgtgcagagcacgtgcgtgcggggaggaggaggagcggccgagaggagacgatgggccggaaaagggaaaaacggcccaacgaccaagagggaggtgaaatagactttttcaagggaatttcttcaaggaatttgaggagcatttgacattggatttgaattcaaattggatatttgaactcaacaaaatatggagaagccaaggaggggattcaaagagcgaattcgatactttcggaaatgggaaggaatttcgatgaggcgtgattttcgatgtcgatgggtggttgaagttcaaagcgagaattgatattttagggatatatttgtatttggcagctcaaggattatttgagagggaatcaaaaggagaaatcaatgttcggggtgaaacaaaggaggtggcggtagaatacgatagataaagcgagggagacgaggagagggggacgcttggatgttagagctagctcaaggagggaatttgattggagaggttttagggttggagtctggttttggattccggaattaggcgatatctgtggttagggtttctacagtgaaatccgaatagaaggattcaaacttcgagattattttggaacggaaattttgaggaggtgatctttgatatcagggtattgagacaagagagggattttaaattgagatctatggcacaacttagactcaacactcaaagaactaaattttcgcaattaggatttttgtacattagctttttaacgccacgtgaaaagcggagcgttatatgagccaactatcgcggcagctgcagactgacaagagtttcttgctccttgtgtcgaacatgaccatccatgttctcttgatgtggcagtatcttcttcttcttccctcgaattctcgctcctgcaccatgaagcagatgagatggggatcgtccatgcttgcgacggggaatattggtttggcttgtgggaggccagcgcaggcatggagagaccagagctcggtggcgtcgaccatggcgtccatcgtccaaaccatgtcgtcgtcgtcgtccatcctgagtatccaggtcttgatgatgaaggcctccttggaattgtcgcagaaggttgtgccggggaggccgcagcaacagcgggagatgatgtagatgaacttgagcgcggcgccgccgtcggtggcacaaactcttcggtccgtaatggcgtaatcccgcttgtagccgtcgtcggtttcatcggtgagggcctcggggggaagtggcacgaaccgcagctgtggattctggtcgaacacgtcgtcgcagaggatgatgccgcggtacaggtcggcccagcacatccgccgctcgctgacggggatggccatgtcagtgatccacgacggcggcttgtcggctctaccgacgaagtgggcgaccggcgcccgcgtgacggtccactcgccggagcggagaacgaggagctcggcgtccccctcctcctccagcccgtggccctctagcacggcgagatccaccaccaccatgtcgtcgtcgccgcggcgtaggaggccggtggtcttctcatccagatggtgatgaatctgatgatggtggcgcggccaggtttcactctcttcttcatatgcttgccattcttcacattcttcatcgtccgctgctttggtgacgtaggcagggagcagcgacagcgatggcggctgtggcggccgggtcggcggcgacggcgccggcgttgtagacgaagtaatcgagcacgccgacatcgccgtacccgcgtcctccgtagctcaaccggacgagcacggagtcgccgtgggtagccacgacgatcaggctggcgccccggtggatgcgcgggaagcagtcgaaacatacgcgcgacgaagccggcggcgcatcgaggaagagtgagacacggacgaggtggccgccggaggagacggaggtcgtctcggtcttgtcgtccggggtggacaagggtggagaggagtcgtcgccgttgcggctgagtatcacacaccgtgggtagccggcgccggcggtgacgccggtccgccgtcggttgggtctccatgaccgtggcgatcgagaggatatcgatctcgatttgatcttcacgtacacggagatttgcttcgtccgttttttaatttttaaaacaaaaaacgcggttgggtcggactacaattggtatccacctccactactacacaaacctagataggtatcggttggaaacccgactaggtgccggatttttcaaccgacactaaaaaagtggcacagatgatagaaatcaaaggtgccggtttggaaccggcatctttgagatcctaaaaatcccaaaaaaaaaactggctcaatacatcggttcgaatcgcaacgccccccttcacccaacatttagttcatagaattaattggcttcaagaattcaaaaggaaaaagtacgaattacccccccccccccgaactatcgtggtcgaccgaattaccccctaaatccgaaaatcagacattgttcaccctcaacttctaatacccgacaaattacctcccctcggcccaatccagagcggttttgtcatacatggtgtacacaaacctacaattggtatccaactccactactacacaaacctagataggtgtcggttggaaacccaactaggtgccggataacctgaaaagtggcacagatgatagaaatcaaaggtgtcagttctaaaacggacacctttaagatcccaaaaatctaaaagaaaagtggatcaattcatcggcttgaatcgtggtgcccccctcacccaattttacccaacatttaattcatagaattaattggcttcaagaattcaaaaacatcgatccaagaacatcaacacaaatgcaaagcacaaagaagatggagaggatggacaacagcctccgtggagaggatggagctgcagatgagcaacacagctcatcagcaatgacaaagaagcggatcccgcagcacgttggaaggcgtcgtctgccgccgccaccactatcgctgcctgcctcctaccgccgcacgttgctgtcgtcatctcccctcccgccggatctggcggaggggagggcaccacccaaaacgctgtcgcctctcctcccgccgcaacacgccattgccgccgcctacctcctgtcgccacacgtagctgccgtcgcatctcctcccattggatttggcggagggggtggcgccgccagccactgccgcctctcctcccattgccgttgttgttgcgactaagagtgccgaaagagagagagaggggggaacctagagagagagagagagagccaagagagaagggtggatgaggaagagatgaggaggagaggatgcggtggatgagaaggtgtggtgcggttcggcttggctcgatttaagggtggcgttatttttaaaaaagccgatacctataatatattataagtgtcagtttttcatctatattatatgtggaatgtgccggtttattttttaaccgacgcctatagtaaatgtgttagtttttttgtgttttcagctcacagaggtggaagaagatgagttagcacaattagctaaaagaatagctacagtatggaaattgcaaacaattgttatttttttctcgttaattaatcataaaatatcctaaaataaaaactatattatacgagaattaagctgctcgatttagcgcaattaatcaaccaaacagcaatgcacacagtcacacacttaatgtactacaaaaagtatttcacacattttgcatgtctgctctacatgcacaacaaaccgaacaggcttcactagccttaatctccatcaacagccatggcttcctcagactcattgggagccccaaaagtgaactgagccggcggccattattgtcataacaaagcaagctatacgctctcagcaaatcatcacgagacaactccggtatctcttggagaagagccaaaatctccttaggagaattgaccttggaatttttggcagatgactcgcatgaagattgcaatgaatcattagcgatgatattattttttgttgccaccttatcatcgatgatcatcagtgccggctttgttacatcattgttgaaccccccatcatcagaagaattaaagcagtgagagaccgtgctaacaaagtaagcatatccataagacaattgaagcgagcttgactcatcgagacggcagactgacatcaatgttttgctgcttgtgtcgagcatgatgtaccacgattgcatttttcttccaatcttgtgttcttcgggcacttggaagcatatgatatcagggtcatccatgctcacgatggggaattgtggattgatgcgtgggacgccggcgtaggcgtcgagggaccagagctcggtggcgtcgaccatggcgtccatggtccaataagctgccatgtcatcatcgtcgccgtccatatgtagtgtccatgtgttgatgacgaagacaccgctggaatggtcgcactgcgttgcgccgcggcggccgcagcagcagcgcggggagacgtcgacgagcttcagcacggttccgccattggtgacgcagacccttctctttgacatctggcatctccgtcggtctcggtcgtcggcggggggctcaatggggagcgagaagtatcgcggccggagagtctcgtcgccgtcgtcgaacatgtcgcagaggatgatgccgcgacataggtcgacccagcacagccgccggtcgccgactgggacgaccatgtcggtttcccagaaggacagctcctcggccttgccgtcgtcgtggacgatcggcgcccgcacgacgctccactcgccggagcggagcacgaggagctcggcctccttcggcgcgtcagcttcacccccatccttcacgatgagatctgccaccaccagatcggcctcggcctcgccgcggcgcaggaggccggtggtcttctcatcaagatcgtgcggcaacggcgacggaagggtcgtctcttctccattgtagtaagccgggagatgcaccagcgacggcggccgaggcgggtcggcggcggcggcggcgcctgcgttgtagaggtacttatctatcgtgtccgtgtggtgctcgtacccttcttggtaactgaaggacacaagcacgagcagggagtcgccatgggcggcggcgacgctcatgtagggtggccctagtgccgggtcgacgggaacggagcaggtgtagcacacgcgcgacgccgccggcggcgccctgaggtctagggagacacgcacggtgtggccgccggaggagagcgtggccgcctcggtcttggcatccgcggcggcggagcagggatggttgacgtgtaggtattcggcttcacggtcgaggatcacccaccgtgggtagccggcgccggcgccacggccatccgtcggttgggtttccatggacaaggaggggctgaggaggatggatggatggatcggttctatcgttaagccggagagagttaattagaggacctgttggtccgtttataaaacacacaggaaagacgacggtgaatcggatacggatcgatcatacaatactactactctccctcgtacttactaccgtattccaaaattaaactaaccaagtactccctccgtcccataaaaaactaatctagtactgatgtgacacattctattactacgaatgtggagatacctttgtctaaatttattatactagaatgtatcacattcagttctagattcgttttttttatgacggagggagtatgttccaaaataaattaatctagacgtgttccgtacttttggaattcaaaacctgtacaagttggtttaggaattatcaactgatcacacggaaataagcgtctattgcttagtcatcaatttattcttatatagtgatgtcatactattattatactggtacttgtttgtaataagagttaacaagtagtaaaaagaaatatttaactcagaactttaatatatatgtctaatgtgtatgtcatgtgatcaaactcatccaacttatatacaaattagataaaaatcactatgcaaaacaaccttagggggttatatatataaatggtattataaagtttagagggctcaatatccgatttcaaagttcagggtgctagacagtcttccatccaaagttttgggggggggttatttagactttctcctaaaatgtataaaacctagtgacacagccgcagagctcggaatcctaattaaaacatctctaaatatttatttcatcatccgtctaccaattcgatcacatatattatacaattcgatcacatatattatattttggataatgggaagattgccattagtaaatgaaacaaaacctagcctccactaccagaaacctgaattttcattagtgcgtaggatttttatgagggataaaaaagaaccgacgaaaaattgaataaactttggcggatctgcaccataccgaaaaggattaaaccagggggcttaattaacaccgtcacgaaaaagaattaacatggtggtttcatttatatccgtggcgttgcacgaacctaacaatagcatcatttccttggcggtggtttccaccaagaaaataatcacgggtggctgaccaccaagaaaatttattttccttgtcgctctactcgtgagtgttttagcgtggcggcttgccgacacaaagtatatccctagcgttttttatagttttcatgacagttttccacactcacgaaaattatttgtgtttctgcctttctggcagatctgcttacatcaggatgcacacaatcaaaaaggaggaaaaaaaactcaagccaccggacaaaaacacaaagttgaaaacaacgcctttaagaaggaaccgtcgtcttgtgtttaattaagtataagcacgcccaggaaaaaaacatagattaattattgatcaaaagtacaattcatcacaatgaaataagttcaaccacgttgcatgtttgctgtgcaaagagagcagatagaacaatcttcactactcttgatttcgatcaatagccatttcttccttagacttaccgggaggcccaaaagcgatctaaatcggtgtcggccaatgtcatcgcaaagaatactatacgctcttagcatatcatcgcagtccaattcaggaacctcttctaacgccgccaagatctcctcaggagaagctactactccctttgacatctgagaatgtttggtagatgactcccgcgacgaggaagatcgcaatgaattactactgacgatacaacttactgccggcttgtcagtgacaatcagcggcctctttgcaacattgctacaagctccaatggaagtgaagtaatttgagatcttgctggggaaataagtgagccaagaatatggctgccacgacgtgtctgactcatcgtactggctcactgataatattttcttgctcctcatatcgaacatgaccctccactttcccctatcagaaaatgatatttccggttggtactcctcttgcaccacgaagaagacgaggcgcggatcatccatgatcatgagagggtattccggtctgacgcgcgggaggccatggccagtgtaggcgtcgagggaccagagctcggtggcgtcgaccatggcgtccatcacccatctcatatcgttcatctttagcgtccatgagctgatgacgaaggcgttgcgggcgttattgcatgtggtggcgcctagatcgccgcagcagcagcggggcgagacgtcgaggaatctcagctcgccgccgttgtcggagacccagaagcttcgcttctgccgcgggcacatccgcgggttgatggagtagtcgccgcggccgttgtcgaatttggcggcgggggcatcgacggggagggagacgtatcgcagctggggaatttcgtcgaacaggtcacatacgatgatgccgcgatacaggtcgacccagcagagcatcgtgtcgccgatggggacgacgaggtcggatttccagcgggacacctcctcggccttgccgtcgtcgtggacgacgggcggccgcgtgagggtccactcgccgtccgagcggagcaccaggagctcctccggcgtcccgccgtcctcctccttcgcgatgagctccgccaccaccacgagatcgccgtcgtcgccgtcgccgcggcggtgcaagatgccggtggtcttgacacccagatcgcggacccaccgcttgggggccgcccaacgccgatacccacgaccacgataagtttcttctccaccatcatcttccttatcttcttcatcatcatcctcttccttttgcaatgtctaccagtaagtcgggagcagcgacaacgacggcggccgtggcgggtcaacggcggtggcggcggcgccggcgttgtagaggaagtagtcgaccccgatgtcgttgtcgtaggcgcgccctttccgatattgcatccggaggagcagggagtcgcggtggacggcgacgacacgcatcgaggggaaccgtctatcgcctccgcggctgccgcttgggacgcaacggaagcgtaggcgtgacaccgccggcggcgccttgaggaggaaggagacgccgacgtgatttccggcggaggagcgggaggccgcctcggtctcggtgtcggtgaccttgctagcggcgtcggcggtgaagcaggagttagggtcgtcgccgccctcgtcctcgtcctcgagaggaacgtgttcggcgaggatgacccactgagggtagccgccgcctcccgccggcgatgggccgccggaattattaggaagcgtcgccgccgtcggttgagcctccatgggcgcgcggcggcgagatgatcggcggagaaagatggatgtggtaatccgtatttacactggttggtttggtgtggggcccacggagtttatgtagacggggcttcgttttggattaatttacgaacttactatacttgagtttgactaggaatcgaaaaacagat

SEQ ID NO: 40024 - DNA, 787 bp, Oryza sativa
agggaggacagcaacggcgatgtgggagcagggcaacgccgacggagggaggaggaggcgacgacgacgacgacggggagggctctccaacgctgcccgtgcgtgtgctcgcagctcgcctccgacgctgcctacgggcgctcaccgcctccggcaccgcccacacgtgctgaccgctcgcgcttagcactcatcggcgacgagaacggacgctgccgccttcaacgttcgccggtgctcccctccccctcccctctcttcctctctctccagggttggttttaaaacctctcaaagtggcaaaatatcctaattaaagataacctattgagtggcattttatgctttgcatcgtattgggtggtatttcgtcgaaacccaccaaatggaatggcgtattgtcctttttctcctttttacacggtctttagcgatatcctttaactattaatgtatttcatattatattattagcaactatataaattagtgtcacatgaaagaataatttcacaaagctacatattttatggtccaagttgcagaaaacaacacattttgacacttgacacttaactacatactctattttttttgtttgacgttccagttcatactcaaaaggtgtttttttttgtttgacgctcgcagttcagaagccctcctcccgtccgcaaatttcccctctcccccctgcagagacgaaacgtatcagtgcaaagggataagggtgaagggcaaacaagtcaattcacagcttccttaatttaatcgaaccggtcggcaa

SEQ ID NO: 40025 - DNA, 1967 bp, Oryza sativa
  unsure (1)..(1967): unsure at all n locations
cctgcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaaccctcccaatccttcaagtattgattgtctcgaacaataatcttcatggtagcataccaaaggagatcttcagaattccaaccatagtgcaaattagcttatctttcaacaatctagatgcacccctccataatgacattggcaaggcaaaacaactcacatatcttcagctttcatcaaataatatatctggatatattcctagcactttgggtgactctgaaagtttggaagacatagagttggaccacaacgttttcagtggaagcatccctgcatctctagaaaacataaagactctaaaagttctcaacttgtcttacaacaacctgtctggatcaataccggcatcacttggtaacctacaacttgttgaacaactagacctatcattcaacaatcttaagggagaggtcccaacaaaaggtatattcaagaacacaactgctataagggttggtggaaatccaggactttgtgggggttccctggagctacacctactcacttgttctagcactcctttgaattcagttaagcataagcaatttatttttctgaaagtagctctcccaatagctatcatgacttcacttgtcatcgccatctctattatgtggttctggaatagaaaacaaaacagacagtctatttcttcaccttcatttggcaggaaatttcccaaagtttcttacagtgatcttgtgagagcaacagagggattctctgcatccaatttaattggcagaggaagatatggttctgtatatcaggggaaactatttccagagaggaatttggttgccgtgaaagtcttcaatcttgaaacaaggggtgcaggcaagagttttatcgcagaatgtaatgccctgaaaaatgtgcgacatcgtaatctaatcactatccttactgcatgctccagtattgattcatctggaaatgattttaaagccctagtgtatgaatttatgccacgaggggacttacataacttactatactcaactcgagatggcaatggatcttcaaatttgtcctatgtttcccttgctcaaagattaaacatcgcggtggacgtatcagatgcattggcatacctacaccataaccatcaaggaagcattgttcacagtgatctaaaacctagcaacattcttctcgatgataatatgacagctcatgttggagactttggactagcagcattcaaatctgattccgcagcatcatcttttggtgactcaagtttgacttcttcctttgcaataaagggaaccataggatatgttgctccaggtattgctcatttcacattgaattctctttgaagttgactggcacattccaaatttttgtatattcatgtgaacatgtgaaataatggggagtaaacccttcctatttgtgatttacagaatgtgctgggggtggtcgagtttcaaccgcctcggacatctacagctttggaattgttctcctcgaaatattcattcgaaggaagccgacagatgacatgttcaaggatggactgagcatctcaaagtatacagagatcaatttccctgataagatgttgcagattgttgacccacagctgctccgagaactagacatctgccaagaaacctcaattaatgttgagaaaaatgaagtgtgttgcctgctttctgtgctaaatattggacttcattgcaccaagttggtcccgggcgagcgcatgagcatgcaggaggtggcct

SEQ ID NO: 40026 - DNA, 947 bp, Oryza sativa
ctaatggttaactagtggtcaactaacgaaatgagtatagaagggatcaaataataaaactcagggcaatccaagggatggtataaaatttaggggcatagaaatggttgagtgaaaacttatggacacacaaggaatttgcccataaactaaatattagagagttgacaagtgattttgaaatgttctctaagaaatgctgatgattttttttttgcatcaattagtgagagctagcactagatattgagatgaaaaagagggaggaaggtaaatatctgtcgccctttcatatctactccctatgttaaaaaagacttaaatcctaggaatgaatctagatagatatgtgtctaggcttatccctaggatttgagttttattttggacagagggagtaaccagcagcatccaaccacgaccacaaccacagagcagattaaccagagcaaccaaggaacccttccaagcaattacatccaagagctccctgaccagagagagatggaaaatgtacagctaagggcctccccaccaaggtaggagagagagaagaacctgtgaaccggaggaaactgaccatgactccatgagagcagagctagcaagcagctggcagaggtcaagaacaccagcacgagtcggccggatcgtcagtaacaggaagcaaaccctgcactcaagtcattggcagtaacaaggtgaattccacactcccaaatcccaggcagtaaacaaacacacacatgcccagatagttttctttgtcatctcattctgcaagatttttttttctaaaaaaaggaccatctggatatgtttgtgttttctggatttctgaatatttaacattagataatggttgcatgcttgaggctacgcctatgtgccaaacttccaaatcaaagaaacatgatgcttttttgaaaggttttagttagttttca

SEQ ID NO: 40027 - DNA, 1320 bp, Oryza sativa
ttgagagtagtttcttgctcttcatgtcgaagatgatcttccatattgtcctttcgcagtggaagcatgactcccagtgttccttgcaaaccatgaagcaaatgatgtgtgggttgtccatgctaacaatggggtatactggtctcaggcgtggtgggccggcgtaggcgtcgagggaccagagctcggcggcgttgaccatggcgtccatcgcccatgtcgtcgacgtcgtgtcgtcgtcgtcgttcatcatgagtgtccatgtcttgatgacgaacgcgccgctagagttgtggcagagggtggtggcgcctgggctgccgcagcagcagcgcggcgagacgtcgatgaacttcagcgcggcgccgccgccggtgacgcagacgctccggtttctctccgggtatcctcgtgggttgatcgcgtactctccgccgtcgtcgtcgtcgaatttcttggcgggagcctcgacggggagtgacgtgtactttagccggcggggacgactttcgtcgaacaggtcggaggcggagaggaggatgacgccacggcataagtcgacccagcagaggagcgtgtcgcccacggggacgaccatgtcggttcgccagcgggacacctcctcggccttaccgtcgtcgtggatgatcggcgcccgcgtgacggtccactcgccagagcggagcacgacgagctcggcatcctccggtgtgtcgtcggtgtcgcccttcttcacggtgagctccgccaccacgagttcgccgtcgcggcggcggcgacgcaggaggccggtggttttcacgtccagccagtgctgccgccgcgcgtgggtcgggagcagcgtcaacgtcggcgagtcggcggcgctgtagacgaagcgatcgagctgaccattgtatgtcatctggaggaggagggagtcgccggcggcggcgacgacgcacaagaatggcttgtcgcatctggctctctctctctcccggtgccggtgccgcacggcggggagcagcggaagcatacgcgcgacgccgccggcggagccacgaggcggcggaagtagacgcggacgagatggccgtcggaggagcggcaggctgcctcggtgttgatcttgacgtcggcggcggagcagcgggagtcgtcctcgccgtcgtcgtcctctttgtcgtcgtgaacggctcgctgctcgaggatcacccaccgtgggtaggcaccgccgcctccgcctccggtcgccgacgaagcaccaggagacggtgtcgccgtcgattgggtttccatgggcggcgagcagattgatcgatcggttagtcacgcaga

SEQ ID NO: 40028 - DNA, 3457 bp, Oryza sativa
ttcgtaatgctccgagttgattacctttattattgtttttagtcaattccataatttatcctgattaaattaaatttttagatagactcacatttttatccctacaacagatttacttataatgttgtactaacaacttacttctattttatgctaagttacttttatgatttatgtaaattactttcagattttattgaacttactttcacaaatgtatttacttgaaaatattctctacactgcttatgaatttactccacagtctctcactacaacttagtcataatatacttacttctaatgttatagagagttctattgcataactaacttacttttacaatttaaatgaattatttttaaattaataatatgtttgaatataaaaataaatttaataaagcctaaaagtaatttacatatattatggaagtaacttaaaacaaaaagaaagtaactttgtcacgacattaaaagtaaatctattatgaaggtaaaaacatgagtctatatagaaattaaatttaattagcacaaattatgttattaactaaaaatgattataaaataaacaactcacaacattatgaatgtatgagaagtaatttagtaaaatcaaaaagtaacttatacatatataataaaagtaatttacaacatagatatttcttttataaaaatatagtcacataagatcttgttctaaagatttaattgcaacgaacgtaatggtgtaattcaagagaaaattctataagaagaaaaaaatgcatgcaattttaggtgtactagtagcaactaggtatgagattgggatagctggttatgacaatccagcgcacggcctcgttgtagacacgtcctagaaataatgcggctccatcacgtttaacttttccacattatttttgtatatagtccaagataatgactacaaaatgttgccttgagacgtactccctttgtcccacaaaaattccaaccctagcttcccaaggtggatataagaggagagacaaaggaccaaaatggccctaattaatagcaaagttatattgatgagcgggtatatgaggggtattgaagagataaagcttctcgatttacagattgatggtaggtaggaaggtagaagctggtttattttaggacaaatttcaaacactaaaagttggtttattttgggacggaaggagtactgtaatatggtagcccacgagcagcattttaaatcgattgatacgacatttagctatcagtctctcatacaattaatagtgggctgtattgattaacagcaattacattgcatatgacaacaaatagctagttcttgcttgaacaatttgtacctggagatagtggggagatagcaggtatagttggagatttaaaaccttgctcatgaatgagctagtgtaatgctaaaagaactattaggtgataggcgttgtgtggagattgtaaagcaatacggggagactagcggacggtttcccacctataccgttggagtattttcgctggcggtgatcgtgtgtggccgccaaaaaaaatgttgacgtaatgaaaaatcgatattgtagtagtgaaggaacacagttcagcagaaccaacgcaatccaacagttaatttaaatcaaatatttcaatcaatcatgatgtaagtcatttgttgtacttgtacatgtagagtaaatgttttgataagccttgatttctatcatcaaccatttcttccttagacccattgggagcccgagaagagacctaaataggcggccattgtcacggcaaagaatgatatacgctttcagcaaatcatcacaagcatgatcgggaatcgcttcgagcgccaccaagatctcctcgggagaagctatccttgacacctgcagatgtttggcagatgactccggtgacaaaaattgcgactgattaccgttgatttcagttgtaattgttgatggcttgctgacgacctactggtggctttgtaacaccattgttgctactatggtttgtgtataaagtggagatcttgcaaggaatgtaagtgtgtccataagatggcttttgttggtaaacatcattatcatatcggcatactgacagcaatgtcttgtccttcgtgttcatcatgatcttccatatcgtcacgttgacgtagaaaagcagatgacgtcagagtcgtctatgccgacgataggtgctctggggtgatacgtgggatgctggcgtaggcgtcgagggaccagagcttggtggcgtcgacaatggcgtccatggtccactccatgccgtcgtcgtcgtcgttcatccttagcgtccatgtgttgatgacgaaggcgttgctagaatggttgcacagggtggtagcatgcggctgccatcgtcgccggtggttgtagggtttcgatgagtggcggcgagaggctgacttgtgctcagggctcgacggaactctgattttaattacgccttattcggatatataggacaggaccgaaatgcttacatgcatctcgcccgaaattttcggttttttacatttttttgaatttgctcatattttattcaaatttattcaaaaatcagtcaaaatttcaaaaaaattcgcacgaaaaaaatccaaaatttcgattctttcacccacctgcggcagaaatcttagtttcaaaatttcaaaccttgggtacagtacctcgagatacttttggctggaccggagcaaatctcttgtttatttgttcctctcctcccccacctctttaatctctgatttgttcataatgtttcgtcccttgcatttgcatttgcattttgttgtataattactgtctgaaatagttgtatgaatccgattgtgtataacccctcaaaatgtacatatatgtgtattagcaacaaggatggaaatttcggaagaattttgcccctctcctgcaagcaaatattttgagcaaactttttggatttttttcaaatttgtgaatttggtcataatttattcaaattcaataaaatttattaaaatttcaaaaaaaatcattcgaaatatctaaaaaaatttcccgaaatttcagaattggtgcccaccgaaattttttgcctttccaagaggaaaacccagtttagaaatggattgtcatgcgtctctgaaaatgtttgcatctcttgaattatatctgtaataattgctatgtaattatatagtcgtgagatgtcaatctcatgtttttctttgacgttttccggccagtcggagagtcaggcggtggcgcggtagtggtaggggatcgggcttgcggtggcagaatgcttgaagggaacgggaggagaggagttaggattaagggctttgcacgaatcttaaagcatatctaacagtccaaaattcgaaagatgagatgtgggattttttatcaatagactagtaatcatgcacgtgcaa

SEQ ID NO: 40029 - DNA, 2542 bp, Oryza sativa
ttcgacatatgcaaatgcaaaacacatgcatgaccattcattcattcccctgctatgcatgctagctaagctaatataagcagttcatatcagcagctttaatttaagccttggctgcacgcagtctctcggacgtccattctaccgatcaacgacccagattcacggctacataatggacggcgttttgttcaactagctccctcgtcttaaaatataacaacgtattattacactatacttcctccgtttcacaatgtaagtcattctagcatttttcatattcatattcatgttaatgaatctatataaatatatatgtctagatacattaacatcaatataaaggtaggaaatactagaatgacttacattgtgaaacggagggagtatgtgatataactagtgctatgagtctgttctgattcagtatagattcgtagcactaagatatacttcctccgtcacaaaaaataagcaattttagttataaatctaggcaactgtgtgtccagatttatagtcaaaagtagctatattttggaacggatgtagtatttccatattgcccccactgagtcatactacgacagcatgaacagttcgtgttgcactaatctagacctttgatctctgttcgaatccaacgtttagcagtgctactgctgcttaaattgcagtgaatactatataggagtatgaccttagcaaatccgaatcttggcaagctggtactagcaaatgtaaagcatttccctccaaaatttctccaatgtccctgcctgccacttcgtgcaacagatgctatatccatgttaccatatgtatgtgcatgcatgcagtactactgcatttgaacccaggtggttttgcatttactgaattggatatatattggtgcaattcagatagagagagagatgtggcaaatttctacttcatccgttttaaaatatactaccttcatactcgtaaaggaagtcgtttaggacagcgacacggtctccaaaacacaactttgacttcttatttctataaaaaatattcatcgaaaagtgatatatgtatacttttatgaaagtatttttcaagacaaatatattcatatattttttatatttttaaactcaacaacttgagagttattcataatttatattcctaaggtttgacttaaacattgtcctaaacgacttcctttacgagtacggagggagtaagaacttctagcacttaaattttgtccacaataatataaaaatttctagcactatagtactatttatcccttctcattcaattttctttttccgatcaaacccacagttaaccttcgacacacatcaattcctcatttattgaggagcagtaaaatcttttcttctcaacccccaaacctgcatatgttttgagacgaaggtagtagtaattcttagctagctacttgtgtgtacgaatatatatatttcttgctttgaggaaggaccctgtctcacttttgtaggtaagagaagagatggctttgttgattgtgagcaaagtagctgtggagtacagcctttgattgtaccaatcagtcacgtttcaacaatcgccagtatgggttgcactttctgtccaaaaaaaataaatcatgaggataaatctggagagagatatatatatatatatacactatagatggggtgcgttgtattaaaacacaacccacccccaccccgctcccccacatatttcttgtagtactgatagtaaaatgattaatgtatgaatatgcatttaccctatagtaatgttgttacttcccgcacatattagccattttctttacacctgctttgtacggttataccccgaatttttaggatctgggaacgggcggccaagggagcggcatcggcgtcctccagcggcaggcagcgggagaacggcgaaatcggccagcgacgggtggaaaggagtcgccgccgcagccgccggaggtcggagccgaggggaggtgggcggacaacaacgagcgacgcctcgagggtatctttcctcttcttgttcttcttggtcctcttcttttccggcgtggccccggccggaaccccaaacgggggcgcgtctcattctccgtccgcgcgtccgctgcggcggcgccggcggcagggtgtgatgccgcgggggatggggatggaggcggccgccgtgccggaggagctgcggcgcaaacgctctgacggcaagtagtggcgatgctttcccatctcctgcaaactcgtgttctcatttactcagatcctgtctggaaaggagggcggcgacgagcagctgtagcccctcacccagttgtcggctcgtcacagccccacacggtggccggggagaaagaggattgtggaggctgatgtccaagagagagggctgcctgccttctggatccgaaggcccatcttctccccagccgatgacgccatgccggcctcctcatttgattgaggcatcctcatcatcagccaaagcagcttgcacaaggcagcgaagttcagatggtatg

SEQ ID NO: 40030 - DNA, 1605 bp, Oryza sativa
attagccagcagttttctgcaattttgaattagttcaacagaatcactagttcagtcagccacgcgattagcagatatggtactagtttctgaaattttgtagttcatttgagcattgttgatcgggtaacaatttttctgaaattccctggttcagtagagcagcacaaatgaatttccttttatccttcactgaatcagttagccatatgattttgattttgagatatgaatatacaggtttgtgatctttttcgatgtactacatactaattacaaggacgtttccattcttaattttctttcatttcttaatactttatataatgttgaggctcttattgctattcttcttgtatctacgtatttgcccaacagtgcttcgatcgggtcatggtgtgctccacttcgcagtaacatatatgtgttcctgaggtatgtgaaacaataaactgtttcataattttttatactaacaaaaataacttagttcttgcatatgtggtgttactgtcatatatctttaatgagtggggaaaaaaatcaaggtgaaagactgaaacaatgcctataatattccaaattcacattgctttgcattcagctgtgcctcattatattcttcatgtatagaccactgttatgctaaatcttgatggatcttggacttgatatctggaataatcctgttattttcaagtttgtatattttcaataggtgcagtgtgggatactgtagttgaggcacgggttgatggcatgttgatgagccaatcctgctgctccaattgacagcttcaaggggtacatcaagaagaggatttttattaaaatgtgctaattttttgatgtcctgaaagtgactaacagtgatctctacatgctaggcactttctattttattggcttctaatctgtgtcatttagagtcatactgaatgtaaatcgagacttctcgttgaaaccacctattggagacactggtaaggacacacgagcagggccataaagattattatgcggcatggcacaggactagcagcagcgtcggcaaggaggtgactgagtctggtgccggccatatccatcattgttggtggtgttgtaattttttatttgtttttgtgcattctacaaatgtatcacattgcgtgtgtgatcagacagccgttgtaattctaaatccgttcaaacatttgtcggatgtgcataaatgttttgctcctgcagtctaagagtaatttatttactcaaggaaggtggatgaagaaaagcacaaagtaatttatttactgagagaagactggactaatatatgttgctatatcaaaagtttttacttctaacttgagtgtagtttatttagtgatagaacattggagcaaaattttaatgtaaggagtaatctaacagaagggctaagaactacctgtgataagggatgagaatctatttactaagtaataaatttactaagataaggagtgagaactacctgtgagtaatccatttatactaacacagtgaaacaactgagagtaaaatatttactgagaaaatgacgtgggaagaaaaatcaggtgtgagataagggttgagaactac

SEQ ID NO: 40031 - DNA, 4233 bp, Oryza sativa
agggtgggtggggtttgtgaggggagtagtttaattataacgcaccctgggtgcggtttagcgcatccacacatatatatatatatatatatatatatatatatataaattcatttgcaaagatttgattttttagggacagagccaggtagcagtagaccagtagtaattttatgctcacagcatgcatgcacagggcaatgcatggatgcatatcatttcgacttacgcttgcacaggggaaaaagatgctgtctgtgccaacaaacagagagccccatcactctcgatctctctcagaatgcgtaacaagccaatggatgataaataaactgatgcagtacatgttgatcgatgaagtttcaattcgcccgtttttggattttatttggggagggatcgattatttttggattattcatggcacacattcagaggtatacgtatgatttctctaaaagctatgcttaggtgatgtcaggtttatgtacgtatatgataatatttaattcatccttaattatggccgagtttagttttaaaatttttctttaaacttctaacttttccatcacatcaaaactttcctacacacataaactttcaacttttccgtcacatcgtttcaatttaaaccaaacttccaattctgacgtgaactaaacacactctatattatatataaataataggtcatccatcggatccgcttttatctgcatatatatatttcatctaaaaagaacgggcgcccatctgatacgatttatattaaggatatatagaacagttctcactgcggatagacaccgtagcattacataattattaatactccttatgatctttttatttgatattaggagatctaactgaacttaattttcatggcgtcaaattaataaggtaaccgaagagtagtacttgttcggtgtatataaatacaaactgaaaagatcaaattatcttggttaaaaacagttgttgcttgtctttttttctctcactctctcgtcttccaggtgcatctttaactacaagtccacagatattagaaaaaaatagattacaggattataaaatagtcttcaagacaaatctacaaactacataccatttttttatatttttatttagatctaaatctctactattataaaaattaaagatattttttgccggtattttagtacatcatccgtgtatgagtcaatttaagttcgttcgcttttggaaatatatatccgtatttgagtgggtttttaagttagttcgcttttggaaatacatgagtctatataagaaatctatttaaaaaatctcgcatgctaacttgagatgaacgaattcctaactgcagctcatgattttctaaaaaaatatatatatccaaacgaattcccacagcgagtttcaccttaactaaaccatataaaaataataagattaaaattgccttcacccgttgcaacgcacgggtattttttctagcattttaaaagtcctcaagtcaaagtttaagtaggagctttgcgaaaaggtgaaatattcatgaccagaaaaatttaataattctctccattaaccttctacttttccttcattcaaaagctcattttattgtatttacttttcaaagctgatttggctcagaaaaaaatttaaaaggacccagagctagcaagctaggcgcatgcatggatgatgaggtttgacgaatccattggtcagagtcaacaaaagcatatgcatgtgcgtgcgtgggactttgatagcatgcagcacaaaaagaaataaaagcaaaggaaaggttcatgtagcaatggaaagatcaattgggatagcattcgatttcgaccaggcttcatcagattctccctgcctttagatttgatcttggagagacactctcaaagatgatcaaagggccgtacattggattgtgtgaaaagatgagatttatccgtgcatggcaactcgagtagtacaactacactctctgcagtgtagtagcctctgcatcaactagaacaattgtgtcattcagtatgcaaaattcctatctatatgcaccataacaaattatgatcctccaaccggtttttaatgtttaagtgtatggttaacttttaaacgtgggttttgactgttcgtcttattaaaaaattacgtagttattacttatttttgttgtgatttgttttgctattaaaaatactttaagcatgattggaacgtatgactaaaagtcaagaacaatctacatatattaaaaatcggaggcagtacaaatagacatcacatttttgcctgactacttgtataccgacaacattcaaagctctcatccatggcatattcttcacataatttgttactagttccttttggaatatgaagtcttttagaacctcgtggaaacgtgcccatactcttcaaagaggttctctatacatgtattttgtcttgcatataagatttctaacatcaagttcgatgaatatccaacatattggacatgcttatgtttgtagtgtaacccaccctcgtccttcacatctctctttccctagaactagctaccagtcataactataacaatctagtcttgtatgaccaattccctatgacgaatagggaaaatgtcatcgatctatgacggattcttaaaaaataataagtataccctcgcactacacatcttccgctaagttgatagggtatgttgctagctattattgctatcctccctatgttacttgacctctttcttcactgctagtctcctttgctaggctagtgccaatctacttgctattgtcctcttcctcgtaatccaatggttcttatgtatgtcctgactatctgcacttttaatctcacttgtcttcaacctaacaactctagtagcacgtgccatcactgatctcccacctggggtgcgccccaaccaggtggagaacgaccctttgcaccccttggtcgtcctcccgcccctataaataggtaggtaccccttcagggtttcttgagttttgtttagattaaagtttagctttgctactttgccgtgtaatcccgtgatcggttagatcgccggttaactcgttacggaaccccaacttatcatttgtattcaattcctatctgcaattcagattgcttttatcttgttcttgcttgtttctttgatttgcttgcaggaataaggttgatctgcaccggcaagatcaacaacccatggagaggtgtatcgatcgctaaggcgcaatacaacaacatctagtacggttgtagtcgggtcgtcaacgtttctcccaaatcgtagttatcatcaactcaccaaaagatcgggccaacaacaatcttgattgtctcaagtggagctcagggttcatcaggtggtatcagagctttcgttgctcggtgagtttttatctacctataatcagaaaattgccatacaaaaaaaatatatcatgtacctaaccatacttgtgccattgcattgtcgagtcgtagtttatttgttatttgttgagttttttatttgttgagttttctgttgcatcgtcgagtcgtagttgctggtcttagcatctagttcgtttagagtttcgagttctggtcacattttataccacagtcgttgtcgcccccgtgtctctgttgtcatcgggacctacgaaaatgaaatcggcttgctgccacggttctatttttgtagttttcagaagtttccgtcggttggttttggagttgttgagttgcaaataggaatctaggatttatgtcgtgtggttgccctctgttccgtggttctgtatatgctcttgcacggccgtgctgatgcgcgtgaggaagatggaaggtgtgcggaagatggaaggtagagattagattagtttggtttggttcgggaaggaaatagttgattggattggctgaagatcatatttccttttttttttatctcttgcatgcgcaccaaatccaaacacctgccgtatccttccaccccgcacccaccaccactgtgacagagtccgactccctccctctcctcttggtttcagtccacaccgtgagttgctatacatcttggtgaaaatttttggagtgtcggattggagatctcgtccatcgtcagttgccaattcccttaaacatatcatggagccagtggtggagctggctaccatgggcaatagcacaggctccgccagacgcatg

SEQ ID NO: 40032 - DNA, 705 bp, Oryza sativa
cccaaatgtatgttctagtatttctgttgcatggcttcagctgcctccctacctgcaagataaccgagtgatcgtttttctgctttaattgttgctgcctgcatggctgcatctttgtggtacgtagttcagggaaatcccatcagtggcacataatctcattgctttttttttctcacttactactatcttcgtattttaatgtatgacgccgttaactttttatccaacgtttgaccattcgttttattcaaaaaatttatataattatcatttattttactgtgacttgaatcgttatcaaatattctttaagcatgacataaatattttcatatttgcataaaaaatttgaataaaacaaatggttaaacgttggtcaaaaaatcagcgacgtcatacattaaaatacattaaaatacggagggagtactgcttagtgcattccatctcgccagctcccatgagctaatgtcaatcacttgctaaaactattactaattaaatttctaagtcatgtttatgctgctacacatgcatgtatctcaatatcttagagctagcgagagggcttcattttgttcattacgttaattgtcagacagaactagaaatatccgggactcctaattcctgatgagcagcactgctggcaataacaaacctttaacaaaaaaatgtcaaggtccagtatgtcagcatata

SEQ ID NO: 40033 - DNA, 32948 bp, Oryza sativa
aaacaagtaattgtgttgcttttggtcagagtcctctatatgctacttgttgcgtttcagaattttattggctgttattgaacaaccttctattacgagctaattaagtgtttcctacgacgtgctggcagctttggattcgtttgtcgtttgatgtgcatcccttgttcggacttcggagggctgtttgtcaccagcagattctcttctgaattctaatggagcagattcatatatatgtccggtatacgatctcgaagtatcagttcgtccagtaattaagttacacaattagactgatgattgttttgcctcatattgttaatgtactgttacagaaaattaatatatttggcaaacaaaaatgtatgcatggactgttaaaaaaagagttattcttttttttaaaaaaaacatgtatctacggcctgcaataattgatgctttacctcagctgatcgcttggataatacttatatataatttagatatcccgttacaacgcacgggcgtatgtttgctagttatatacatgcatgtaagactgcaaattacggtgtatcatcatgcaaatcttgataaattggatttttgtttcttgaaatgacctatatgggacatgggacaattatatatttatatgttgtcactgcactatttttttttagtctgaactttgattaatagttatttgaatggaattttcgggcactatgttttttctaccttaatattaggtcactttatatctaagcagttagtaaaaaaaataaacagtcagtttttttctaccttgacaaccccaagttcgtaataaatattggcatcggtcttttcaaagtgtaataaaaacaacaaataaggaacttaattcagcagaattagcacagttaatcccacaagtgtatacaagtaccactataacaaatattttaatcaatcatgttataggccatcagttgtacatgcactgcagacgggacaatctcgacaagccttaatttctatcaacagccacttcttcctcagactcattgggagcccaagaagagacctaaataggcggccattgtcacggcaaagaatactatacgctttcagcaaatcatcgcgagaaagctcaggaatctcttcaagtgctaccaatatctcctcaggagccatccttgacacctgcagatgtttggcagatggcaaagattgcgacagattattaccgttgatttcggttgtgatcgtcgtcgttgcctcgcagatgatggccggtggtggctttgtagcaaaattgtttggaatgtaagtgtgtccataagatggctctcgttgggaaatatcatcatcgtatgtgcatactgatagcagtgtcttgttcttggtgtccatcgtcatctcccatgtcgttctttcgaaatagggtttcccctgtttgtgattgtatggctcggtcacgaggaagcagatgacgtcagcgtcgtctgtgctgatgacagggtactccgggatgacacgtgggatgccggcgtaggcgtcgagggaccagagctcggtggcgtcgatcatggcgtccatggtccatgacaacatggtgtggtcgccgtcgccgtcgatcctgagtgtccagatgttgatgacgaaggcgtggcgagaatggtcgcagagggtggcgccggggtcgccgcagcagcagcgggggaagacgtcgatgaacttgagctcgccatcaggcatctccgcgtgctctcgtcgtcgctgtcctcctcgaattcgccggcgggggcctccacggggagcggcacgtactgcagccgcgggggaatttcgtcgaacaggtcgtcgccgcagaggatgacgccgcggtacaggtcgacccagcagagccgccggtcgccgacggggacggccatgtcggtctcccagtaggagagctcctcgcccttgctgccgtcgtggatgatctccgcccgcgtgacgctccactcgccggagcggagcacgaggagcttgacctcctccagcttgctgctctcgctctccctggtggtgatgagctccgccaccacgaggtcgtcctcgccgtggcggcggcggcggcggcggaggaggccggtgctatctgcgtccagctggtgcaccttcggatcctgacgccgccttctttcgtcctcgtccaatggatcccagtaggacgggagcagcgacaacgacggcggccgtggtgggtcatcgtcgtcgccgtcgtcgtcggcggcggcgtaattgtagacgaagtaatcgatcccgaattcgtcgtagccttccttgtcgtaacgcatctcgaggagcactacggagtggtcgtcgtggtcagcgacgaggtccatcgagggtccgtccttgccgcacggggagcagcggaagctcacactacgccggaccaggtcatctctgacgggcccaaaccctcacctttgacgggtttggtcttggtcagtgattagtggtcactgatgacaaaatcacctgtgatgtatgaaacacccgtcacagatcacccatctgtgaccggtatataagtcatctagtgggggttaaaacttgtctcccgtcacagataagtcatcagtgacgtgtagtaactacctgaccgtcgctgatgactcatctctgacgggttgtaacttacgacccgtcactgatgacaaagtaagaaatataatttttgaattttaaacgcaacaaaaaacctcaaaaaaatattttgaattttactagcaatcctatacatggttacacatcactacctacaaattcacaatttttcacgcaatataacttgtatgctacaagtgagattcgaactcagacctcaacctccatatagagctctcttaccaactcacctactcaacacatattgactactaacccaatgttattattttgtctatgcttgtctgaatcatttaacatatatttaacaccctaaatgacttcaaatgaaaatattatcaactaaatagttatctcatcgtgttttataacttttacatagaaaatatcttcatccgatgttgtttgaagaattcaaaatttcatttttaaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggtttttttgcaaaatttacaaatttgaattttcactcatcactgacgggtcataaccaccacccgtcagagataacgttatctgtgacgtgtgttagttaaagacccgtcagagatgagtggtctcttttgtgatggttcataatactacacccgtcacaaatgacatgtcatttgtgacgagccatggttgtgacccgtcacagacgatctgtgacgggttacaagtgcaagccgtcacagatgactttacatctgtgacgggtcctccctggtagccatatattgaagaggatattttttcggcccgtcagagatgactcatctttgacgagttacgttggcccgtcacagatgacccgtcactgaagcccggatctgtagtagtgtcagctcggggcggaaggagacgcggacgagatggccggaggaggagcgggaggtcgcctcggtgattggcgccatcgccgtcgacgacctcgagcatcacccaccctgggtgggtggtagcctgaggcctgaatctctggccgccggcatcgccaagggctctagggtttcgatgagcggcgatggcggcggcgagaggctctgcacccgcacccggctgtgttcggggctccacggaattctgcctgattttagttaggccgggtttgacaggggtttcggcccaatccactctgaaccccggcccgggggcaaaaaaaaaaagaaataagtccactttgactctaactaattgccaaatctgattcgcatccttgaatcataataccggatatctcgactcccaactattaaaacagttgcaatttgactccatcaacagttttagagagcggtttcgctgacgtgacgtgtaacatcctgaaaattcaagacaatgaaaatcacgaaaatttcgaactttttaaaacttttgcatcatgctggttgttatgattgctattacttgccaaaccgtaaatgatcaccaagaaagtaaagaaaagaactacatttaagcaatagatatgatttacgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctgtatatataatagaattacgggagtatttaattcgatatgtagatcgattttgcaccaagttcctaattgcatttagggattgaaatttgatatattaaacccctccatataaaataaactaacatatagataaattgagctaatgtgctattgtgttaataacggtctcattagaaaattatagaatctttaataaaccttaaatattggacaatattaaattttgggaaaaattcacatttgaacacttaatacggtcacctaaatgcttgggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagaataaatccattggttggaatgacacaaatattgggtaaacttctttatacaaaatctaggatttataaaatcaaatttacacaaaaaataggctaaaatggggattaaataggaaaagacactattcatcggccgccaggtgttcgacgtggtcccctaacccagcccctcctctttccccctctctctgtcgcctgccaccgcgccgacgtcgccatcgccgtccctgccccgcgctgccgtcgccgtcactgcctcgcgccgcgcgccgccgctgtcacgccgtcctgcgcccgcgcgtcgcgtccgtcgtgtcgccgtcatctcgagccccgcgccgccctgtcgccatcgccgcgcgccgagccccgtgccgtgccgcgccgtcccgtcgccgcgtcgccgtcccgtcgccgtgtcgccgtcccgtcgacgctccgccgtcgtcgtcgtgtcgcccgtcgccctcaccgcgcgccgagccccgcgccgtcccgagccccgcgccgccgcgccgccgtcgcgtcaccccctcccttctcttccctcttccccttattccctctctcccctataagagccaccgttctcccctctcctcactccatcttccccctcctctccctcttccccctctccacgcgccgccgcgccaccgccctcgtgctgtcgtgccgccgcattcgtgaccgccgcgctgccgcctcagtgtgccgcgccgtgcgccgtcgtcgccgccgtcggtgagccgctgcccccctatttgtcgtcgtgccgccgggtagagagggagccaagaaagagagaggaagggagaagccgagggagagaaagaagagggaaggaggagagaaaccggaaaggagagagagaaaggagaagaaaagaaaagagggagaaaggagaagaaaagaaaagagagagaaaggaaaagaaaagaaaagggagagaaaaaggagaggagagattagagtgggccccacgtgtttagtgaatagtaatccccttcttaatctttattagttgagtctattacatgtgggtccgggtggttaaaaatcaaattatagaagttttatggtctcgagttcatgacatgtgggccccacttgttattagctcttcctatttccctttagaaaataattcggtaggaaaaaggaataaacccggggtcccacttgtcaatggatatgtcttggattaaaaataaatcgtttatgaacagtagcttttcgcaatttctcggattaattcaaagttgaatctttacactagcataacttattcattttaactcggatttgagtgaaacttgaacctaaattcatctaaattcataagctttccaatgatatataattcactattcaataaaatatatttataattataaattaattaatatcaaatgattagataatagttaacctaaatagtgtgccaataaataaaaaaaatggatattgtacagtagcataattatctttaatatgtcttgtcactgtagcaaccaaataaattagttataatcaatccttcaaattaatgggtgtaaaggaaaatgttagtgccatttactagcctatgtccgaatataactaattccatgacttataaattatttacataaagtttagcctcatattttgtaactaaaatataaacacacatagatgagtctttaacttgtttaggagagtaatcacagagctagttgtatctggaccacttaaaaaaattagttgatacaatgtcatgtgaagtagaatatatatatatagtcggttgatatccattagttaaccaaatagagccatcttaaaatcaacatgtattgtatagcttacagtaaaaagaaactactcaaatatatgatccaataataagatattgttgcttacacatatactatacatcccattatagtggtacggtatagtattaatttgcgtattgcatatatgaaattaagagggagtgtatgacaaacatgtatattagataaatactagttataaatcttgacctcatataattataattatagttcaactgtaaattaggattattcattgtaaaattatgtgatgggataatctgtaaccatactatgattaacctaaacaattctaacatacaaagcaagggtaattgttaacctttataatttattttgacaagtaaaatatgtacataattaaaataaagcctccatcaataaaataataatacaaatgattcacagtaattatttgaccgatccaaatccatccggcaacaaaacctctagtgtataaccgttctatctagatagatgcatgaatagccatttgctagactaaaccacatagtagccagatacgtatctcattcatactacattggctagctcctaaatagaccaccatgataacagaaagattaagaaactttagcccttagcatgttggaaaccattagcaagcgcgaataatatgagcaaccttaggttcaacctcaacaaatatattttgtttgtgcatatttgattgttgcttgaatattggtttttctcgcgtattatagactttgtgtatcggttagtcgtgaggcaatgtcagcaacttccaggaggtgaaggttgatcaagaattatatcaagaataaggactatcctgagcaaggcaagtcatcactattcctcgaacatgttgatcctaattgcgaaattgttttgtttacaagtaaaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattaccttcgggaaggtaattgagatgcggcatgtggagacatgagcgccacattgccatgatgttgatgacatgatttgtgaaaggagaaataaaattaaaacaactgttttcgactggggcggacggaggatttgggtggtatctggaaaaggctagtaccgtccccagtcaattaaggaccgagccatgaagttaagcatgaaacgactcccgtacaaccgtacttctcgaatgggtatagacctagcagattagatagccgagcggaggcagatccctgcatagatggttcacccctgagtgaggcaggtgcgctacgatgggacagccgttgaggtagggccgagaggcgtgccctacatcggtgttgccattggtaggactgccatgagtgtgtgagagagagaacttaacttgaaccataatttaatatgcgtgtgagacttctctttccccgggagcgccagaactcctctcactgctagaaacatggatgcctagagtgcatgaggatttaagttcatggagcgggtactgccaatgcaaggttatcgaaaagctttgccgtgacgcgtctcatgtgttgggacgaggctcatgtgttgggcagtcgcggagtgcgggtaaagtgtacatccactgcagtgtgagtaaaccagatctattcgaatagccgtgctcgcggttattgagcaccgggacatgtattacacttggctagactctaaattctttaacttgtgtgggatgggatattgcatgatgatttttatgctgatggagccacttcctgagaggcgggaatgtggacgtcctcagaaaaccataacgactcaatggcgggaagctatccttgggatcataatggatagtggacagaaccgtcgttgtttaatgtgaatactggtactaaaatttgatcagtctatgctaggtcttaggcttgtgaaaagaactgcaaaactagctttatgcaaaagaacctgaagccattccttgaaataccctctatcatatgcatcgttgctgtggtggcttgctgagtacggttggtactcacccttgctaattatatatcttttaggagagtgttgaagagaagcccttgtcggtacgcttgcgtatccaacaagatgatcggagtgcggtcttgttctaggtctcattccccagtcgactgcctgtggcatgttaaccgggcccttatattatttggtcttccgctgttgttctctgatagttgttggcctacctggccctaatgtaagtatttaaatcttttagcctgaattcattcgtgatatgttgtgattcaactatgtgtgtaccaactactgatccagggattggtacggataaacacagatgatttccgatttccaaaatcgggggtccacatgacgtccatgtggcatcccagtcatcaaataaattaaaaatagagtgggccccacctgtcatcttcttcctctacctctctcccatcctcccccctcccctctctctctccttctttcttcttctcagcgcatgacagcacgagcatcaccgccaccgcccagctctggcggccaccactcgcgtaatcgccaccgacgccgcgggccgctttattttttaatttagggtgggcccttcactttatttttaaatttatttgatgactgagatgccacgtggacgccacgtcagcgaaaccgttctccaaaaccgtcggaggagtcaaattgcaccgattttaatagttagggggtcaagatatccggtattatagtgtagggatacgaatcagattcgggcactagttaagaaagtcaaagtggacttattccaaaaaaaaatctcaacgaaccaacgacccccgctcgatcagtacggctgcagtacggctgcgtttgttccctaccttttggaactaatccctccgatacataaaacggaacgaccgcattattaattaggtattagctttttaaaataaaaagtagaataatatgattttctaaagcaacttttgtatcaaaatatttttagaaaaaatcaccatgtaaccgttcggaaaatgtacgcgcgaaaaacgatgaagatgagttgggaaagccagtgaacaaactcagccttaattcagcagagaagaatcagattgtatctctacttttagctatatcaacatttattatgtgcctgcttatattgagtaatttattggtatcctctttttttctgacatattatgagaattgattcttaagataatgcgatgtgactctccgtacgtgtttggtggagagaaaaataaatgtgataaatttctacggtagttgacatcctcacctaatgctgtgtcaacttgtgttataatccttttggtcttcctgttaagttcatccttcaccgcttgaattaaaccttttgtgtacctcgtgacaccaccatgaaataattttgatgtacgtttagatctaacaactcaattatgactcattatgatcttgaagaacaactaggattctagcggctatagccataatttggtctgagaaatagcaaaagctacatgttttggtcagtccaccgaaaagggggaaaagcattgactcaagatgtttgtactaatctgtgacaaaaatgtgtttgctgctatatgtattaattcgtgaggtttccttgtctttagctcctaatgcctcgaatgcacttttgatggtttgttgattattatgtttagactttagatattttggatatttctgttggcatgtatgtttagacttagatattttggattattatctgtttgtcaacagtatattttcaacctgacgatatgtcattgtttttttttaacctaatgctgaagtgcaaatctatacctcataaaaaaaatcataaggcttccatagaggattttcgtccgtcgcccagcgcgcacctcctctgcaaaccccaaattatcacacaatccaatccaacccaaaaacaaaatccaaatcaaaatcgaaatcatcacaaaatatcaactcaagagacaaaatatcaacacaagagatgatgagaggagaggaaggagcgagcgggaggccgccgctgctcctcgctggacctctacctcgccgcctcgctcccgtggaggtcccgagctcaggggctagatcctgaaccaccacgccaccgggaagccgctgcgtcaaggagcaactgacccgccatgccaccagggagccatcaccctgccgcgccgccgagagccatcgacccgctggatgtagcgaggagcggggcggcggcagcaccccgacgaggaggaaaggggcggccgacggtgcgaaattattcttatgtgtcaatccgttattaaaagtctaacattgattgtttattgaacaatattataagcttgttgccagggttcaatgtatcagaaaggggggaattttggtggttagaaaaatatgaaattgtggatatttttcagatatttcgaacgaaatattcaaacaaactttaaactctcgaacagaaaaaatgaggaaatttgacaagagatccgtcatttctagcaacttctgcaacaaaacaaacgagggcattcatgattcacaatgaaaaggacaccataggaacaacacacctgcagcttgggctgccgtcgcccatgacacggatgaagagcagttgccgtcgatgtcgccggagattgtggctatcaatgtcttccaaagtgtccgctccaccgctgcgcgccgcatcggtgtggggagcgcccgccccacctcggcgcctgtcgtcgacttcgccggagaggctgctcctccgccgttccaaccgccgccgaggaatagctgcggcgcgccgcctagctgcaaggaagatgtcgcctcgtgaggaaacaatagcaagggaccagggaagtgaatcaagtgatacaaatagggaagagaaagggaggaattaagaattttgactgattttgacccttttgatcaaaatatttgaccggtagccatttccatcggacccctctaaaagaactgaaatttcggaaattgtgaaccttgcttgtggcaacacaagcaatcttcattgtgttcatcttaaaggcttgggtgcttccacaaatcaatgaaaaatcctacttaagaaatatccatcagagaaatgtgcatatgcattaatgttaagacatattgtttcattattgcagaatgtttcaccaacagaaagttcttctcttgtgaatgttcaatagcattatgagatcaattcaagaataaacttgagtttaccttttttttttttactagtgtaggtgctgaattgacatctaagctattagccataatattggctcaacttttacaaatgtaaagaaaatctaaaaataaatatcacagtttgatagaatcaacaatgcatgcttagtgccaccaaaattaatttgcaacagatatttcaatcaatcatgttgtaggtgatctgttgtacatgcatagcagacaggacagtcctgataagccttaatttctatcaacaaccatttcttcctcatactcattgggagccccaaaagagatctaagcaggcagccattgtcacgacaaataatgccatacgctttcagcaaatcatcacaatccaacccaggtatctcttcgagtgccaccaagatctcctcaggagaagccatccttgacacctgcagatttttgggagatgactccaatgctaaaaattgtgacaaattactgctgatttcggttgtaattggcagcttgtcgatgttcgccggcggcattgttgtgacatcgccacagcttactacgtggtcggggattttgataggaatataagtgcatccatatggaagtagccatgagaaaatatcatcgtcgcgcaaaaccgacactagtgccttgctcttcgtgtccatcatgaccttccacatcgtctcgtcgtcgtcgtcgtcgtcgtcgacgcggtgtttacgccgtttgcgttctccgcgcacactgaggtagatgaggtttgggtcatgtatgctcacgatgggtaactgtggattcgtgtgtgggaggccgcttaggcgtcgagggaccagagctcggtggcgtcgatcatggcgtccatggtccatgatgacatgtcgccgtcgttgtccatcctcattgtccaggtgtggatgacgaaggcgccgccggaatggtcgcactgcgtcgcgccgcggcggccgcagcagcatcgcgggaagatgtcgacgaacttgagcgtggctccgccgtcgatggcgcagacggttcgggtgtcgagcaggcaatgccgccggttgccgccgcggcggtcgtgctcctcgtcgaacgcgccggcgggggcctccacggggagcggcacgtagcgcggccggcggcggaggggggcctgctcgtcgaacacgtcgtcgcagaggatgacgccgcggtacaggtcgacgtagcacagccgccggtcgccgacggggacggccatgtcggcctcccagtaggagagctcctcgcccttgccgtcgtcgtggacgatcggcgagatcggcgtggcgctccactcgccggagcggagcacgacgagctcggcgccctccaacgtgtcgcgcctgcggcgcctcttggtgaggagctccgccaccacgagctcgccgtcgccgccgccgccgcggcgcacgaggaggccggtgctcccttcacgcagctggtgcgccttggcgctctgatgcggacgatacgccgttttctcaacctctgacaatgggacccagtaagtcgggaacagcgacaaggacggcggcggacgtggtaggccgtcttcgtcggcgacggcggcggcgccggcattgtagacgaagtaatcgaagtgctcgtcgttctctcccttctcgtaatgcatctcgacgagcacggagtcgccgtgggcggcgacgacgttgatcgagggtccgtgaactctgtgcttgctgcacggcgagcagtggaagcttagctgcgacgccgccggtggcgcctcgaggcggagggagacgcggacgagatggccgtaggaggagcgggaggccgcctcggtgatcttggctccaccggagttggaggtggagtcctcgccatcgccctcgacctcgagttcggcgtagtggttgagcatcgcccaccctgggcagcctccggccgccgccgccgccggcggcggtagggtttccatgagcatcggcgagccgatctaatggggctcgagtggtcgacggagttatggaattaattacacaaagaaaacccagatgagtttatttgcaaaatattccccggccggtgtgcctctaggccctctagttctatgggaaatctgaaacagtataaaaaaacacgaatatcaagaaaggatctaatattaaataaataaataaaaaagatgggactttaaactcaggatgtatcttgtggagctagccgaaagatcactggacgtttctcgaaatctgacccccggacgtttctcgaaatctgatacagatgattttaatttcaagaagatttataactttccgtttgtttagacttcaaaatatttatccgttcaaaaaaagacttcaaaatatttaggattgttttcactagtatttcccaactgatcatctgtcatctttttttttcttttgaccgaatgtcataatgccactttgtcgtatttctcaatccgctctcaaaaataaaataatattgaaagcagtactttttttctgacatttgtttatttattggcagatatatatacggtgtgtgcacacgatagattcctatgatgtcaagtaccgtaaacattaacagcgccacaaacaatcatatgaaaattcttagctattccaaaatgaaaatagttattccaaaaaaatatccatcacatgaacatatataatatagtatgtatgtcaagacaaaactgtttaattattgcaaaatgtttcaccaacaaaaactttctctctgttggatcgatgaaaccacatataccaaaaggttgggcaaaattggtctgaaacgacttggatcgatctatcgtatacacttcttctgtcctaactggcagtacaattacactaaatttcgaaccctttttcatgtttggtagacacaactcctataagcttccacatcaaacttttctttggaaaatgaaatctatcgaaacattcaggcattccatgatgccgaccatcgcatggtcggcttcactggccagtcttcctccatggaggtcattatcagcgtcgacgggtcttccaacatcatacatgccacaaggtagccgatgatggacaatgtccgaaactttctagcctacttgaccgtccgagcttgccgtcgtagtactccagctagccgtctttcagtaggcaagactcggtgagctcgactctagtatgaatgaaaataaaaagatcattgcctgagttgtgtgatgtaaagtgagagtgtctctcctccttttatagcatttaatgacggttgtgaatggcggttaccacccataaccatcattgggagccaatgagaactctccatgtggaaggtgggggcggggggccgtgttggttgttcggcccaaccacttccaccgcctcaagacaccgaccttttctgtgaggctgacatgtgggttcttatgacaatgcatggtggataagcctaattatatcagttttactctgatttatgagcccttaaatccgtgtggtcacgtctgattggccagatatgtgtttcttcgcatagcgggtgattgtgatacaatgtttcttcacatggcaggtgagttttcatacagaattacctgcatacaaatatttcactaacacctgtggaaatagttagtaataaactctaccactatgcccagtgtttcattttagttttttttctgcaggaatggatggcacacttaacatttaaggatcgtcaacaagctatcaaccataatattggacatctaagctatgaaccataatattggcaccattcttccaagtgtaaaagaattaaaaataagaaaaacaatccaccagaatcaacacaatccaatagttaatcacacaatgtatacttagtaccaacaaaagtaatttacaaaagacattccaatatatcatgatcatgttgtacatgtagagcagacatgacagtttagataagccttaatttctatcagcaacaatttcttcctcatactcattgggagccccataagggctttgaatagacggccattgtcacgacaaagaatgctataagctgttagcaaatcatcacaatccaacccaggtatctcttcaagtgctaccaagatctccccaggagaagccattaacacatacagactttggggagatgactcggatggcaaagattgcgacaaattagtgccagttccggttgcagttggtgttgcaattggtatcttgtcgaccatcgctggcaacattgtcgtggctttgctataactcacataggtagcaaagcagtcagggattttgacaggaatacaagtgtatcatgtggctgtcgccaatggcaccgaccgtcgccgcgccaaaccgacactagtgccttgctccttgtatccatcatgatcttccataccacctcttcggcgacgtaatgtgcaccccgtttgcgttcttcgtccacaatgaggcagacgagatttggatcatccatgctcactatggggtgtagtggaaagctccgtgggagggcggagtaggcgtcgagggaccaagctcggcggcgtcgatcatggcgtccatggtccacgccatgtcgtcgtcgccgtcgccgtcgatcctcagtgtccaggttctgatgacgaaggcgcggctcgaacggtcgcaggtggtgtgcttgcccaggctgccgcagcagcagcgggaggagatgtcgacgaatttgagcgcggcgccgccgccgtcgatggcgcagatgacggttcgagtgttgagcagacaacgccgatagttgtcgccctggcggtcgaagtgctcctcgtcgaacgcgccggcgggggcctccacggggagcgacacgtactgcagccgcgggggaatttcgtcgaacaggtcgtcgccgcagaggatgacgccgcggtacaggtcgacgtagcacagcagccggtcgccgacggggacggccatgtcggtctcccagtaggagagctcctcgcccttgccgtcgtcgtggacgatcggcgcgatcggcgtggcgctccactcgccggagcggagcacgacgagctcggcgccctccagcgtgtcgcgcctgcggtactcctcggtgaggagcgccgccaccacgagctcgtcgtcgtcgtcgtcgccgcagcggcgcacgaggaggccggtgctacctccacgcagccggggcggcttggtattggtaccctgataagtcgggagagcgacaacgacggcggccgccgtggtgggtcctcgtcgccgtcgccggcattgtagaagaagtaatcgatcccgtattgttggtacccttccttctggtaatgcatctcgaggagcacggagtcgccgtgggcagcgacgacgtacatcgagggccggtaatgatgagctccgtatccggagccgccgcacggtgagcagtggaagcttagccccgacgccgccggtggcgactcgaggcggagggagacgcggacgagatggccggacgaggagcgggaggccgccccggtgatcttggctccaccggagttggaggtggagtactccgagtcgtcgacctcgcgttcggccgtggcgtagggcatgagcatcacccaccctgggtagcctctggccgccgccgccgccgccggcggcggaacgccggaaggcagcgtcgccgtcgccgtcgcaaccggccgtagggtttccatgagcggcgccgcgagccgatcgatcggagttttggagatcacgtgtttatttacgtatgggtacaaaaacctagatgagtttatttggaatacttaccgcctcaccggcaagccaccccccccccctccccgcggattatttggaactaaaattagttcggctaaaaattttggatttttttctttttttgaatttagcaaaattattcaaattgaaccatattttatttaaatttcaaattatttcggaccgaatttttccgtcgtatcggtgccctccgatagaaagtgccggtgcgatatatcgaaccctgctccccggcctgttcctctagtcctgtcctatcagaaatctgatatatatccttgattttaaatttcaagaagttttgaaaccttccgtttgtttagactataaaatattttggatttttttactgtttgccaccagtatattaccctatttccaaaccgacgatcttgtcgttgtttttttttctttttactgaattactgaatgccgtaatgccacttatttcttattgtatttctcaatctgcaactaaaagtgtaataatattgaaagtaaatgcacagatttttttttctaaaattttcaatggtatttgttaattggtgtgtgcacgaaagacttatgttcacaggatatcgtaaacgtcaatggcgccacaatcatacaaaagtccttggtgtttccttccacaatgaaaatatgtgaggagtatattaacagaaagtcctacaaagtattacaaagaattatccatcacagaaacatatgctagtatatatgtcaagacaaaactgtttaattattgcaaaaatgtttcaccaacaaaaacttcttctctgttggattgatgaagccagatacgaaaagttggacaaaattgctctgaaacgacttggatctatcgtatacacttctgtcctaactgacagtacagttacagtaaattttgaaccccattttcatgtttggacaaaactcctataagtttccacattgaacctctctttgggaaaaaaaaattctatcaaaacatttcaggcattccatgatgctgaccgtcgcatggtcggcttcaccggccggtcttcctccatggagatcatcatcagcgtcgacgggtcctccagcatcatacgggctacgaggtagccagcgatggaccatgtctggaacttcctggcctgcttgccgatgaaccgtcccagcttgccatcgtagtactctggccagccgtccttcagtagcctggactcggcgagctcaatggcgcgcttcgccatctgcggacgcccagtcttgatgcaggctgctgtcagcagccacaggagaactgcagatgggagaacacacacataaacgttaagatcttggaatgaggattcaggtgactttggttgtgaacatcagaatcacatttcgccaactatctagggaacacgaagatcggatcaactttaggaaaaaaaaaagtgccacactcaaccctcaaagggatctgtcggttctgttcaatttgatgaaaacagatgaagaagtcaaaatttcatagccataagcaccttagctacccccaaaaagttagtttttacagcttctgtatgacattaaggatcttacagtataagacttgattaataaaaattattagaacaaagtcattatcagaagaggtgaatgttgaatagtattatgtgatcgatttcagaataaactttagtttacctatttattattgtgtgtgatgaattgacatctaagctatcagccataatattggacatgactaatttttatgaagagtaatgcatagtaaggatcagcaacagaatcatctcaagttagcacagtgcaaaaggaaaactttaacctggccatgatcctccattgtgataactccaccgggtgttcttcgggtcgcagccagtgattattctccattcatggttctcaattgcagggtaacatatcttcagaggcatctcaccaactagctcttcccaccgctcctcaatcagatccattattgccactgattgctctggagtagccagagatgatataatggcaatgcaatttccaagggcaaaccaccgaaagtccatcatagctgggctcacgttgccaaggaagtagcctccccggcatggcatgaaatcaaacacccagtcagggattgaatccgggatgacattgaatttgttcacagcagtgtgtgaatactcctctgttttatatctgtatatgttattcaggtgtgggaaatctagccagaagtaattcctcatgtggtaggttagagcatgtagccgttgccctatcttttctatgaaatccttcccttcaccatctggcttaagcatctgcagagcacatctcaacgccatgtagaatagagcttggatctcaataggataaccatatataccctggaaataatagtagatttaacatttgagccaaacagtcatgtaatgataaggatctcaatcaccaattataaaattgtagttcaaaaagtagaacttctaggaatgagattatagtattatactactacaaatgcctgttagcactattatccatttttaagtaaattcaaactacgtagtatctctttcagagaaggttaagaagacaacgcttatacttgaaacttggaataacaatgcagtgctcccggacattgtgctttgaatatcagatttctgcccgttttattaaaaaaatgttttgaaaaaacagaacttgcttggttctaagaagaaaaagcagaaacattcagcttctttgttgccacatcaactgaactgtactgtttttaatgatacatgtcaagaaataaatcaaatcaaggtgaaagctcataccattcgacgatctatcattgagcagccatctgtgcagagcagagttgggaaggtatcaaatccctcagataagcataggttcagtatcagcctcatgcagttctgacactctggtgattctgccaaactagtatctgccgtatactttgtatatgcccggagtagaatatccaccaaaatccagagtccactggagccaccctcccaattgcactctcaccaaaatctgcaactaaagtttcagtgtttctgttccgattacgatccaccttgaaacttgcaggcatcgctcctgctccaagcttgaaacggtctaccattttctccgagctttgcaggtggagtgttttcaagaggaagtttttcactatatcagtctcattattcattagaaaagccaatgcacttggaaaaaaatctcgcacaaaaacctgccattgtaaggataacatcaggaaagaggtgaagcataactgaactattcatttgattcagggggaaaaaaacattgaaaaaacaagcatgcagaagaatcctagctagaaagcaagcaaagttttcaaagccatactgcttagataatcaaactgaacaggtcatcataagtgctagtaaaacaaacgaatttgctctgcaggactccatgccagtgatgatggatatagttaccatttaacagcctacataatatattcagtaaagctattatattgctcgataatcgacataatcatatatatcaacatcaaacaaaggctaagcatcaaacactacaaagatcctaaacacaccagattactcaggtactgatttcaacatgtataaaccaaacattcaatacatcatacaacaagaacataaaaacgagattcagttttcagaaaccatatgaacaagcagaggattccgatttcacctgatcataattgagcacctcctcggacgcatggtcgacggcggcaatcgtcccaaccggctgcccccggaagtacaccacggacttcctgagagcctcccacgcctcgttcacgagcgggtggggatcaccgagcgtccccagcgagaagggcgagtcgaagcccgaggggaacgccggggagtgcatgatgctgtcgaagccgtcgttctggcggtgggagagctcactccacgactgctcgtcgaaggacctcttcctctccagcgtcagcctcggcttgtcgatgaggagccgcgagagatcgaggttgatctccgcctccgaggcgatggagacgtgggacgacaccctcttcatcctgctgatgacctcctcttcttttcttggtcaaatttgtttcagcacgaatcagttcgagtaaatccaatgtgaaattggaaagacaggcaatgcaagatcctgagaagaaatcaagaaagaatatattcggatttgacaccggacagcaagcaatcaatcgaagaccgtagcaaaatcagcggcggcggccggcgaggagagaagaataccttgaatccgaagcggcggcggcggcgtgttcgccggagaagaatcgacgaggagagagaaaccagccaactaataaaccaaccaatgagagcgtcgccgttcaccgatcttgcggtctagatccaagcgcaagaacggcaagatctcctccggcggcggatgggatcaagagggggagggatcgtggaaggaggtggtggtggtggagggaggagactatccgcatttctggctccggtgagcttactatttatagacagcattaattctcccccatttcctggcgccttcggattttctttcttcttcccggcgaacttcggacgtgccacccacactgttcaaagctttgtcgtctccactttctatcttttcggatatttggcttatccaaaactaatacttctctagtctaacatgaagatttcctcaaatttttttttggaatcaaaagaaaggttaattttttgcaagtttatttctaagttttgtgatagtctcttcggtaggtactgacccacgttaaatgtttttcatggtggaggaagggagaagattgagaagatacgtgtaatgaagtgagtcattaacgtatagttaattcagttaattattttaaaatttaaaaatatattaatatgattttttaaaacattttttctataaaaattatttaagaaaaatatttaatagtttaaaaggcatgcgcatgaaaagcgagggaaatctcctctctttatctacagctcaaacatagcatgagagagtgcattgtagatgacatcatgacagccggcgtatgcaatacttgtttatcggtagtatctcgtgacatatttgaaagaataataacaataaaaaattttagcaccaaactcaatatagtgtaatcctatataaaagaatctaactacgagtaatcgaaaaaaaatgaaagtactaaaaaaactaagggctcttttcaaacgcaggattcttaaacacgcagcattagaatatcatcacgttttttatcttagggaatgaaaaaaaacaaaacagtttgaatggagtaaaggaaaaactgagaggagtatacacaaagaaaaaaatattaagaggttgcagctccaaaattcgcatgaaataggaaaagcatcagtggtgtggtgttggagtcgtgggtgcatgactccagtcaaatcctagcttccacaaatattacacgtatgtaaatgagctttcaacatggttttaatgaaatcttgagcgtgtttcataaaaaaaaatcccataaaacatgcccatagaaatttcaaaagaatcccggagatccaattctttgttttaaaggggctttctataggatcctaattcagaacatgatgataagcggaaaaaagtgggacgccaagacgccgatgaactcaagctgtgaaagtcttcttttagagagagaagaaagtcgtccgaatttcatttccagggtcccgaagaggttcgaaaaggtgtacatgagttcctcctataaggggctcattggttgtcaaccaagtgagagggatctaataaagatgagtacagataccttcaaccgatatcgcttgagaggcatagccgtctcttccaagagattctctcttatttcttaagcaagtatgaattgccatagtattcttcgaggcatgattcaagatccaatcgatttgaagtatgaattgaacattggtttttgcatgtcaataatacactggtagagaaaccatctttggtcggttgcccaaaatccataataatcccggtttgaataagaaccgggactaaaaatgatctttagtcccggttgaaaaggctaacgtcactttttgatctttagtcccggttggtagtcccggttcgaaagaaggcaagctgtgtcagaccccccctatgatctttagtctcggttagttaccaaccgggactaaagatctattttaatcccggttgcttataacaaccgagacaaaagaaaaacaaaaaaaaatcgcaccgcgcctcctcgagaggaccaacagccttatcctctcatccactcatctctcctcctctcccttatcttctccaatcttctcctcccttctcatcttttcatctccttcttctcttcttccccctttctccccttcccctctcctccccctcccctgcggccgcggcagatccctccccgacgcaggcgcggccgcgtgcggcgagcggcggatgcagctgcggcggcgcaggcggcggccgcgcgcggcgagcggcggcggctgggctgcggcccggcggagggcggtggcgggcggcggatacagcggcggcggcgcaggcggcggccgcgcgcggcgagcagcagatgcagctgcggcggcagctaggcggcgggccggcggagggtggaggcggcgcaggcggcgcgtgcggcagaagcggccggcgcggcgagcggcggatgcagcccgtggcgacgactgggcggcgggccggcggagggtggcggcggcgcaagcggcgcgtgcggtagaagcggccgcagcggcggtcgtgcggcctggcggagggcggcggccaggtgacagcggtgaagcgatgaatttgcttttgagaatttgtggtgtatttgatctgtgcgatgtaaatatgtgatgtatttgggatgtttctttttagaatttgtgatgtatttgttttgattatctgtgatgtatttggatatggtggatttgtagatgatcgatctgggatttggagatgatcttttgttatgtgattttggggatgatttggggattttggagatgatcttttgttctgtgattttggggatgatttggggatatggtgaaatcaatattcaaagtaaaaaacaataaaagaaaaaagaaaatactaaccggatgtggcttcatttttagtcccggttggtaacaccaacaccaacctgggttaaaaatggctccatcttaccaaccgggactaaagatcgatttttagtcccgggtatttgaaccgggactaaagatagcgatctttagtcccggattcgtagtcccggttgaaaaaccgggactacagggggttgcaaaccgggagtaaaaaacgtttctctaccagtgatatcatagttgacctagaaaagaagagatcgccatctctctctctcatgttcaatcgagattgtgtgggtgtttagtattgtattctagttctggctggttagagtagaggactcgaaatcctcttaaaatcccaaaaatcttctatttttttcctttaatttcaaacgagtcataactacgagaattggttcccaaggaagtcacggtgcaaaactcccccgtgaaacgtttggaaaattggaaaacgaggtgctaaattattattttagctgccaaaccgtcaaaccgacactaaactttagaagtcccgcctaaccgacactaagctttagatggcccgtatattattttcaacattgctcttaaatgacactaagcttagatgacagattgtttccacggatgataagatttttccatgtagcatatggatttgatttctgccttccctgcttaaatggatttactgatcctcattacctcattccataattgtttggataactcctaataataaagtacagtagtaggaaaactaacgagaaaaaatggcatgagataagggcattaacttttgcttagatattttaagctggaaattctttcgatgtcatcaaggttgaataatcgacaccagccgacgacgatcggtggctgctaaagaccaagaaaaagctactttgtccatttgtaccagctaaaaatattccaaaaaaaaaacgttatattgtccaataacgaaggacatcaagtccaacttttcttggatgtttttttcccgttaaacagtgagaaacgaccaatcatgtgacttgtgtaaaaaatattgtcaaaagttgctttcgcttgtggtgtgttgtgctcgatggttttatgcgtaattcaaaccgtgatatttgatttgtcttctatgtctattgaggatgtttggaacaattccatgattatatagctttatatatactcatataatttgataagataaccaatttcatagatggaagtggaagttgatttctataatttcattttgcgagtgtatgttataaaacctatcttttcctcctaataaacaaaccagtccctcactatccaagtaattttgcatcacacgaaaaacgaaatccataattcgtttttagggggtgcttattagacgcaactatgctgaggatgcagctagagaacacattttttacaataaaaaaccaaaaagaattgagttgatagttttaaatttgaagatgaaagtttaaataattcaaattatgggtagagtttttaaaaagttgagttgaaagtttcaaaatttatttgaaaagtttaaaatattaagttgtatgttttgaattttgatatgatatttttaatatttgagttaaaaattttaaagtttgagatgaaagttttaaaattgagtttcttcaaaattgatgtacagtatatgtgaaacatgcatataattttggggaaaaaaaaaggaaaacatacttatactagtgacgagtggaccttgtgggccagaccaggtggtagcggaggaaaagatccaatttcactccctagaaaccgggtatattgccccccccccccaaacgattaaagtagttcaaaacgactccctcgactgtattgcaggtaatttttgctgccgtggtgtccacatggtagctcagtcattaggaagatgaaaaatagacttgggactcacatataagtggcaaaaaaattgtgagttccacatgtcagcctcgactcttattttcccctctctcctcttttctttcatacaagagcacaacaccctaacagtgggcggtgcaaagcccgctcctcgtcctccccctaggaggtgagtggtggcgatggcggaagaagccgacgagacaaccgtcgccgcacgaggcatgcatgccaggagtcgtcgttgctccaaggacttgaccttggagaatggagacgcagagggcgcgcaggggtgtgatgatggtggcgtcaagtcatcggcgatggcgagcgaggagcgcgaggctgacaacattggtgaagggcgccaatgattggggtccgacattaggctccaccttagggttgtaggctcgttgcagcttcgattaagctatcgggcggtgaaggattggcggcgatgatggctccttcaaatccgcttcctcgtggttgatgaagtatggagctcatggccgatgcgcgtgggtcgaagaggagccggtcggacaggcaccttccctgtcaaagaggaggacagtgcttgctgccagccaccgccacttcccctcgttgtctcgccacctccgccgctatggagaggagggatgagactctctttcctccggggagggctgattggctagcggggagaagggggaggaggagagaggaaggatgaagaagatagggagagcaagggagaagaaagagaagggtcactaatacgtggaccctacatattgacgcaactagtttgattaggtcaacgtgccatatcaacgaaatcacttactatcaagagagtcaaattatattggttttaatagttaggcggtcaagatatccggcattgcagttcaggatatgaatcatattggagtggacctatattactgggagtcaaagtggacttactccaatagcattctgttcatttatcagcccaacaaactaacaaagaagggcttcctgaaatttgacacaaaactgaatttcaggcccatgaaagcccatgtagacctttcccgttaacttttgggccccacaaactgaaatgggcccacccacctctcgtctgctacgtggcccccactaattgcagtgaaaaaccccaaaaccgggtggatttcctccttcccttgcacgcctccacgcacccgtggccggagaagaagacgccgccatggacgccggcgagtgctccagctcccagccctgcgcgtcctcctcgccggacgccgccggtggcgtttgggccaagctaggtgcggccgccctcctcccccaccccacccttcctttttcttgggtttcttccgccgcacgggttcttgattcttgaccttttcgttggtcttgcccttggccattgcttgcactgcagtgccctccgattccgcgttcccggaggtggagctggccgaggacgacgccgtggtgtgctcccgggtcaccccggacggcggcggggaggtggccgcgtggtgcgagattaggcgcggcggcggcgatggcgacgcgtcgtcggcgacgattcggaatctgaggtatctccccttttctgctttgctcttctggactgtgcattgtaggcaagatacgctctttttctgcaatcttgttttatcggattgggggaacaaatgccattcattgatgatgcgtgtttggacgaaggttataaaatgcagaaaagttcgtactgattgcgattgaatgtgagttgttgtcgtttggattatgtgaatcgttgcggtgtggtagcatcgtgttcgtgttcttgatcacctcccaataccaaaattaaagaaaagtttcctgtggataaaaaagattcagatttgctaatgattctaaagcgccttgattttcttatccataactcactttccaaacttctgaacctgattgatcaaaccaaaaatgaacttttgaatcgtgctcatttgaaatcgatagaggcgagcccctggagacagggaagaggcagagtggtcatgggtgagttttttttttggggggtggagggtagaggagaagggaagttcacttctgtggccaaggtggcaggagggtcatgcaggttggaaatgaggaagtttttctatatttatataaatagtttctctatgtgcgtacatcatagccaacctgtgttgcaaccttctgttattccttttatcaaattctcgctgatgttagatgcctgtcttgtcatccttgtaatgtatgtttcattggacctctatcgtacgttaacattatccatgtgccattgagaaagctcggatgcaattattgtcgatggaagagtgatccagcaagaagcagttgacatcaaaccggggagtgaaattgtttcaggaccccagaaagatggtgagataactatgtattttgagtttggcatttcatgcatagattggtgattgtgtatatttaatggtcttctattttttttaagtggactattttatgcctttatgaagccaaatgagtgtttacacatgactctgaatatatgtactcattgagtcattttgaatgtttattgtttcctagacctttctgtttataaagtgaaaaatctatggttgcatgttcgtaattgtgcttccgaacaatttatcaaattacaaatgtttatccttttgtgattccgttatgttgaacaggtgaactgtaccactatgtaatgcatttatgctatccatcttcttgcagggcatctgttgtacacctttgatataacaggcctgaatgaccaggacaaaactaatatcaaggtattttgttgaaatgaatgttgatcaacaacaacctcggtgcataaacgtcactaacttttatttaaatgatgatgtcagattgtgctggatattgagaatgcaaagtgcagcatatgcttaaatttgtggcatgatgttgttactgttgctccatgcctccacaacttctggtacttttgccaattttcctagctatttttgatttatctcaaaattctgattggtgctcatttctgtattccttttaagcaacggttgcttctctgagtggttaagaaggtcttcagctaattcgcgtgataaaagtcagagtgctgcctgtccacaatgtaggacggcagtgcaatcagttggtaggaatcacttcctacataatattgaagaggtgtgatagttgtgtttagtgacttaactcctcaatactgtttaagtgctacctattgtacagctgagatgtttattatagttctgcttttgtaggctatactgcaagctttttcatcgctacagcggtctgatgaggagattgcattgttggagtcatatgcctcggtcaagacaaatattgtgagttaaaaatcttactaagaaattgttgatttccaccattttctcaatggattgtataaagtgttgcaccagtctcttatctgccagcactgatatttgtccctgttatctgccataaaatcgaatattgttttaaaatcatcacccttttttaacttgtttatatattgttgttcattttagagaagtgccttcctcagtcatttgttattagttgctgataaatatttagttttgctgttgatagcttttgaactttaaaaagcttgtagttagccttccctacaaataaaaaatggcagcttgtaattatggacaattcaaggcctttctcatgataatgtgatgttatatataaattgaaggttgcatgagttttgtcataaaatattgttggggctaattttaattactcaattcatatgaaatttaattgtgaaactttatctaagtaggcgcagcagttgtattttaacatttctgctattcagtctatgatgtattttaacctaaaattcacaggcatggcatgcattcatcccttttccatggtcttatgctggtgcgatgattcttagatccaccatggggataaacatctgtcagagggaggtcagatggcaacgactcaaagtagaacagagctaggtgaagtagggtacaattgagggagcaatagatctataatagcttgccatgagagagaccagagctgactagagacttgtttattcatcttagcttaacggaaatgtataatccccatccttgtgataatttgaccctgaagcttatctctaaaataaggaatagataccaacccaatctaatctgttaaatcaactggcatgaacagtacccctgaacatgacaatttgtctgtctgatggataaaatgccttattattagagccagttgagtcacaggacaattaatacccgactcaccaaggttataggtgttttctatgctataatatatatgttgcaagtatatttgttttggtatttaaatgatcagtcccatgattctgagttgctgtcaatgttcataccttaggttttggggaaacagaaaatccagtcaaggaagcgccgtttgccacgttcaaatgatgaagctaaccatactaaccatgctgattttctatgccctcaatgtggtaagtgttgaaatttcatttttaatatttttattcttctttttagacatgttactcaaatgagaaaaataaatgcaggtgctgaatttggtggatttaggtgcagtccaggtgctccacacttgccgtgtaatggatgtggaggaatgatgccagccagacctgacaccagtataccacaaaaatgtaaccgataattctgaccatattacaagattgtaattctataattcagttgttatttgattgattattcaacgtaaccatgtgtgctgccgttatgttaggaactggacatatctatgttcatatttttttcttgccatactaatatgcttggtatcaattagatgagctaaaattatttttattacataattgaggagtatgatagatatgcacgattgcctcaagatgtattttgaagtttgcaggcatcatgagtagcttgattgcaccttttccctactgaatgtttatgaaaattatatcctctgtattctttttaattttctggctctaatctatcaaccttatattgcaggtttgggatgtgatagggcattttgtggagcttattggtgttcccaaggagtgaattcaagtcagcataatccaatctgtgatcaggaaactttcaagatggtaagataatctattacttatatcttttagaccccactgtactccatcatcatacagtacatgttgtgtacttatattcactgtttgacatgttgtgtggataactgcataactttgcagatctctcagcgccatatctctagtgttcctgacacagtacatggaggcaatcaatacgagaaagatgtaggaagttttaacatgatcttatactatcatattgctccttttataccccagatagtagtttcacatgtgagtactgagtatagtattttctcctctctagattacagaaagatgtatacagcaatcaggcaaagcattgcaagctataatctcagagtggatagtgaagtttgacaataaggagcttggtaaccttctatctagttaagctaattttttcgttgatgcaaaatctgattatatttgttatttagttgtagtacatattcatgttgcagttttgcatttcttacatcgtgattacatcatgattgttctagcatacgaatgacctgttaatagcaacaatttacacagtgcctgagttgtgtttttgctttgaatggacaaaatttatgtatgacttgaatgttgagaaggaaaacctacttctggggacaattttctctttgtttagcggattactatcttgttgcacaatggacatgcccccatctgt

SEQ ID NO: 40034 - DNA, 2987 bp, Oryza sativa
gttcgatttcatcttgctcatttatctcattttggacttccaacaaatgcagccaatgctacagcaggttcatcgatttcctgctctactggttccgtgtatcaatgccaagaaatgtatgtatacttcacacagttactaataattactattatcaatccctcttcatgatgcgaatgctttatgataatattaatcaattcctcttctttaaatagtcatatgtgataggtcccctgtattctgaagccacaccatttctgaaacttaacatgtcttacagaaattgttctagaactttcctgtgttccaaaccaactttgttgaatggtgttctaattatttggatggtcaattttgcaacatatctctaaactatacatggaattaatacttggtttgttcgactgcttagttttgctgcacatatattctatagttgctttcatgatctaatcctggactcctattctaaccactggacccttgttgctttctaatatcctgagtagaacaacatataaatgtttcatttaacaatagtaagctcatgaacctgtaaaaatctttgatcgccgctacactgcttcatttattcatagatcataccagtcttctaatattgatggtgatgttctgttccagctccttccacctgatgctgctaacagggagagctgctggtatggtttcatgtgccgaacccagcaccaccggcctgaccatgctaagaagctcaaccatgtctgtcgtccaacaagaggcaacccctagcctgcctcgttctctgaaaaaaatcatctattttcagtgttcaacagcagcattgtacagcaaagagcaagtgccataggctctggtttctcagtgtttaacagctctgtttgattagtaggaatgattgtcaggtacatcaaccagtttcaaatgcctaaactgatacaacctgtttatcttaatctctcctattgcaaccttccatacttatgtttttgcaatgcaacctcacatgctttcaagttgctatttttcgcccatctgcgagtgtttgaacagagggagcagaagagttcttctgaaagagaaaaatgcaactaggcaaggcctggctggcttgaaagcttgatagatacaagaaccagcacatatatatatcctgttaattaattaatcttgaccagtgcctgaaaacgaaagcgcattgcacttgcactgcatggacacaagctgttgctgtgacggcagctctgtcggcaggtcaggggatatgcatataggagcattcatatctgcaaggcactccctccgtatcaaaatataaacactttaaattatttaacaaatactaaaattaagaaaaaaacaattccttccagtaacattagtggttaatttttttaaattttaattgcttagattcctctctcaaacatctgattggctggaaatatatggatttctgtgtattgttccgtgcctagaaatacttatattatggtacaaattctaaacaaatgcttatattcttgggacggagggtgtgtataattcagttctatatatgcctcgctttcacacgcatgagaccaatgttttctcattgccattgcaagattgataggaaaaggatggcgatggcgacgtgttcatgcaacttcaacccatctcgccgtccttgtcggcgatttccccagaatttgttatcacgtcgtcctcaggttactgcagagtttcaatcagtcagcatcatcgacacatgatcaccatctttgacactgcaaatcagccgcaattatatatccgttttgtgtgaggatgttttcatttggtccagtcatgttgagtatcttttgaggtagcatacggcttcttttggcttatggtacatatagatgtgacaattttttttgaggcaaaatgggaattttgttaagcaaaaatgagaaaaaaaaatctggcctctgcatctgccaggaatgtgctaacatgcttagtgcagatttagggtctgtgtccatcaagctttggctaatcttatcctggtgtttgcttgccttttgcaaaaattgatctaccttttaaacttattaaaaactgctgtttatatatgttagtactacatgtaaagctagctagctagctagctgatgctgcatatatattgatacagtaatatacagtaactctattagttttagcagcagcagcacagaaagcaagggaaaagggaaagggcaaacagttgggaatcatggacagggccagctctccatgccacagtgccgaaaaaaaaagtccccaaaaaaatgtatatgcacagttgttctggaatgaaatggagattaatttcattattttgtctgaaggaattgggcgttgtattttttggaattttgttggagcactattggaaggcatggaagaattaattgtgactgtggctttatcagcatcaccgtggcgattggttaaaattgcagaccggatacttaacgcgttagcaacaacactgtacacacaagttgagtggcagtatccctcacctacgctaggtcgctatcaccacttagatatctctaatcccacttgttctcctagctttcgtctctcagtatcagtgcgtcgtcttagcaaagagttatggatataaatatctagcttaacgcagcaaatgaaccgttagatttgtctcaagattctcacgtgactatgatgtatgtgctaacatgacggacaacgattgatatagaaatgccccatatctgttaactttgtattagctcgaccatggcgcccctcttcttgttttttttttaaaaaaaatattattaccatatcattttttcctcctgtgttactctcttcttaattaattagtcttgacaatatgataggaacatgtattttttttaagataatgagaaaaagattctagcttttgcttcatcaaaaggtagagccaaattattacagactttgcagcgcat

SEQ ID NO: 40035 - DNA, 2793 bp, Oryza sativa
ccagtctagagtcttaccgccagagaatgattttagtttagtttaatttaacacaacagacattcttagcatgcaaattgccaaaactgtatcacctcacaaatgcaatatctggagttctgaataacatgtcaaaaatatctgcaagtgtgtgtgatccatttggatgcagaaagtcagagagagcatcacgagcttggagcaatcacactgcaaacagattcggagcgacattagctagcttgcaactgttcaaaaggcaggcaggcaacactgccatatgcatatatgccactactgaattaaagtggcagagagttgcattatctgtaaacacacacatgatagatatagacatagatagatataccagcatatatatgtgtaaagcaacaagcaccgatcgatcacaatcccaagaatatattgtacaccttggaaaagaattagtcaatgatgcggttctagtcatgtttttggaatacacatgatgtattagagaatcttgtagcgtctttttatttataagaaaggaaaattttcaaggaaatatatatgaaaatcctataaaacttctgcgttccaaaggaacaatattgaaggtttactactataagattcccgcgctacgaatggatgctcacgtgaaaccacctaggaattaggatggtggaacaatcccaccgagcattgatatataaacgcatattactttttttaagaacatatgcacctattgcaacaacttaattagaaattatatggagcgcatggttggaggattttatgggttataagtcataacacttagaggttatttttctaaaaaatatttatagaattcccatgtttcaaatgggtgctcatataaaaccattatatatataatgacgtgaaacaacattatatagcattgacgcataagaggcatatatatgcaaaaacaacaattattatatcaaccacaattaattagtaacggcttatagaactcattttgagtactggtagttaggctcacatagatttcataaaaaaactaacggtttattccataatagtcctgttagtgcgtgactcccgtgatttgaacatgtgctcatgtcactaccagtctcacgtatagcattgttagtgcataagaagttaactagctatcatgctcaaccaagaagcacatattgcaagaaatccgagaaatgattgttagcaacaatctaggacatatttggagtcatggattgtatagtataggagttggattttaattttccgcgacttttatgggattctcatggttcagatagattacaggggatgtaaaaccacggacaatagcaaactgattaatgatcatacggaacctagacataaacatatgcaaatcatagcaagaatcaactattacaacaaactacgccaaggattatattagcatcggtttaggtcattaaatatcaaagaaaagcaaccgtttaggttcagctaggagcgtagggttgcatcccaaacaaccgggtgtttgtcattgttaatttcataagctttgtacatgtcgagcacagactgacaacaagaaacatattaaattaatcactcagctaggcttctcaagatcgatccaattggacccactactaatcatcatcatcatcacaaacaccttacattgattaattaattaatccaaaagagcaaactaaaataatcccaggtaaaaaataaggggggtaaactaaagaagcaaacaatccattgattgatgaattgagatgattaattaacgagagcagcagcaagcagttccaaacaccctaatctgtactctctctaatcaaatcatcatatgccatttgcatttgcatttgcacagctacctcccattaacccatcatcacagcttagctagcttagcttagcttagctcagctcactgcgagctcgccgcgccgccagcctcgccgccgccgccgttggcgcggcgctgatgatccatctccgccggcgactgcccctcatgctggtgctggtgctcgccggagcggccgccgccgccggcgttgagcgcggcgagcatgccgaggttgttgttgctgctgttgttgttgtccgccatggtgacgttcatcgccgtgggaaagctgctgcgcgacatgaactggagtggcgcctgcaccgtgttaccggcggcgccggcgccggcgccgtgggggaatgcccatgccggctgcatccagaaggcggcggtggctccggtggtgttcggccccacggcccacattgctgacggggcggttggcggcggcgccgccgctgctgcggccgcacgggccttctgctcggcctcgccggtggcgccatcgacggggtcttggcgtgaggtgtccttgaacaggtcgtcggcttccctgtagcgcttacgcatgaactcgccggcgccgggatcttggggcgtcggctccgggtgctggtgcggtggcggaggagggagcagctggtggtggtggtggtggaagccgagcatggcggcgacgtcgtgctgctgctgctgctggaggtggtggaacggcgcggcgcgcggggaggaggagtgggaggcggcggagcggagggagacggcgagggaggagaagttggccgggatggtgcccgtgccggtggcggcgacgatggccggctccgcctgctgcagcagccactcgatggtctcgccgtccgtcttgtggccgagctcccgcgtgagctggaacacccgcgccgcgcacagcgccgacatccgtatcggggtgcagg

SEQ ID NO: 40036 - DNA, 2172 bp, Oryza sativa
caccaacaacagctgccaccacaagaatcagcacacagttagctaccacgcacatgcagccagcgcgccaccgctcaccggagctatcagaagacggaggaggaggacggcggcaacggcggcgcgggcgcacgtgcgtggcacgcgcgggtgtgggggtggagaggtgtggggctaggaggagaaagagaaagagagaggtgagaggaggaagagagggatggaggtgtgtgtgtggggttggtaggttttggggtttttgattagggctttcttctcttataatcccctcattttgggtcagatttaggagggtttaattggtatatggtattgccttgctggtgatatgatccttgcatgtggttaactaaggaagtttattaatggacagctaattcggtgattacatttagctggcgtatatttgagattcgtggttgagttgggttagtgtgaatgcgttcctggcgataaattttgggaaggttattatgttttccttggtattgttcatttatttctatatctaacattcctgacaattaatcctacctattttattttttcctaagatcgagatattttatccttgttcatcttacttagaaatagtcacgtgaaagaattgttgactcccctcactctagatgtcaaattctcatgtgacaacaacctctccactttgctaacattgttcgtactacattagttacatgttgtgatatctacttatatatatatcgttttctaaccctcgaagacttcaaaattgtaatcccgtaatcccctttagcagtgtattatgttgaaaagtacatatagcaaacgacttcataattgatcgatcgatgacacatgtagtgattattacaccgagaactcttcttttagcaaaaggcaatggattttacagataggttaattatagaccatgatttccatatggttgttcatcccaatgtagcaacaaaatttaatagtatcaactaacataaaaattttaccacaatctagaattccaagtaacatcatcactaagtatgtgatactgataggacttccatatactttcaaaccttggagagctggttgctcaatctctggtttctcttttgcccagctttctagggttcttagatctttaatcatttggagaagagaggagctacatatctagtagcttcaaattctctctagagtgagctaagatagctgtggcatgtgaggggttggatggatggagtgtacgtgtagcagctaggccactcgtgggtcctcggaatgatgaacccaaagggcaagcaaagagggacagtagagcgtcacccttttccctttgtgctaagacacaagctgagaaatattagaaagcacccacacattgccctcatctttgttgctccgatcctcacggaggcgaaaaaaggtgtcggattttttttttgaaaaaaaattgtaaaatggtttgcaacaagaaagtaaagataaatttatgagcatgaataagatttaggggatgatgttggtcaaagatgcacgcaatagctagaactcttgcatagaacaagctctaataataaatagccatcccgtcttattcatgtgagatttataggacacattactgtaacatgaataggtagtcaatgggtgttcatagtactcaagcatgcaaattcaagacttggactagaagtaataatgattgagttacaatttacatgtgtgttgtaaacttgcttttatgcaacacgactggtagtactattatatatataaagtgaagcaaggtgctgttagtgtttgtgtgaacgtatattcgtaagagtatgtaatagaatatcttgtccttggggttcccatgctccgaatccatacagaagtgcgaaattggttataacaattaaaagaaggactaaatattttattctaaaaaaataccatccctttgttgctttctatttatttttttcacaccttttgcatataatttattctatgccacagagaaatacaaacttgttcatatttatcactattcgctaacgtttcacaaaattttgagattgccatgcatgcctagtcctctcctttctcaatgtaatgacgtagcttatggtctgtcatttcttacctcactaagtctttctcccattgatgaacatgatt

SEQ ID NO: 40037 - DNA, 2480 bp, Oryza sativa
ttcatggagtaaggatgcatctggagtgtgtgaacttgacatcaattaattagtagggcttggtattatgtgcatgcatccctcttgcaacaccagtgtgatgtgatgaggtcctctatggtgttggctagcacagaatgataatgtacttgaccctctatccactatgaaatttggatttcttacccacctttgaatgtttgatagttcatgatgtatatcttgtcctatacatgatttggctattgctcattaaatttgcactagaatgagattagattatcaatttttccttaatttgtttctacttgttgatttatacgagtcatattttttatagaaaatgttctcagatagtactcaattaattgtttcataatgttcagacgatatcatttttaaaaccatcgtaaacacactaccatactcttatatcattgataatacagaataacgacataccgggtatatattctcgttggcatgggttatactaatttttttttgccatgggtagaataacggggccgtgaagccaaggggagacattgcaggtgcggggtgtcagaggggagcatctaatgctgctgacagctcatcccaacagcaccaaccaggtctcttcactcactcacacaaacagtaagtctcactctctcttatctcacacacagacacacagagagagagagagaaagatgagccaacagtggtatacagtgctactcctgtcctctccatttccaagaaaaacaacgatcaaccatccatcatcatagattaattaattaatcaatcacaggacgatccagtagtagttgatgatcctagctagatactagtactcctccagctagctagtgtgtctctcctagtagctggtacagccaataaaacgctaaagaatgaccccggtgtacgtttgccatgcagctggccaatttgctcctcagtgctccaacatcttttgtttttccctttttcttcagtttagacactactccctccgttcccaacaaaatccaacctagtttagagatgagatattatctagtccaacgaatctgaacaaacctatatccaaattcgttggactaggtaatatcccatatttaattaggttggttttttttagatatttaactatttgccactcttacaagtgacaattagggatttaccactagggctatatatcatagacatatgaagactcacatgttatagactgtgagtagcaaatccttaattgttacatcttaaaagtggcaaaaagtaaaatgccatgttttaatgagggagtacccctctctgccatgtattttctccatctaaaaagagtttaattctaactataaattcgaataacatagattttatgggacggcgggtgtagatctctatagttaatctactaccaatagtttgcataaatgatactttctccatttcatattataagtcactttgtttttaagtcaaacttctataagatcgaacaagtttatagaaaaatatagtgactctaataacaccaaattagtcctactaaacctaacattaaatatctataaacttagtcaaacttaaaaagtttgacttagagaaaaataaacatcttataatatgaaatataatgagttagtgaaattctaacattaaatatcctatagagattttcgataaaagttagcgaaattctaacctcttgaaaaaattccttatatctctcttattcgaatcatgtgttttttatgtctatttaaatgagcattttctatattatctatatgttttataatcctttgttttacagttatattcgctttcttcgttttttttctaatccttctattcaaatgagcccttaggaaggcatatctagattatatgctaacagtactacagttcttaaaaagcaaagatactgttcctttttaaaaagaatagagttccatggaatatcttgagctatctagctagctaagagtgtagctagtttgacatacatgtgaggtgtgagatagagaacaggcgtcgtgcatagttgcagcctagcttaattagctccatcaaccattcatgtagggtactcatcatatattaaccgtttgaggataaaacggagaagaataatgatcatatataaaacgaacaacaaaaagaaaaatgcatcagcctatatactttcttgatttattaattcaatccatgtgcatcccatctattgcaaaaactgcttgaagagatccaagatattttttggaatatgaagaattttctggggcttctagatttaggatggaaagaaccttcttttaattttacgacataagaaactttatgtagaacacgcccctcataaagaaacgaaaccataacatgaaacacaaatgtcgatgaagaaataaagccaaaatacgataacgaaatgagctgaaatcaagcaaaaaaaaattttttttacaaagacgccatag

SEQ ID NO: 40038 - DNA, 6012 bp, Oryza sativa
tgtttaaccattcgtcttattcaaaaaatttaagtaattatttatttttttcatatcatttgattcattgttaaatatactttcatgtacacatatagttttacatatttcaaaaaaaaatttgaataagacgaacggtcaaacatgtgctaaaaagtcaacggtgtcaaacattttgaaacggagggagtacaagagaaggcatcagtagcatgtgcacgcacatgcacaattgcgtctgtacattttcgttgaagattcagagcttttatcttgaaatgttcatacaaccgctgaaatttaatacgccataaaaaaaagccaagagatactttatctgtaaatcttgtgcagttcaaagtgaacataattgttcgatttcttttgtgcagggatttgttgaatgtactcatctcagggcctctgattcctcaattgggaggactgaaaaatctccagtacctgtaacaatttcataacacactttgcttaggacatgacagcttgaactcagatgctgagttgctggaaaaatactaacagatcatgtttgcagtcagttgtatgggagtcgcctaaatggatcaataccagcaacactggggaagctgaaacatcttgtgagccttgatctttcgaacaacctgctcactggcgcgataccaccttcgcttggcgccatcagcaatttgctaattctgtatgctattttttttacaacaattttatatgccgaatggtgaagaaattgaagtaaaatccggatattgtttgaagtgccaaaatgaatgctggttatatgcaggaggttatctgggaacaacctgacaggggctatacccccatcattgggcaatctgaagagccttgagatcttggagcttggcaataatgcactgagtggctctattccagcttctctcggcgatattgaaacattgaattacttgtatgtgctcatttctaaatttctcattgataagttataatatatctcctcctcaaaaaaaaaaaaaagaacttgcaagatgtttttaacttgaaataatattcgtttgaatgaaaaactaataaaactttaaagagattataaagttgcagaaatgttgatagaaatgctactagaggagactctggtataagaactaagaagcgaacgaaagcttataaagttacaattctgtattaaaaaccttgaagtatacagctttgatgtgtaattgttctcaaataaactgaacgatatgttttatatttatgtccagagatttgaatgacaatatgctgactggcaccgtgccattggaaatcctttctcgtcttgtcaccaccttggatgaactgtgagttgcatacatgttattaacatattgagttattacattccagagcatctgtgtccggcataattcatgccgagacatgtttgcgagagaaaaaaaaaaacatactgagacaaaactaaatttccatacaggaacgttgcacacaatgatttgtacggcacaaccaggaaatctgtaaccagaggtatatatgtatcattctaagattttgcattttctttatacatacatgccaaatgtgtgcttacataaacttcgaattgtcattcttgcagttactaccgtagtccatgacatgccgaaaacttcaaactgagtccagggacatgattctgtactatttcaggcatatttttggaaatgaaggaataaaataatatcgcattaccatatgctgaagagttttttttttccttggcattttgtgtttcccctgtggagcatatgcctgcactctacgcagaagcaaggctgcgcgcctcaagttacatcgtgtacccgagatcggaacgtgtgggatggcactcgtcgtgaaccaatcatggcatgtatgcaggagctcgtggctatgggctcctcttattttttccataaattggcaatgagatagaacagaaaagctgcagcaaaacagcagcaccgcgatcactcgtgttgttcattgtgctctggagttcgagctcgtgcgtgagttgaaaaatcgagcgagagaaccgacaccctatgtgctcactgaagtgctgaacatgtcctagcttaatgttcactttagtttgcaataggttggaattcaaactttgtgtttactgataaggttattccattattctattccatacctacatcaatcatttctacaacttcctaataattctaaagtaaatcagagaaaacatgaatacatctagttcacataaacatgtctagtttaatttatgcttcagatgaaagggaaactttcacctcggacaaatgcagttgttactaattaatactctagctgcaatttgaaccgaaccaaaccgaaagagcattttcctgttgttgttagtttcttcttgagttttgattttgtgaattgctaaaaattgtcaagttctttaggcagaaaattttcaaatgtaactatagtattattgcagtgtaattacattttgactataggcaaaatttgctacatggcatcgaaaaaacgtgtaattggctggtggacatcgcaagaatgagaatttactgtcaggcataaaaaaacgtgtaattagctggtggacactcacgggcttattttattatttccggtggatttggagagagaaacactggtgagagtacgattttgcccctgtcattgttccacttacaacgagggagcgagaaggcgagcaccgcgtggtggattggattcgattcatccccgcaaaccttagacgctgatccccccacttcatctccgactcgatcgccgccggtcgccataccgtacaagcatgtttccgtcgtttctactccgggcactctccctcgccagtcgcaaggcggcgtgcccacctcacccccgcgacctcgtcatgctcgccggcgcgcacagcgcaagccaggccaccacatcctgttgtcgtcccttctctaggcgctctccagcggcggcgtcgacggcacgaacctggtgtcacctaccaccactacctctggtggcgacacatggtcggaatcgggatatctacgaagcccgctccttggcagatcagcctgccggtgcgagcgcggaaatcaagttggggtcagatttggtggcttcggtgaccgctcgcgaagactctgctctcctccgtgctcgtcacctcttgaacaaggtacaagtccaggcagagcaacatcacctcgccgtgcacgacggctacgggggagtgagactggactgagtcttggttcgaaccagacacagtctactgtaagcaaaacgatggcaggggcaaaatcatactctcactagtgtttctctctccaaatccatcggaaataataaaataaggccacgagtgtccaccagctaattacaccttttttttatgcccgacagcaaattctcgttcttgcggtgtccacaagctaattacacgttttttcgatgccctgtagcaaatttgccttgactatattgtaactattatatgattgtagtgtatttacaccgtaactacattataacttctatatacaggttatttaagttatgtgcatttttaatagttatatacaagttatataaaagttacaatttaattatattacaatttgttcttcaaaacccagtagaactgcgattcatttcattaagaagaagaaaacaaatatttacaccggagaggatcaaagatcacccctccctccaaacaaaaaatgtctcttaattacattacaattatactatactatagttatgtttggcatgcggcagtatttaggtagccctttttttcttgcatagctcaggatttcgctttcggctcggtgttcaaaggtagaaaactgatgttatcacataaaccgaagtaggctatacctctccatgttctgtgcagttgcccctgtcaaccaagctcttgcgatcaatcgctcgcacactcccctccatagcccttccgccctcactcggtttaacccaagaaccgaagaaaccgacctggcctggaatagtttggcttttaaagctcttttttttccgacaatttctcaaaaaccgaacttcctaaaaaacgaagaaaatgactgaaaaaaccatagaaatctactccattgtagtaacacaaacgttatatgctttatgtaaatgaccaggtacaattttagattgtggtaaaatatgttgagggttaaaatgaagtgcatggtaatgagaattacaaccattaatatccaaaaaatatcatttactgaaacatctactcacgtgtttatatagcaatcgaaccaactagggggaaaatgaaaaattagaaaaatgaaagaaaaaaaaggaaataagtaataaattttattgtttaccaaaaaacaatggatttgctacagttgttggaaatcttcacatgaaaagatctcttacaagttaaataaaaaaaatcaaagcaagtagcataacaacgttgcatgatacctatatttctagaaaataataaggtacttaatgaaactgaaggacacctttcacaactcattgtatgtttttcaaagtaaatggataaaaataagtatgagtacaaacagacataatagatataaaaacaaaatcaaaattcattaccgtaagacacatgcctattacaatgtgattttctgctcgcttattctattaaaagtagcattagtacttgtagtcacatcaaaattctcaatccaaaagaaatctgaatctgtacctcccgtgtagttgaaagtatttttcactgattataaacaaaatcgacaacaataggaaagaaaggttcttcttatttttcatctgcttgcttgtctaacagacatatactaggctgcattcggtagtgagctttcccaacatataccctcgtttttcatgcacatgtttttcaaactgctaaatagtgtatttttttcgcaaaaaattgcaaaaaatttctataggaaagtcacttgataataccatattaatttatttttaaagttagttttagctaatacttaattaatcatctaatgagttgctttgtttttcatgccgaagggggaaagttcccagtcagagcaatgaacgcagcctagtatgtttgataagttagttttacttaattaatgccaatgtactgtgatactcggcagtataacagaagcatacacatgaacaatctacaaaataaatgtgtctaggtatagataaaaaaaaacccttttttctacttgaaatataaaattcctgcaggaaaaaatggccagaaagctccattgactgcaagacttggacatatgtgtcattggaagcttctatagaaaactttctgattgcttagatgacaagtacttcctccatccaaaaatataaacgtatttctagaatagactttgactaacaattactctaatacgatataattcatacaacataaaattgatgccatagattcatattcaaaagtatttatgattatgcttttgtagcacacaagtgatgtagagtaattgttggtcaaagttttatcctacgagataaaataagctttatatttttggacagagggtttatgttcatctgaccggcttcttcttttaccattgaagttaacctaacaaaagataagcatttatggtcgagagtcaatccaatgggtagtaggagaaagaattgttccatggtttccttctatggcttggtattggagtatttgaaactttaacaacttctgaaatagaatatgaaatgacagtacatggatgtttgcaattagtcaagtggtgcacagttgaaagtagatgtatacttttttcatatatattttgttaatagcttcatatatatgtttgttaagagattcgtatatatatcttaagagtttcatttttgcatatatatttaaaattatgactattttgccataacccatgcatttgatacttaaattcacgtatatatactccctctggttgtaatgtt

SEQ ID NO: 40039 - DNA, 2757 bp, Oryza sativa
  unsure (1)..(2757): unsure at all n locations
tgcagttcaattcaaagtgcgcataattgttcgatttcttttatgcagggatttgggggatgcagacatctcagggcctctgattcctcaattgggtggactgaaaaatctccagtacctgtaagaacttcataactcgctctgcttcgaacatgacagtttgcattcagatgatgaattactggaaaaatattgataactcatgtctgcagtgagttgtacgggaatcgcctgaatggatcaattccagcagcactgggcaagatggaacatctagtcagccttgatctttatagcaacctgctcactggcacgataccaacttcgcttggtgccatgagccgtttgcgatatctgtatgataatttcacaataattttataataccgaatagtgaaagattacggtgaaacttctggatattgtttgaactgccaaaatgaattatggttatatgcaggaggttatctcaaaacaaactgagaggggcaatacccccatcactgggcaatctgatgagccttgaggatttggagcttcacaagaatgcattgagtggctctattccggcttctctgggcaatgtcaaaacattgaattacttgtatatgctcattcctaaatttgccaacagagaaattacgagatattttttcaccaaattgggaacctccaagatacttttaacttataatagtagtttttgtttacataaactacatcctccaccccaaaagtaataagaaaagattataaattttccttttttaaaaaaaagattttactagaggaaatagtcatatactaggttttgcacaaatctgtgatataaaaattcaggggatgaaagcttacaaaccagtattaaagaccttcaactagaagcatacaactttgatatgttattcttctcaaatcaacagaactatatatatacctttttaaatttgtttgcaggcggttgaatggtaatatgctgactggcactgtgccgttggaaatcctctctcttcttgtctccaacctagttgaattgtgagttttacatgcttgtttttcatgtattgattagttaaattccagagaaacagtcctgattaactcatactgacaagactaaatatttcgtacagaaatgttgcgaataataatctggatggcacagacagagaatctggaacgagaggtatgtatcatttgaagctcttttggctgcgtacatccatgttgaatatagaggccgggttttaatccattttttataaaaaaaacattttgaagcttttgactttttctttatatacgtgtaaaaaaatcagttgtgttgattacatgaactaccgatcgacaatattcttgcagttactaccattatccaggacatgccgaaaactgcaagttgaatccaggaatccaagttcaagattttgtatttcaggcacattttggaaaatgggataaataaaaaaaataatgatccctcctgtgctcactgaagtactattactgaacatatatctcctagcattttaatgttgactaggagtgcaatggaaattatggtgctaatatgtactttctctgtttcacattataaattattttgggctttaatagattcatgcatcgatacatgtatgtacttcatttatgtgttcaaattcatatgaatgttagtgaatcttgactagagatagagagaccaaaacatcttgtaatatgtaatggagggagtagttgtgtgttttactgatcatgtgcctctattccaaaacttactaatcatgtatttcctaaaaattcatctatgcggtgaaactgagaattattatggtttcaaattaaatagtagatttcacttcagactagctttgttacccatatttagtctgaatgagagttttacaaaatttaatcactttggacccgtttttgttacaaaacagctgcagctcgaatctgtggcccacctgtccaagaaagggagaaacatatccatgtagaggaaaacatggatatacggtgtaaaccccaacttaggtgaaaaatcgtgcaaaccatgaaaaaaatgtcaattttttggaagattttatttcatggtttatacaggttttcaagtagggtggggtttccaccacggtcaataaaaagttgggatttccggcgtatattttggtcacatgctgttgtttttgttcccctgtttctagtcctctgtttttcgcatggagagagccccaatcctcatgtaaagtagccaaggagaggaacggcagattttgcagcccaagggctctctctgtgtcattgttcctgttctgatctggatctgaatttaccatttaccgtagcaaaaaattattatttttacatatcttgtatcagcagatgtcgaccatcggatcaaaataccgatgattcacatgtcaattttaggggagaagatagaaatttggggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40040 - DNA, 11344 bp, Oryza sativa
acatcaaccgtaaaacgatgcactcaagaatagcttactgttggaatgtgccatatggcgtgtaagaggattagaggaatcccatattgctttatcacagtttacttaagaaaagaattgcattttctttctatcagatattagctagttaaatgcaactaatcattacatggtactccaatgttactaacttaaaaaaaaggtactaaccttgtattaatggtttttcttaatacaagcccatcttttgtggcttagttatttaatactaaccttgtcttattattattattattattattattattattattattattattattattattattattattattattattattattattatttctgtggcttgatttaacactaaaagttatttaagcatcatataaaactaacaattaaatgttttaaaaaactcaatgacgccatctaataaaaataaatttaatataacctaatgtcaatagctaatcttacacgaccaccaagaccacattctgaaataaacatatatgccaaaaccatataaatatgaaaaaaaatctaataaatatcatcaacaaacgttaagaccatcgacaaacacaacttcaaaaaaataccattatacgagtcaatttattccgaaataatattgtcgttagagtttcaaccattccactctattaacccatcacattttaatacgtagaattgtacgaaaccttttgaacgcagaggaatgtatgactgtatgagaccccaagatcatagtatttatatggcttttacaacggtattttctaaaagtcatgatggccaatggtatttcgtgcatttcttacattttctccatgaatataacgcttaaaaaactgtacctcactaaaaggaaaaaaaaacatatatccggagacaacgacatgccttgacaacgaaatgaaacaacgaactcaaaaaatcgccccaaagaaaatgaaagaaaaaactgatttattttttctttttccagattggcttcggctccttcttccatcgccgtcctgttcaacgttcaaacccttcctcctcccgtcgcctagtcgccattggcgacctcctcctcctccacctccacctcccctcccttaaatccctcctctccccgccccacctccctccccatccacaccgcaagcaagattcccaagagaaccatccatcatcttggaatccaagaatcgcccgccaagaacagccaagaaccggaggatttccgcgagggagggagctccaggaccctatcaatcggggattcggtgaggggggaggaggaggcgggcgagatggtgaggctgccgtacaccacggcgctgacgacgctcttcagctacgggctgctcttcgcgttcggccagctcagggatttcttccgcaagctcatcgattggttcaaggccaagaacgtcaaggtagggcctggcgaaaatcgctgcgggctctctctggtcggatccgggtgtttctcttcgtaattcttgatgagagatttggatttttctttttggacgcagggctacgcgccgatctgcctcggcctggaggatttctacgtgcgccgcctgtaccttcggatccaggtactcgctttggatcgacgcatttgcttgctcgccttattttggtttaggaaattctgatatgctttagagattaattgaaatgctcgctgtttatgcctcgtagctagaaatgtctgagttgtatcggcgattcgatgaatgttttctgtgatttggggtgggctttgtgacgatgagatgggggaattgctggttccggaacacattttgttgcattttcacaaaatgttgcattcgatattctacgagtatatgggagcatgttgggggaaatttctgattatttaggagtttgggtgagtgtttattattgtggagaagattattttgtatttttttaagctctgtgaggaactttggatgcaaccccctgtctttggagctgaagcaatatgctggattctttcatggcttgaaataatctcattatctgctgacactaatatgtaaataccaactaaaattgtagaagattttagttccagttctaaagtgctggttttctaaaataattggtagcataacatgcttgatgttcatgtctttttttacttggctgtttgaaatgtgtttggcctgaaatggcaagggccatgttatctacttcctgaatatatgtatgacataatccaatcatgctgctcatttcaagtgttttacggatttagtccaccgcacgctaaatgtactgtactagtcagtattggactggattttgcatgactctgttatgttgcaaggttatctccttcaattatttcagtgttaattgcattggatattaaccaatccatatttatggtttcacaggattgcttcggtaggcccatagcaagtgcaccagatgcttggtttgatgttgttgagcgctactccaatgacagtaacaagacattaaagtaagcacttcttcttcttattgttatcattctaggatagagcttgagcttaagacaattgggctgaaaaaattacgtgcagttctgttatctgggcatttccacatgcagctgcatacttggtgcattgaccaaaacaaaaatcagctgatcatgcaggcaaagtcaacccacctgatctggacctatatctgtacaaccttttaagctatatatactacataatgaccataatcaagtttgtcaatatgcacttattggaaagttgtcggttgagcttcaatgatctgttctgacatatagatgattatgataaaaatatatgatccaaaaataaatgaaatgaaaaacacgcacaagtttcaactgttgtttaaactccaaatattgtttcaggcgtacttcaaataccacaagatgcctcaacctaggatcctacaattaccttggatttgcagcagcagatgagtactgcactccacttgtgatcgagtctctcaagaaatactcacccagcacctgcagtgttcgcgttgatggcggtatgcctggatgcttgtcatgcttttttttttaaagaactgcagtctgtaggcaccatgctgattccttttatttggcaacaggcacgaccaaacttcacactgagttggaggagttggttgcacgctttgttggaaagcctgctgctatcctatttggcatgggttatgttacaaactcggccatcattccttgcctagtaggaaaggtacaatcaaaacgtcaagtggttgatctatccagtaacagaaaacatgactaaacttagcagcaattaacatgactaaatttcatgttattccagggtgggctgataattagtgactcactgaaccataactcaattgtcaatggtgcaagaggatccggtgcaaccgttcgggttttccagcataactgtaagcttttatgcctttatgcaatgcgaagcaatattcactgtttgtggttcacaaggacttatttgtcagcatgctgcttacagcccctgctcatttggaagaggtcctgagagagcagatagctggtggtcaaccacgcacacacagaccttggaaaaagatcattgtcattgttgagggtatctacagcatggaaggcgagctgtgcaaactacctgagatcatagctgtatgcaagaaatacaaggttcgaggaaatttcttctaatttacagtttaagttctgcgcataaagcagcttaattagcttctcaatcaattagcaatctatatgaagtgcaacatcgagagttgaccatgttgaattattctttattctgtaaaataggcttacacttatctggatgaggcccatagcattggcgctgttggccagtctggtcggggtgtttgtgagctccttggggttgatccagctgatgtggacataatgatgggcactttcactaagtcatttggatcatgtggtggatatattgcagcatcgaaggtacatcttcagagcacttctttcagttgcttgaattgaaaatttactgattcaccttgcttgaactctcaggagataattcagcacctgaagcttagctgcccagcgcatatttatgctacctccatgtcaccaccagcagtacaacaagttatttcagccattaaagtgatccttggagaggatggctccaacagaggtactagccttttcttctgcttcgaccctttcaatgcgctgcaggctatccatgtaagttttactttcaattcttatttattttggttttgatgtcttgcaggtgcccagaaacttgcacgcatccgtgagaacagcaatttctttaggtcagagctcaagaagatgggttttgaggttctcggagacaatgactctccagttatgccaataatgctctacaatccagccaaaattccagctttttccagggagtgccttagacaaaaggttagtaatggtatagaatgctatttatcttcagaaatggtacagaataatggtttttgccagttttttgtcgttccctagcccctattaccgtgcgactgatgtggcactggcatttcaggttgctgttgtcactgtggcattccctgccacacctctgctccttgcaagggcgcgcatctgcatttctgcttcgcacactagggaggacctgataaaagcccttgatgtgagtgctttcgtttgttaattttcggctgttcacatatgtttaaacggattccaattcacattgttctcatgtttgtaatccactcacgttatcagcagagttggtgatcttgtgggcatcaagtacttccctgcggagccgccaaagattgctgaagctgatcacgataagctggagtaaatgatgaactgggttgccccattgaatgctcaagttgctggaatctggtaaacaaggcgcatgttgttgattggtttcatcggtttgacttgggattttgttgatacctgagaatccagagcctgtctcattagctgactactgttggttgtacaatttacacttctaaaatgtgtatagctggtcgaagtttgattgttctattgttaatcgattttcttcatgtaatacttgatagacacaatataaattaaatttatgatagaacatttctattgatttctgtggaaagttgaagtaaccattttcagcaaatgaagcaatgcttttcatgtgtttctccatattcagtcaatgcggtatttgagatacagcagatgcatatgtattatgttgtataccaatctcctttacagcagttctttggattgcattatttcacttagtattagagaaatatatactggagtttctagaacctttgtaaatacgatgttaaaatataaaaacgggtagtcactggaacaaaattttcattttaattcgccttgcacaatcacctaaagtttaatatcatttgacttaaattcttgaaagtctatagtatataccaccttttcatattaaatcgttttgattttttttaaatcaaacttttttaggtttgacaaagtttatgaaaaagtatagtaatattttcaaaaaaaaaatcaaaatatcaatatgttcaacgttaaatgtaataaaactaatttggtacttaagcgttgttaacttcaaaaatttgaagtaccttataatatgaaacggagtgaggagtgttaagggtatgttcggcaccccttttcccaacccctcttcctcgtttttcacgcacacgcttttcaaactgctaaatggtgcttaaaaaaccaaattaatccatttttgaaaaaaaatagctaatacttaattaatcacatgctaatggactgctccgttttccgtgtggagggaatgagttcccatccggtagatgcaaacacagcctaaatgagttctcatataggtggtgtttagatctagggactaaactttagtccgtatcatatcggatgtttgaacactattttggagtattaaacatagactaataataaaactaattgcataaatgagagctaattcacgagtcgaattttttaagcctaattaatttatgattagtaaatgtttactatagcatcacataggctaatcatggattaattaggcttaatagattcgtctcacgaattagtctaagattatggaatgggtttttataattagtctatatttaatactctaaattagcatctaagagcctgttcactttgatgcaaaaaaacccttacaaaattttggcatagttgccaaaattttggcaggatttcttatatagttaccaaaattttgcagcaaagtaaatgtagccacttttttggtaactttactaaaacttggtaaggttgaaaatggcatcaaagtaaacaggtcaataggctctaaacatccaatgtgacaggcacttaaaaaagatttagtctacacaaaaaaaagaaaaataaaaaagagaaattaggaaatgaccaaaatacccgtaggcatctcatcctctacccttgcctcctctctctctctgttttccagccgcctccccccgcttcgcctcccctcccctcccctcctctcgcgcgccgccgccggcgagcacgtcaccggaggcacggcgcagacgagctcctctcctctcctctcctctcctctcctccccgattcctccctgctcccgccccccgccctccgtctcggttctattcgaatcgaatcgaaggtaaactcatcctcccctctctctccctcttcctcccatatgagcagatgtgggagattcatcaggacatggatttggattggtttttttttagtactgaaacccccatttacccccagcaccaccacgtgacgccccctagttcagatgtgtcgccgtttgcgcctaagatggcagtggcagagtgcagcaaagagttgagagatgttagttcgccatatcgtcaattaggatgctccacggagctctcgtcttgatgttagtacaaatttagtcgaaagccattctaatgtggcggtgcccctgggctatttattgggagcaagggggatttgctccattttgttacctctgtacggtgtctttaccaggaatttttagccgaaaggaatcccgcgccgccgattttaagcgctttgaatagatttttggttatagcctcgaatcgctagtaatattccctgcgcatcttcgacttatgattcatcacctgcggaaacatgtgtaggtctgattttgtgttgcaagagagtgtggaaaggtaggtcggctaattcagtttgtttcagccgtcctgtgtattatattgtggtggttggttttattcggacctgatttccaatgactaccctggttaatatggttatgctgtatagcagtattttactacctatgtgtattcttaacacttcagaatgaataaaatcaatctatgaatgtgtaagccaaaacttaaattctacactacagctgtatagctgtagtagcaactgtggtattgctaaagaagtctgtatgttggatcggaaaatgtgaaaccagaataatacagtccagtagtccatatgttttctttctgccttttcttataaggagtaaggttatcagccagattgtaagtttatttctgtgaacatggaacttgaataggcatatgatctttcacaggattgggaatttaggatataccctaatgaactacaacctctaagcagcactgccttcttgtgtgactaattaagcaactattagtttgattcttactttcatatgatttatcttaaatggccatgactgttcaatatgtgtcttaccaggaattagtaggcagggattcatatgactgcctcatttgtttttttgttacctttgtttgctgttcaatatgtgtcttaccaggaattagtaggcagggattcatatgactgcctcatatgtttttttgttacctttgtttgctgttcaatatgtgtcttaccaggaattagtaggcagggattccattcagattttgagtgctttgaatagactggtgattagcttcaattctctagtaagattccctgagcatgcgcaacttatggttcgtcacccatggaaccatgtgtaggccgatttttgtcttggcgaaagtgtacaagtttcctaggtaggacagctaattgaatctgtttcagtcgttcctatcaattgtatcatggtggttttttttttaccttgaatccttgttcttatttcaaataaccgtgcgttgcttatatagttattttgtacagttactattttactacctatggtttgtgctgacatcggaatgaacaaaatcaatatatgaatgggtaagtcaaaacatagaaatcctacacggcacttgcttgatggggtattaccaaagaattctgtttatgaaaacagaatacagtccagttgtccatattttgctgcttttgcttataaagagcaaggttgccagccagattttccctgcgaattcggaaattgaatagaagtagaatctttcacaggattgggaatttaggatgtactcccatataatttaatcattttaacttccgtacctgtggaagcatgaagatcggtactctgactattgtgtcatcttttatttcttatgaagaactacctatctctaataatgcaacaggaatgtggaagagttctagatggaaccattatacatgggtaacaggggattaataggcatcactcttcgtctgttttctgtagttcatatataccttcactttgcgctgcatattaggctctactcatggtcttaggaatggtatttccgagcatattttgttacatggttcaacaatctcacttaataagttcaatggacgaatttgaatatacatgatgatggagatttgttttctaatggagtacatctgaatgtgatctttgacttttgttgtcttttcgtgtgactaataatcaactactacttcgatccctactttcatattatttatcttaaatggtcatttgactgtctttttcttcttcatattataccatcctaccttcttttgtatgattgggtggttctcgcatgttttgcttaacattggagaacttatgctcatttatgactgggtggtacatttatgctcatgcaacatttgtgtggcagaacttgttcagcatcactccttaattggcttgacatccaccgtaatgtgaacattcattatgatgatatcaaaggtcatgcatttgttaccttttttttttttttgcttttttccgaggattcttcttattactgaccattatctcctaatctagttgttatgtagtgtatttttaggaactggatatttcttccatggttaatgtccagaaccatgataatagatatttactagttacatttcttttcgtgtatagtgtaagaagaattgttcagcataaaaacttgtagccttttctgacatccttgcatttttttaattccttttgaataggttgtaaggatgaagaagggactgcatcctcagatgcagtggatttcatatgtgacacaaagcggcaggttgatcaatatcatgatgaccaaggtcaaccatactggcaaagtgtatcatatgagagcaaagcgtcaaatggctcaaagcctgggccagattgcaaagttcaaccgccgataccagcaggaatctgaggaaaacaaagaaaagtaggctgctgtcagcaaggagctacatatgctctaaggcagattagtgtggtgctatgtttatcgtccaggaacattgctcatggatctttgttttggatgtcatcctcttccatgtagccatctgatcattgtggtttatccctgtagtttcagttctaccattcacgaatttttctggagctatttttgttgctcaattctgcccgatatctctagagaatacagcatgctactttatgttttgttgattttagattgaagctccctgaattcctgtaagatggcatcgtttggcttgtcatgctacgtctcttttagcttatataaattatgtttattgttagtacataatatttctattattctcaggtgtacttgaacctttttttgtatgaactgtaaccttaggtgatcctggccttaggatttatataagataaccgtagtgtgatgatgattgattatagttgtagacgatggacaagggctcaaatgtataaattaaatactagaattaaaatatcatttagaaaagtcatagaagcaatgctgattgctgattgagcaagtttttgaaatcaacgtacagtacttcctagaagtgtttgtttggataatttacagaagttatgcccattgtctcgtttatttatatgcttatccaaatcgtttattagcacataaataatcatttgtgggtgaaacttttatgtagtgttcttagcgacccaaaagtacatgttgtaaaataaattatgatgcaaaaacaaaaaatcaaattcaaaattagattccaatatttaaatttcaacttacaaacataatttaattcctagcatcttaacgtggagttagtggagatgaataataactaaaatatccttaattattaaaaaaggtagtaaaagtgaaaagtagtaaaagtgatagataggtaacatggagttagtggagatgaataataactaaaatatccttaattattgaaaaaagtagtaaaagtgatagataggtaaagggtattgtaggaataaaactgagagtaggtagaatagcagatgttggtattttgtgggataaaatttacactctagaggttattttattttattattattattttttgacgaagggagtatgcgagaccgaccaatcaagggaagggaatacgagatactcgtgcaaagcccgcaccccctgtctctctctatcttctcctcttttctttaagatttattaccgttgaagaaaccatttctctccctgtgtctctcgctgcaagtggaccccgcggtttccgggccccaccgtgtcagtgggagatggggaagaaccgagaggtgtttgaagcttcttccccttgtcgccgtcaccgtctcgtgagtcgtgagtcgtgacagctgcctgctccttctccacctccaccctctctcttctcgccgagcgccgcgtcggccgcatcctgctcccggggccccggccgccgccgccgacgacgccgccacctagcagctgcgggttacagcggcgctgagggcgagggagggagaaggccggccgcgcgcaagccgcaaggtggcaggtgaggtggggggggggggggggggg

SEQ ID NO: 40041 - DNA, 6396 bp, Oryza sativa
ccaccacctgctgccgccggtcttcgccgaccgaggcgcgtgcgtgcgttcgcgggtgcgcgtcgagggaggggaagcacgccaccaccacgcgcgactcgctacttggcgacgacgacgccgaggccgaggaggcggacaagcgcggttcaccaggcgtacggcgccgccgaagggggtcgagaatcccgcgtcgctcgcgggcgggcgctgaggaagccaggaaggccgccgaaacatagcggccacacctgctgctctgctccctctgcgtgcggcgcccggtgaggtagtcggggtcgaagcgcgtcaagtcgagggaggcgaacctgcgcccgcggctgatcgatcgaggccctcgccgccgcgcgcccgcctcgatcgagagcccttctgcatttgatcgtctgaactcagctcaggtacgcactaatttggttccgcatctagcatggtgtccaccacccacgcacgcacgcacgcactccgctcgtccgcttgccgcggcgcacgcacgacacgataggcgccgccgcgcgcgtctcgccgccggccatttcgcgcagcttctgagtgtcgtgatgactgcgtgacgtgcaactgtgcgcttaccatgtcaatgcagtgccgcgtagagattggtggatggccatcgccaatacatggattaattagttagtgatgagttaaactaacacacgcacacaaactgcagccgcggcgcctacttctgagcactaaattaaccttgaaatccattttagccagcactaaacatggattagttagtgatgagtaaattgatgtagttaattttgcttacaaatcatcattaattagtcctctccaagtaattaaatgttggatgaaaaccgagcaggtgtgattaaggacaagacatactcaagctatttggaagacaaccgtgagtttcatgcatggccaaggtttcagataacgaaaggttagtgcctccaatacatctcaatttttcattgattgtatttttttttcatctctggtagctacttgtgcatttatatatcttctatagagtccttacgaatatttaattgctatgcactaccgtatataatttagtgattggtccatattactattgacccatagttccctggtagtagtttaaataaaacaaatataatgcccatagtttcctaaaaacgttataatgcccactatagactataaaccaaaaataataatgcacaccatagactaacatggtaccggccgacaagcaagattaaagttaaaagtttctctcttttttctagctctcctatataatcccagcagcttagtagtcactagacagtgatggttttgtcgttgccatcctttatctgctcttactactctgggttcaaacctttgatatagcaaaaaaacattaagagatcaaaattttagaaatacatcaaaatattgattgaaattgtcaaacaaaatttggaatgaaccttttttttttgtttcatttgactatttgagcctgcctgatgtatcttaaatgagccctcctctccaccttcctcaccactgcaagtgattgtgaatgctaggcctatttgcctgattacattgtggatttaaattaattttataattattctagtcaaaatattatttatactatattccctccgtttcatattatcagttgctttgacttctttctaagtcaaattcctataagtttgattaagtttatagagaaatgtagcaactcttgtaacaccaaattgaacataacattgaatatcttcttccccaatttcttcttcttttcctctctctcccttcctcctcgactggtcggctatagcagcggcactgacgccaccgtcattgcttcgatgcaatcggaatccggtggagccacctcaaatctagcctggatgatgggcctgtgccctccacagccaagtcccctgcctaggagaaaccatgggtgcagcttcccctctctctatatggtaccgacgaggaggaggcggtggtggcggttgatgaggagcctctatcttcctccaccactcaagcttccacccgccttgcctctagcgcgaggctacaatgaccgtcgtgtgtcgcaccaccgtcggccctgtcgaccaccaagagtggtcatggaagtcttgcaactgtggtattcaatcccacgcaagcttcgaccttgcctattccctccgcggctccacctactcaccgacatgtaggtcaccgggttgtgcgctagcagcgcggcctacatgcgcctcatccgggtgcttcccggtgccggccgcacactcgaggatgaggcgttcctccttgagatgtgctgcctcgagctccaccctgtcgctcgcgaaggcgggtaaggaggacatggtggcagaggatggtgacggatcctcgcggcctgccgcatatggatcaacgaggtggaagagagatggggaagacataagagatgatagaggaataagatggaactgtcatatgggtcccatgtttaggggtattttggtctatatgatgacggaaaatgtgacggcgatggcatgcttctaattttgtgcgtattcgaatggtatggatacgaatagatgaatagtaatgaatttatctaaaaaggcaaaattttcccaaaaaaaactaaaaaaatgtgtaattagctgcgacactgtaaagacgtgaatttgtccgaaaacactccaagtgtggtaatttgctacaggacaatggatacattaaaatataatattaactcaattgatgggagagaaaccacacaaaatgatagttttaccgttatgttattctcctttctcccaatcttcttccgccgctcactcacagcaagctccacccgcttgctcatggcggcacaaccactcgacgtagtcgatggcgcggtcggtcgacatgctgccggcaccggtgagattggacaccgtctagctagtgcgcaccgggggggggggtgtgctatggtgccgtcggcaaactccctaattatgaacacgttgccgaagtgggtgaccttggtgagccagctttcgccatcgtccatagagtgttccctgagacaatgtaggaaatccgccgggtcgtcaaccacctcgaggaggcggtgctcggggcgaggcggtacctagtggagagcacgatgtggttcatgtctctcacgtggtcgtccggttcaagtgccggccgcgacggtggcgcgagcacgagtggcaccggcgattgcaacgccaccacggtcaccgatgacatttggctgtaccttccgtcctcgtcgccaacagcctcgacatgctgtgcgaccgcaccattgactacaccgagcagctgtccgtcatgggtaagccggtggagctcactgcgaatgagcgttgcaagaaaaccgaaagaagggagaagaagggaaaaaatgtcattttatgtggtttcattctcatcaattgggtggatattatattttaatgcgtccagtgtcctgcagcaaattaccacacttctgaagtgtctttggacaaattcacgtctacggtgtctcatagctaattacacatttttgtgtgtcctgtagcaaaatggcacatttgtaatggcatggatcaattaatcctatattctaaacaatcttctgtttttcaggtatccagttgaagtaagcaatatttcaaaggagggggtaatcaatttctcatacaaactattaatattcttttgcattttttaaaaaaatattaaataaaattattggatctaattccaaattacacatgtttgtaggaggtggaggtcgttaacaacaatgtgaagttaatctgttatagggatcctgttccagggactacaaaattcaattacccattttattatgcttcagtttatgatctcttaaatcctaaaactgcgatagatcaaagcattaggcaatatgttgtccttcgaagaaagccacttcaagatgcatatgacacattcaacttcttgagcctttgtgaacacccgaacatccttaagccctatggattttgggaggataatgataacaaaggttttattgcatttccacgtgtcaaaggcacattaggtaaccttccaacagatgagttgttctctgtggagatcgatgcgaataaggttacctggctcaaaggcttttctccaagtggcatgcaaataatcaggtacaataatgggtaaccttgctaaacaaattctcaattattcatgtcatgtcattatgcgttaatttattaatcttcacatccttttgtatagataatatctattttacgatattgagcttagtctatttttgaaaaaaaaatgccattgactttgtttccttgagcaaaactgaaatattatgagttttttttgttgcttttatagagatattgtgagctcggttcactatgtgaacgagcggtatcctcaagctggcactagttctagtggaagtgccataccgccacttacgatgtttccactagaacttgcctctcacaaaattttatatgagaagattccaacaggagaatacaagatttttcttggagatatatccacgactaaccattggccaaaaacaatgaaaaagagtaagttatcgtttcatttagtattaagtgctatatttacctctatgatatttgtatgttctcatgaaattacgaaaataattacttgggtcattttgtacttgccaataaaaaaaaactcgtagaactaaatttctgaaattatgcacctttaaatgaaggtagctagactttatttatacccctagtgtaatactccatccatctcattttcatgattacctaagcaaaagtgtagcaaccaagtacaaaaaaacctttattattctaaaattaatccttatcagttaatatgcttcataactttgtattccatggattatgtcatattttaaatattacatgacattgcaccaatagaaattaatcttggttagttgcatgcagtgcattcgacgatgcacgtttactctttacacaaataaatgaatagacacttgttagatgatgattataatatattaattactaatttgctttatttttttaaaaatttgctttattttcttggcagtaggataactgtacacttcccgaaaaaaatattagctattgttcttttctttctagaccaaatatccaaatagcttctaacttcagttttggtatttctgtatatttagacttttcagttgaagatctcaagaggcacaactggaattgcctgggaaaatacatttcaactatcatggccggccataagcccaatactgaattgatacatcttgtagatgtcctgataaaggtaaattggttgttacagttttaatgactcaatgcaaggaagcctgacaactaactcatctgaactggagtaatatatttgttattaaaaaaataattacaaatttcttactgttgctggaagtagtttgaatcaaatgttgcatgggagggggagcgtggttaggaattatatcgaagttcacaaatattttcatgattattagtttgaataaaaaatatgctggaaaataatttaggggttaagtgctctggtgaaataattcgagacaatagaattgacttttcccatttgttaatacccgagaattccagtaggtagctaaagctatggaatgtacgttgtatatgtagaaactagctagtcctagtgtccaatgctcaatatttggttgggcctgtagcactaggccactggcctcaagctgttgtttacattggactaaggccttgtttgattcagcttaggattattataatttggattactagtagtaagctgaatcaacagatagcttattatgatagattattacaatctataagtcagattactataatatggtaatgcactctaaaggtgcttttttagattactaagtggctaacagctagtaaagctaatgatctagagaaacaaacaactaacaacttattttatgtcggcttattataatccagcttatagtaatctagctcaataatctagattacaataatcttaagctgaaacaaacagggcttatatgtcgactagagtttcctaagtaatttaccaataaaatgtatatatagcactcaatattgctcatatttattttgtctttacatgtgtcaaatagatttgaggatattctctgggaacctgcactatggggatcgaaaatcaaaatgcgttttgttagagagatagtttggtgcttagagaatgacaaaacaggaggaagaaagtcaacactctccaaactatctccattgggtctacaggattgtatcaccaagcttggacttaactacaacgaag

SEQ ID NO: 40042 - DNA, 12217 bp, Oryza sativa
ataacttaggtgtacggtgcaaatgtttttcggtaataaatagagctatattgttgccttacctgcctagggtgacttgtttcagggataatttttgggcgtacttgtcatggctggtgataatcttgttggcgtctcgccaaattgaggaggatcgtgatggatttgcttgggtagcagatgaagaacatgagaagtagaggatgaggcaattggggattaatttctttcttctttcttttcggatggaataaatgggttatgcccgatttattctaagtacatcccataggcccacaattaacgttaagaggattaataccacattggaaactttgtgaggtgatctcaatttaaatagggagctattagagagcccctgttgaccggttgaggtgttggtaggattgccacacgcacgggctgaacgtgcagtgatgtagcctagggggagtgaataggctttcctgaaattttctgaacaatcgcagcggttaaattgacagggcccggaacttccgggtggttaaattgacagggcccggaacttccgggtaggatgtagtatcccggaacttccgaagttcttaagccaagaacttccttaagaacttccgggcagcagagataatttgtaaactgagaagaaaagtcctagctaggaagatcaggcacacagatgcacaagaaaaagatcacaggatatcagcagattcaaacaaagaacatgcacaagagagacaaagacgatttttttcccgaagttcggatcacacggctcctactctccgttgaggtgctccaaagagccgggtctcgattaaccccttgcctcacttatgtaaagatcccagaagagatccacagccttcaactcaacacttctaggtcattttctagaattgagtgatcaccaagatctaacttaaaattccttctagaaaagaccacaagtgcaagttgctctacctaagataacctctgaaaactcagcacaagaatctttactcacttacctcgtttccttgcggaggtgaggaaaaccttcacgaactttcccgggacatccacaagatctttggaagctcatgggcgacacctaaccgtctaggagaagatctccaagagtaataagcccaagtgacagcccacaaggtatccaaagtgctcaatcaaacctaatcttcaagccatctccaaaacactcctacactctcatctaatctctcaatctcacaagataggctttagatttaagtggaggaagcaaaggaagcttgggagtggctagaaaaccctagaacatgaaagaactgaagtggaatggccaaagggtgacctggggacgaaatccatatatataacggctaggtgacgtcatatagccgctactcacaagtttgaactggaaacttgctaggaggttccgggcaaaagtgccaggaacttccaggcagcacttaggaaaatttttgcaatgaaacggcgcccggaagtttcggccagaacctccgggtagccctctctgtcccgaggagaaaatcatttttcaaaaatgattccaaaaatcttttgactcatggatatgactaagagcactttgtataccctagaaccacacttgaaacccctcttaatagtacggtttttcctaaactcaatttcgaaagtgaaaattctagtctaatcaccttcggtcctttccgctcttaggaacattcaaattggggggtctccttgtattcttagccatcacaacatgctttgggactaaactcctgtgaataaacttgatagacatgttagtcccctttaaccaccttgtcattaatcaccaaaacccactagggggtttaagtgcaccttcaatctccccctttttggtgattgatgacaacatggttaaagcatacaaaaagataatagaatttaaatttggtatgatgagagaagtgtgaagctccccctgaagatatgcatataatgaaatgagaaatgaatacattatgcataagacgaaggaaagctcaaaagaaacttcacactaccctcgtcaatcaagagatgcagatgaaagtgcttgaatgatgagtgatgcaaaaataaagattagatgacatggcaatcactcaaaaaaaatgaaaggaacacaacatcacatcaaaatgcaacatccatatggtctaacttactgacataaagggataataaagcatctaacagtcaatgcatccaaccaaaatagaaaacgaatacatgtccatatagagagagataaaagagaggaaatcggcctggccggaacctcctgatcacaggacccggaacttctggtcaaatgaccagacaatagtgacccccttcaattcacaattgtaatgacccccttcaattcacaatttctccccctttggcatcaaggcaccaaaaagcaagaaaccatgaagagaagaagatgatcactcatctccatctccattagagggaacaatctcggtatcgccagcgagatgagattcatcggactgtgcagcggtgtcgccctcatcaacatcagtgggagcatcctcagcagctgcctctgtgtcaccctcatcatcatcatcaacatcatcatcggagtaggtggatggaccttctccgacaatgttgcgggctgcctcatacgcctcaaatggatcaacatagacctcatcttcagaatcatctgacacttctttcccagcttctctactatcttccttctaacgcctttcgatcttcttcactttcttggcagtcttagcacacatacaaaaaattgcctgaagtgccttcttgatgggagaagaacttgaggaactcggttgggcactagaagaaggaccagctgaagtagaaggaacagatcgaggtaccactggagaagaggaaggtggagcacgagggcgaaaaggactgtggcgcccatctttaatgtagaacaccccggtgactgtctcaatcatcttcataatgaaaggggcatagatacaaccccgcttaggctcaagaatggtgttggctatctcataccaaatcaacttcatcacactgaagggaggctgattgtagcgcatgcgactgagaagatgtgcatgcttggatagcaaagcagtaacatctccaacctttggaagcaaagaccaacgaaagatggagtacaacaccttgtagttaggatgcaaaccatgagtagattccatgcaagtcctaggagcatcctttgcatacatgaacttggttttgatcatggggaggggtgcttcactatgaatgttgggcctattgagatcctcatcatctaaccccaacatctcagtaaactgtgccatggaaatcttgtgcctaacaccctcagtcaaccacttcacataaggggttcctttccttgtagtaccaaagaatgctgtcgcatagaactgtgcaatgacctcctcattccaaccatactccaaggcaagaatatctccaagattcttgttgtggcacacttgcatcacttggttgaacacttcattgtttttctttctcatgtaagcccaatcaatccacttcatctcaaccactggattttctctagccataatcactgagttataccaatccaattgagtgaaagtcctgaagcgtggatcctgtgactcctcaggctgtgtctctggatcaatcaaacgatctcttctgcacttggcaagttgatgaaggtagttggacttgggtcttccaatgtggtgcataggagtggtgtcaaatccaagagtcttgtagagccgaacgggattctcacgagatcctacagggaaatcatgagatgcccttccagccccagaactacgaccaccacctctcccacgacctcttgtattaggtgcatcacttccttaaccactgtcaccatccctaatctgaacaggacggttgctggattgccttgtaaacctgggagaagtacgagtgccactgccactgccgccctcaaccactttttctttatccaaatgaccacgaggaaaccgaataggaggactctcatcacaggacacatcctgagatgctttctgtcttttctcacgagtcatagtgcttactgcaacaggaatcaataaatttgagtgcagtagttaggccaaaattgagagaatcaagaattgcaggctgactggacagcgcccagaggttctgggtgcaagaacaccggaacttccggccggcaaaaatgaagaaaagaggtctcaaaaatagccagtgcatgtgaacaaatcctatagatcggtgatctacaaggtagcagaaacaagactatccaagtggttttctccctaggttcacagatttagagatcgggataaaaacacaatgaaccgagagagggaatcaaaaagtgctaccttgagagaagaaactgcgaatcgatcacagaaagaagctcccagccaccaatgtggatgaatccacggagaataaacgaatttgattggtggaaagagaaaatcgccacttggggcactgtagcagcgactaggactggcatcggggagggagaagaataaggagagagaatagggtttctaactccccctgagtatatatactcaccgacacccggaggttccggacagggaggcccgaaacttccggcctgacagataaagggcagccacgcccaaaaacaaggtagagagaagaattcaacgagtggaattagagaaactatggacaagcagagacttatgatacatatgaccagccaacaatcaacactacataacaatggtcaatattcatcacaagaaggggataaaaatcaaattttcgcaataaaaggcacacaaaggattttgcaaaaaaattcacaaaagggtttttggatatagggggaatgtttgagctttattcctggtatcaagaccatcttctaccaagaagtgatcttcaagacagaagcactttttttttaatttacatgttagtgatacatgtttgactataaattagccaaccacccatcacctaatgttgcgagaatctaagatattgagctcactcctaagctcgcaaaatcttttctcatctaaaggcttggtgaatatgtcggctaattggctctcggttctcacatgggtaaggcatatgtctcctttggtctcatgatctctcaaaaagtggtggcgaatatctatgtgtttggttcgtgagtgttgaacgtgattattggctattttgatgacattctcattgtcacataggagtgggatcttggtgaagttgtagccaaagtcttttagagtttgtttcatccaaatgagttgggcacaacaagaaccggcggcgacatattcggcttcggcggtggataatgcaatgaaattttgcttcttggaggaccaagaaacaagggactgcccaagaaattggcaagtcccggttgtgctttttctatcaaccttacacccggcataatctgaatcggaatagcccaaaagctcaaagtcacaacccttatgataccacaagccaagattaggagtatgaactaaatatcttagaattctcttgacggcaatcaaatgacactctttaggctccacttgaaagcgagcacacatgcaaaacactaagcatgatatcgggacgagatgcacataagtaaagcaaggatcctatcatagagcgatataccttttggtccacacatttaccattttcatcaagatcaaggtgaccattggtaggtataggagtcttgatgggtttggtatcttccatcccaaacttcttgagaatgtccttcacgtacttggtttgagagatgaaagtaccatcttgtgcttgcttgacttgtagcccgaggaagaaggttagctcacccatcatagacatctcgaaccttttagtcatgatactactaaattcttcaaaaaagaggcattagtagaaccaaatattatgtcatcgacataaatttggcaaatgaataaatcattttcaaactttttagtgaagagagtagtgtccgccttcccaatttcaaaaccatttttcaaaagaaaatctcggagacattcataccaagctctaggggcttgtttgagcccgtagagcgccttgtggagcttgtacacatggtttggcaactttggatcctcgaaccccggtggttgctccacatagaccaactccgagatgggtccattgagaaaggcgctcttgacatccatttgatataacctgaaatcatggtgagcggcataggctaaaagcattcggattgactcaaggcgagcaacgggtgcgaaggtttcaccaaaatcgagaccctcgacttgggtgaacacttgcgcaactaaccgggctttgttccttacaaccactccatgttcatcttgcttgttgcggaagatccacttggtgccgatgacattttggtcgggtctctccaccaatgtccacacttggttgcgagtgaagttattcaactactcttgcatagccatcacccaatccggatcaccaagtgcatcttcaaccctgattggttccaaagaagagacaaacgaatggtgttgacaaaagttagcgacatgagaacgagtagttaccccctttcttatgtcatcaagtaagttgtcgacggggtgatctctttggacagtgtgatgtattcttggatggtgcaccgaggggacctgagcctgatcaggatgctctatagtgccctcggcatcaatcccatccacttgtgccgtaggcacgccttgactgtcctctgcccggaacttcctagcagatggacccagaacttcctggcctggggaggtccggaggttccgatcatctgatcccggaacttccgggtcaactgactcttgactttttgtagggctattggatgttgatgatgaaggttgatccctatcttcttggtcatcctacgtctcgactggtcgtatgtctccaatagccttagaaccaattgcttgtctaggattcgcattatctacaacatgtacaacaacttgctctccttgggagccattagattcgtcaaatgtcacatcccttctaacttcaacaataccggaggttttgttgaagacacgataggcatgtgcatttgactcatagccaagtaagaatctctcgtccaccttaggtgagaacttagatgaacgaggcctcttactcaaaaatgaagcatttactcccgaagacacgaaaataggaaacatttggcttcttaccactcaagagctcatatgaagttttctttaggattttgtggaggtagaggcgattgatggcatggcatgcggcgctcacggcctccgcctaaaagatatccgaagtcttgtactcatcaagcattgctcttgcggcttcaataagagttcggttcttcctctcaacgatgccattttgaggaggatcataggaggcggagaactcgtgcttgattccctctccatcaaggaattcctccacttgagtgttctttaattctcctccattgttacttcgtaccctcttgatggtgagatcatagaggttttgggcttgcttggcgaagcgcttgaagacatcttgagcctcacttttgtcatggagaaaatacacccaagtgaagcgggaaaaatcatcaacaatgacaaaaccatacttgttacctccaatacttatgtaggccacgggcctaaataaatccatatgtagaagctcgagagggcgtgttgtagtcatgatgttcttgataggatgcagattcccaacttgtttcctggcttggcaagcactacacacacgatctttctcaaatgtgacattagtgagcccgatgatgtgttccccctttagaagagttgccaaattccgcattccaacatgggctagtttacgatgccatagcaaacccatgaaggatttagcaatcaaacaagcttcaggattcactctatccacatcaaaatcgacaagatagatatcacccttcaacttgcctttgaatgcaacggaggagtcatcccttctaaagacggtcacatcctcatcggtaaacaagcaattgtaacccaacttacacaattgagaaacagataataaattatagcttaataaattgacaagaagaacattagagagagattgattattggagatggcaattttacctagaccaattacctttcctttaccatcatctccaaacacaatattctcacgagtttcgttctccttatcaagacttgtaaacatactcctctctcccgtcatatgattggtgcaaccactatccacaacccaacttgaaccaccggaggagtatgcctacaaaagaaatcaagcttgggatttaggaacccaaacttgtctaagtttgggtcccttgatgttagttaccaaagcctttggcacccacacacaagtgcggtactcatcattgtaattcccattaaaattggcaaccactttgctctctgaatttttgaagattacatatgaatcatagtaaagaccctctggccggaaccttctggcattgtgcccggaacttccggtcatgtcttgtgcacggccattggcccggaacttcctggtgggaatttttgagagacagatactcccacccggaggtttttcccggtctgtccggatgttccgggtccctggcagttcacaagcctagtcacctcacttgcttgtggtgctttaccttctctcacaaacatcaagcattctttcccatttaccatcacgcgcttagacacaggacttccacccaaaaacccgagcccgtgtccatccttgttaggatgagcggtgatggtcttgtaaagggcatcttttaaatggtatgtcttcatgcatccatatttcaccaatgtgcccaacctttcattctctttcttaagagcttgcatagcatcaatattagtagcataagatttcaaatcaatattgtaacacctagcacaactattgctagtagaagggttagaagaattagaaaccacatttggttgagaggtgctattccaaagagtatcaaattgaacttgatctttatgacttttgtctgaattagcaaatttttcttgaagggtttcattgacatccctaaggctagctaaagaaccattagccaaattaagatcattagcaagttgttcatttttgtcacattctttagctaagctctcctctaaggcaaggtttcttttcttctcaagaataagcaattcttcttgcctttcgagtgattgttctttactatccaaagctctcattaacttagccaaatgttgcatagcaggtttgctaaagctcttaagcacatcatctaattcattatcactttcctcatcactagaatcaacatcaagagaagtgtgggagggcttttgagtcatcaccttgcggccttgggccatgaagtaagagtagtggtaggagtcgtcgtcgtcatcactcaagttattgaagagacgctccttacttgaagaggatgacttgaaggcgacggtagcaacaccaccttctccttcaaccttgtcttttgacttgggcttgggctcgacctcgtgatcaggatcttcttactcatactcgtagcagtagcactggcaacagccttcgaggatgaggccgtcgaaaaggagacgccgtctgggccggaggggaaggcggccccctccccatcacggacgaggtgccaacgttcatccccaacactaccgaggttggggagcagcaacagcaaagtaaagtcgtgcttatttaccagcaatcgctgcagcagccctaccaaagctagaagaaaccaagattttcgttttgaacccaaccaaataaaacatatctgaaatcactaaatttttgcaaatatggtaacaacatactggcattcggctagtactaacattagtattactaatccatgcactacctcgacagagcacacggtttgcctctcatttttcgccgaacgctgatcaatatggtaacaaggcaaccatcctaaaattctagctgtatatgtacgataacgctttatatcggtcgaccggcacgggagcgtcaaggattggttgctcgcgcgtcgccacccacgtgtccctgtccccaccttccacttccacacacacataactcaattgcaacaaatcacccacgtgtcccctgcccccacctgccacttccacacacacataactccattgcaacaaatcacccacatattttggaaaccctctataaagggaatttggtttactttttgttccataaaaaatatttatctagtacactcacaacgtttcactatatatagatctaatgttgcagtgaactaaaatattccattgcaacaaatcacccacatattttagaaatcctctgttaaggaaatttgttttattttttgttccacaaaaaatatttcacctaatgtacttacaatgttttacaatgtttcactatgtatggatcaaatgttgcagtgaactgaaacattctttcgctatttgctgaaacattatttttatataaggtgaaacaacgtctgatttaaacgagtgaaacattttcgatctaatcagtgaaacaattccgatatacctagtggaacatcgtgcaacatttaaaaataattcaataataagctaaattttgttttcgtcggaatatatccacgtgtgatcttgtttcgaatatttaattacaacgaatttaatggtgcaatcggatcattatttggataagtaatttaagagaaaaatcagtttaaaatagttttgcacgtaaatcaggcgccgattttaacctcctcccatcgggcgcccgagccggagtcacatccggatatatatcaaaatatggcattgttgccctggtgagggctccttgacaggctacactcatctgcagggcgatcttcactttttagctgctaacggcgagattctattgatggaagaaacgaggaaaaaacctgctcaataaacaactagaagacatcaacatactggcagcaaggtagaataacccaaaaaaagaaaaagaaaaaaaggggagagcagctagccaactaataaaatgaacttcccaattaataataaactaataatactaacctcttgcaagggtcgtctaacaatgtcatagtagtggtgctcatagtatcttgaatccatccaatattgggcataacatacaagaaaacaaataaacaagtgaagagacaacaatcgaaatttttgcatttatgcacttctcgaacacttttcgtggcttccacacaatgacaaaaactaccagtaagaagtgagaaaatagctaaagttttccaatttgtatatctagagtgaatctcttttctgggccgattgggagttttgctactccctccatctaagtttatagcacattatttaagttctatccatcgatacgagatacattgcagatatcaatgtaaataagtgagcttttcactatatttttaatagatatacagatttatttcctatgtcatgtacgcatgcattgaatccagtccttgaaagaaaataacgacactttttttagtttagcaactttcaatcaccttggtctacatacaaaatagaagacaatttttttgtcagtacactgacattatgttctatttgtacaaaaatatcagtctgacatattttttacatcctgaattttagtaacacttctagatgtataaaaaaatactgtcactgttcaatcaacctaaataaataaacaaatactaaatcatgataagacaatccagaattcaataccttctcacgattttcagtccacctttcacatgcttcaacaaccacctaatagaagacaccaataagtttgatatatcatcaaggatgcaccataaaaatgaaacattgactagtaaaagactcagtatactacctcttcgaaagtatcttgccaagagttacccttccgcgtgaagattaaccaacaatcctgacattatttacagattgcatttgaaatattaatttggaatagatgagaataacaaaattagaactacagaagacctacaatgattcctctgatcatgtaatgcttaggaagggaatgcccagaaaaaactctctcattgaattcatctacaagatctgaaaagcatttcttgtcctaaaatccaaggggtgcagga

SEQ ID NO: 40043 - DNA, 4715 bp, Oryza sativa
  unsure (1)..(4715): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagtggcagcagatgagagtgctatcatttattaaagatcagtttaattcagatacaagagtcactaatttataagaccaaattagagtggttaggtttatgaattatgaagtacaggaagaagcttgtagccgtaggaattgtctgtgcattaacagcaccctgtcaatctgccacatgctgaaatactgaccattcgtattgcttatgaaacaaaccattgacttttaatatacacctaagctttgtcaattgaaacatactggcttaaaagttagaatgtggttatgtgaaacttaggcttcctattaccgatgcagtgttgtttaaagaagggttagataatcggatgtaaatccaatatgaaactattggttctatcttattcaaaatgccctcttctttagttaaattgtgatgtaggctgtctttcatacgttgacacaaatctgtttcgttaggtcattttgtttcaatctcagtaatattctcacagtaacatgtacaacattgctgattgtctatccacattataacgtgaatttgtttgcacaatggactttcagcatttaagcgaacaaagtaactgatttgataatctacacttgcaggttgatttttttgacctggaagttctatataagaacttgaggcctgaatttagatccaagtatgctattgacagtagcaagcacccccatctaaggatcatgtcaaatatgcgagaagtatgcgcttgttatgatttctgataatcagcttgtacatatgttcatatatgctaattaattatttcttctttttttgaagcggaaatattattcaatgatcagtgcaaaacatcacaaacaaatatgtgaaattcttggagaactcattactttgaaaccatatatcaaggtatctccttagtttgaactacgtagttaagttgaaacgtcatgacctacatttatttcatttgcagggctctgaccattattatgaaattgttgaacgtattggagaaaaaattgagataccatccaggatctttgaccgtgatgatgcgaaaaagtccatccgtgtgagtatttgctattgatttaggaatattgtattgaaagactcgcatacttaccctaattcttaactaaatcttcttgctaggtcctccttcaaatcttacatttctgggaacctcagtttcatcctctaatacgggaggtaatttctggaatttgtgagagcacttttcttcttttttttcattgtttgtatataatgttttcatcatatagggtcacaaggacttccttttagacatagccaggcggttggccaaggcaaaagcaacagaatattctgaggtttgttctttttttctttttctgctgtaatcttagaatactacttaaatatgtttcctttttcagccattgataccacaaatggaggatttcttgccacatttacaaccttatgcattcgcatttattgtggctacgctaaaagatccaatggtatgacattgaatatttcatgcccacgcctagggctaccacagtcccactacggcggagtagcgtcgccgcgcgcctcccacacccacncacccacaccccccccccccccgcccaaaacctaacctgccccgatcgagcccttccttctcccagagccgccgctcgatcagccgcccctggagggagcgcccatggacgccgccacaacgtccgtccgcgccgtcgactgcaatcccgtgccggtgagggatttctctgtactgcctgatcggtggcggtgccccggtcatcgtgatggttcggggctacgcaaattttatctcgctttggcggggctctgtccgatgagttgtgcaacagaatttgatcattttttttatttctttttgcttgcttgatttgacgctgcaggtgagggatgaagggtatgtcgatgcgttggtgagggcgtcgcttcattttatcaggaaggatttccctcatgaggtccggggacatggcgtcagattgctacaggtcgtttaatttaattcctgctgtgctgacattatgtgctttgtcgtggacttgatcggaggataaccttttcgttgtgtgcttccatttatctgcaatttttgcccatcctattgcgtctaaaatattgggttgcacggtttagtgggaaggggaagtggatgaagttctcaatatttgcctaatgatcaaatactttagtgaattgcaactaaatggcagcatatagcagatgatattctccacaatgacattgcagatagaaatttaaaaggagttgggtatatatgtttcgtatcaaatttaggaagaataatcgtgtgatgaatcttggatctgattcattggattttactaccaacatgtcctttgaatcagttttatgattcattgtattatgctatcatcataattatatcattcaccagccaccttttgatttgtcttatcacataaggtactaactgtgacaagttctgatttgcatcgcataaattcattttggtttttgatacttgatgatcggcatgaaggaaaacctagtcaaatctgtcaaactaaacagaccagttatttctctatattgtttctataaactttaccacaatttaattgtttttccctttggtcatttcttactttgaactcccatgatgattagtagtaaaccccccttcaactatgtctgagagagctagttcctgcaactgttcctggtgatgccaggatgaccaccgagcaggtctcaactgatgttagtcttcacctcgtggagcactctaatggtagaagtgaacatgggatttgttagtcttcacctcatggagcactctaacggtagaagtgaacatgggatttgcagtttctggagagaattaatgttgtggcaggtggatgggagattcagagcggcggacaactccgggaatagacaggaaggaagggtagctggatgggttgctagttgtgagcttgtgtgtgcggtgtggaagacaatgtgagcagtgttatggtcatacataatgggagaagacgaaaatgtcaaataacttaactttgtaaactgtcaattgcattaaaatgtaccagttacttttggtggtataaatctaactctagatctttcagtggcacaaaaccaattttgcctttcagttactttcaagtttggatgtgtcctgaaaatttgtactacaacataggattttactaatcatgtacgtattttagtctaattcttgccattctgtttgacatatgctccagaaatgcttcaagtgataaccattatcgtcctttaattatgtgtcatgcagggaagaaatgttaaggttgatgtctagaattgcactaacaagtttgctaaattttggttatatctagttggctgcccccatgtttccgaaagaatagttggagagaccttggaaagggattctgatgaaattccaaatctagtaaaaatagttgccaaatttttttatccacttccatgggcctcagaacaaaatccccctaggcacttaagtaatgctacacctacgttggatgtgatgtgagctgcagcagccaattccatctatagggttgtgccaactcttaatggatctgactgggggaacaatggtcagatgatggttattgtggaccgattaatttattgatctcatacctttcattattttgttgctatctaattctcgccatttcggaattactctattcaagactcacacttgcagtatttactataatgaagaattatgagcacaacctttcacatcctgttttcctttatattagatgcagataaggcatccgtagttgggatttcgtccatgagttcttatgtcaggcctgcagttgtttccaatgtttatgctatagaactgtgtattcatcaccttctgtattgttattttgcagcatttgatgagattcaggtgggaggaagttagcatcataaattgaagcaaatttgctcatgtttttagtttattaggagttgagttgggagttcccgatgatctggtttggaagaatgcagcagctgatttagttgcagaggttatgatttaatcttattttattgtttgcgttggtaccgattcatttcttatgtattatgttgaaaattcatactatttctcaataacaatttaatgtagcaggtggtttggagccatggaatttctctcttgcatgacctaatcccatgccttgtgtgtctatcagcaaagggtgctactgaggtaagtttgtctattttaaccaccactttgacctatttgtactgacatttgtgtgactaatattattttgttttgtcgtgtgaattgttagaccgaattagtttgctttattctgaagtcaatttctgataatcgaattgctcatgtttcacattctggaggtaagaatcataattcttttatgggtagtagttcaactaacaggtaaattgacaccgttggttttaatcggtgataaaggcgaaccgctttccttatctgagttccttcagcagattttgccattcatttcct

SEQ ID NO: 40044 - DNA, 9365 bp, Oryza sativa
  unsure (1)..(9365): unsure at all n locations
attgacatgtttgatactgatgagtattatgatagttattggggaatgatgggcatgacaatgatagtagagataacatgctggatgccgcagacccaagaatggtagtaactgcgttgccatctaatccaataatatatttatttgctgtttggtgttctaaatcagctcatgaagaacacagcagattctaacagttcgaatttcccatataaaactataccttccataagaagtgtcacaatttgctaagtttcgttttgattttccatggtaattaggtatttcatttattgtaacaccccagcctctgtattgttccctgtctcttccatggggtcaggttcacatgcggatagcactcgagtactcgactttctcttttgtcctttcttcatgtgaaaaaagttgttaacccagaagtgctattgttggaggcttgcagcactctccgtatggcactaatcccatcatgtagcacataagttttcactctaatgggcgatgatactacatgttaatgaaagtgtttacccttcaactctttctagagtagcaatcattttcactaggtattagatgcacatgcttttaaagatgcacactactatgttgtatatgtattctattgttctattatgtttcagggtaatgatggagctagacgagcaaactctttccaccacttgggctgtctactccttgctgagcataatattatatctgaagcattccttactgcgtcatcctggtctagatgtgtcatcatgtaatttgttattatctaacattaattgggtggagctactatgtgcaaccgtagtaggcttcatgtagtagaaataattacttgcatcatattcttttctcttttaggattcagcgatacaaggaagttcttgtatactcagtcctcttagcaaaatttgaacccagccagagtgggaaagcaaatacacacattatgcatggtgcctcacacgtctattttctaatagacagtttgtgaagaatgttcatgatgtggcgaagacatgggaagggcagctcaaaaggagagcagaagagtctcatgcaatccaaatgcctgataaatactcaggtagtctcttagggttgatccttccattgctcctaagggtatatctccacataaaagttcacattatcataagattatatacataatgatgttgaattcttgctttatttctagttacttttgaatcttgtgaattatttgtatatctgttgacttgaaattattgtctttcagttccttcaatgtgtacatgccctctggaatcgagatattacttatgatctatcaaaaaagtttgcaaaagctaaaagacttgggatcgatgaggaggaaggtttccaagaaattgagatgagacaatggctacaggatatccgagagattgggtatgtaccatgcttgctcagatactcatgcagattctacttgctgtgttttcctctattatatgtatttcatgggtacaagagtttttgactttttattttgtcctgtgacaaatgatatttttcttcagaaaatgtattaaattgcagcaggcgcacaagggcaagatttgtacatggaattgggaggtatgttctcatatttccttgttttcgatgatctcaactacaatttagtggaaccatgatttttggattttatcatctattaaaacatattttttgttttatgcagtttgaagatgaatttgaagatatcttccagtttattttgagatgatgcaagaagtggatacaatggttgggtgttttgaggtaatttttccgtgagcaacaatagtgcaatgcaaagaatgcttattatacgtttatttaaagagtactacagaatgcttgagtgttcaatagtttagctaggtattagatagttttatccattagtgtttagggctttaatgtgattgggaggtgggacatgggcgataactgtggcaacagatctgtgcatctactatgtagtgagcatctattaacatccttacgaactgcagtagttctagaaaccaaatatgatattgacaaggttcgagacctgctcccatatcttctatggttacccctacactcgggaggtctgggggctggtcaggggtcgtgtcggccttctttacgcagcaccggatgatgtcttctcatcctggtggtgtaaagtgcgaaaggcaatcgccaaaaaggataggagatctttcgatgcgggcgacattttggtgacctggctgatttggaaggagcgcaatgcgcgtgtatttgagggtcgagcctgttcgcctgtcaacctttctgcagccatagaagatgaatggagaacttggattgcagcgggcttgattgtagcttcgtaagcggcagaggcggccgtgtgctgtagccttttctcttttctgtcttctcgccctcagattgccggcccggcaaaaaaatattgacaaggttaaaaaatcaatatagttggaatagccagctccatgtgctatgatgcatggacacagatgcgtatctctgaaatattctattgcatgctgccttcaatctagtgtagctactgaatccaacatgctgaacttaggaaagaacaagatatcagaacaactcatgagagaggggcttgtgtgcaacttttctgcagtgtcagtgcatgtgttattggaaactatgttcattcatcttagtgccgggggccactaactctactggcagttggtaaatcagaaactactctgtgttctccatgcctagttatttatgctctagtctgctagctattaactctcanagctaatagtgcctagagaagacagccattaggagtctgcagaactattcagtagggattaggtcttttgtgctgtctttcctgactcctgtttgttcagtgggtctcaatattcacatatgcatgattcagtatgtcatttgttctgaaatgttgtttactggaccaccaatttagtgtggtaaggttggcgttttagatatgtgaaaacttaggcttcctattaccgatgcagagttgtttaaagaagggttagataatcgtatgtaaatccaatatgaaactattggttctatcttattcaaaatgccctgttttttagttaaattgtgatgtaggctgtctttcatatgttgacacaaatctgttttgttaggacattttgtttcaagctcagtaatattctcacagtaacatggacaacaatggtgattttccatccacattataacgtgaatttgtttgcacaatggactttcaggatttaagtgaacaaagtaaccgatttgataatctatacttgcaggttgatttttttggaccgggaagttctatataagaaattgaggcctgaatttagatccatgtatgccattgacagtagcaagtaccctcatctaaggatcatctcaaatatgtgagaagtatgcacttgctatgatttctaataatcagcttgtagggttccccgtaaggaaaaaagagtacaacaactattttacattttagcatcaattacttcggatcgactattttacccctattttgatcttcaattttgattttgcccctgtatttttttaggttttcttttttgcctctacttttttgaaatgaaagccaactttgcccctacttttttttagaattacatagtacaacgtagacacttacaatgcacgcgcactcacccatatgaacgcacacacataaaccctatccctatgagcatcttcgaagactggactgtcaaatccttgagattgacgaagtcatcacagacgtctcgctgtcgacgggtacgttgactaccactaaaagcacaacgacgttaaatcctggaaaatccgctcccatgaggagtcgaacccatggatggacacgttgacggagttaaatctttggtgaaaagacgattatgctcttatttgatattgcatatttgtctcaatgtttattcaataatatctgcccccattttacatgaaacttgcattttggacaaacttttacaaatttgacaattttgatagaatattaaaaatgaattggaataattttgccacaaattttttgaaaaaaaaaggacagaatttgggcacaattttgacatgtttttacatagctaacaaaaggcatgtagcaatcacaaaatcaagcaaatccaaatccaaatcgcctgctctctgcatcaagccgtcgccgcctcccgcatgaagccgccgatgcctaattaagtcgagacgccgccgtcgcttgctcctcgcgtcaagccgctaccgtctggacaagagcctaccgtcgtctcgtcccctcgtcgagccgctgtcgcttggcttgcgtcgacacgcgcagccttctgcttgtcaccattgtttggttatcggctcaccaggggtataaaggtccatcaacgaattaaaaaaccattattacttctttatttctctacttctttagctccataatcccatgtcgactaattacgtctattccattaaaaaaggaaaaaaaattaaaaaccctaatttttagggtaaaattaatattggacatcaaatagggataagaacgaaattttcccatatataaaatacgtttttcaaaagtagtaaaatgtggcaaaaaaaaatccagccgtctattgggacacctcctaaagctaggaggaggggccccacggtgcagtttctcaggtgaccgcgaacgacgcgaaagcgcaggccaaattagggatggcaatttaacccgtttgcatgtttacccgtgggtaaaagccctaatagtgttggatttgttctctatgtaccaataggcatacgggcacgggcatgggtagtcactacctacccatgcccgtttcacccgtttacccgaaaaaaccaactaacatgtgatccctcggtcaaattagtatagatgccaccatctagtattgatgaacttatgtttgtggcaatattctttctctttttggactcaaccgcaaaggattcatctaaactaattagcaaagtcttgctttgattttctggggtacttttcaagtgtaccaataaattgtttgttagtaaggaatcaaatgctggagaattcatttctaatagatactcaaatgaaaaatttcgataccaaagtccctgttacttctctcattgaatctttagcaaaagctcaattttgttctgcaatgcttgtattgttaaatttggtacaactataccttttctttaaactatgataatgtctctctgcttgtggagatttgtgattaaagaaagtgttgaactgtgagtatgtggcgggtaaacgggcatgtccgcgggcacatagcgccggcgtgcaatggacgtgggtagtgtttcttacccgttatgtagtaacgggcatgaattatctcgcgggtacggcgtcatgcccgactgccatcaaccgggttccggatccggtgcgatcgcgccccgtcggagtcgggagcgggagcgggtcggcctccgcctccgataagtgcacgcatctctgcgcagcgcgaggccgccattctgtttttcgcctcggggagctaagccgccgccaacccgctacaaaaccctcgccctcatcgtcgtcgcctccggcggcggccgcggccccacgcaccgcccgctaccccaccgtgcgcgccgcgcttggccagcccggccgcggcccccctcaccgtcaccgaccaggtagggagggctggagcgcagccattccggagagtcgtcgcctcctcgcaccgagcgagcaggaaggtagcgggggcgccgtgcgcggcgaccaggcagggacggacgcgggcatccatcgcctcgtcgggcccctccactccctccccacctcgcgccgccggttgacgcggcgcagccggagcccccccagagcgcgcgctgcatcaccttcgccggcgttcgtttcgcccgtacctgcggaggcgggtcgccgacaccgagcgcctccgtcgacgcgacgccgcggcctgtctgcgactcctcctccttttgccccaaggtacaaaatagcaaacatatgctcagcatttcaccttcatatgcttctatttttgggaatccttttgatttctttaagataaaccaagttttatccatgttaaacagttacatcaagataatacaattactatggaggcaattacgcttttgactctgttataaagtctaagccaatctaaccttgttttctcaactttgctcatttcaccctatggacatgaccttattatgtgagacaaacgtaatggtgttaacttggggccataatgcatgccattaccttattctctcggaatttggcacgtcgtattggagaggcatacttgctgtgcgctgtgtgtcgagacttgagagtgatagctgcacattgcattagccaagaggctcggcggccttcacaccaaagagactaggtctggtcatcctcaacggtttgacggtaggggtgagcatcctcgggtgttgggcgtcgaaacgggcgtaggggatctctgtggtggcaatgggctgtgggcgtaagcatcgatcaggtgctccaaacactagaccctcttgtggaagccgggacataattggggaacgatgcaaattctttatgttttgtgtgatgaagagcgcttgccttactgccgacaaccttcaacgcaggggctggcatcttgccccaatttgccacctctgctcaaacggcggcgagtcatgccaccacatctttagtagctgctccttcactcaggaggtctggggccttgtcagaggtcgccttggtcaccttcaaacaacaccgtctgttgatctctcctggtggtgtgatgctcgtaagtttattgctaagaaggagagaaaggtatttgatgcgggtgttattttggtgacttggttaatttggaaagaacgcaatgcgcgtgtgtatgaagggaaaacaagctcccctgttaatctatgtgcgaccatcatggatgaatgggagacctggacagctgcggggttgattccagctggctgatctgtggttggggcggccctgtttgaggaggggtttttagtagcttttctttgccttgcccttttctcttttctgctccctgagttctgttcctggggtgataggataatttacattctcgcattctttcttaatatactctggccggcaaagttttgccggcccggcgaaaaaataattggggcaacatgttgcaccacgcatgatagtcgctcgggagaattataggatctctaggagaaaactacttttaatcatgaacattggcttgcgctactccgacggtttggaaacatctagatgcacttccactgtgtaactgtagttctgataccttatattagtacagatgaatagagtccctaaaatcaagcctaaagaagctgattatcacgttcaacaattgtagcatatatgttggcattaaataaaggtacataaacctggccacacccaaactagtccactattgtctgttcatttatagtttgctttagaacagcccattttactcaaatgctcgctattcttattgcaggatacaacatggacacgatgtcagataatacaagccacaacattttgtcccaggtaaaattttgtctcaaatctcactcatccattgatcaatggtaaagctagacatacaagcattttatagatggcaagttaactaaagtgatgttaaaggtagaatattccattgaaatttaatattttcttggcacattccaatacgcaaatatattcactcaattgtccataaactgcacatatatactcaattgcatgtttctttgttgtgctgttcgtgtagacataaggttcaaaaaactacatggttcaataggaactttgacagtgcaaatcaactgaaatatattatatgtactctcctatgtgtttccaatgaaatatgaaattttgtcaaaactgtttgagtatatattgatcaatctatatgaaattctcctaaaacacatatatgattgttttgtagctttttcatgtcattgtgctgctttcttttacttctaaccacttccttgatctatcgggttaccatcttcttaggtcaatggaagttctcaaatagtcataacagacagcaaggtccaaaaacttgggagttcagcaaactatgtgaaatattataagggtactgttaagtttggtaaaggacttagaatacaaaccaaagcatctgtgcttgcatttacctcatgtgatggagaagctgcagatgccttgtatgtgcgacttgttgcagttaatagcccattcacagtcaaaccattgtcatatggcagaggtattcgaaggtacagggaatacaccttcttagctgttccaccgccaagttgtttgctgtctaactacactgatggattcaatgataaaactgtcagtatgaagagattcactgaagaattcatcaagataactgggtatgtcgttaatgttttggcttatctgactgaatttatttatgcttgttgatgcatttactaattgttttgtgtttggttagggatattgttcgagcaattatcacccttcattgccaaggttactggtgttctggtttgaaagggaaacacatatgcatctacaaaatggagaagtgtactgatgcaaagatttggagtttttgctttgcaggtatgaatttggcaaaaaaaaagaagtgtttcgacttatatagtcagtataaattgctatgttcatagaaagcctctaataattttataattactggagaaaatgcatgattaattgtgtcaacctagagttgatatttcaaccttgaactattgcctcaatcttaaaacttatcatctctaaattctataaccataattcatgcctttatccaatatgaaggggttttaaggtttaatggtatcctagttatcgtgaagtttatatacaagttgaccttttagttatatatcagttgtaaaccaatgaaattatagaaatcactctataggttacgtgcagaagttgtgaagaattctctcataattaaaatatataggtgaggtactactattatacatcctaatgaccatgtaaaatacgtatgaaacttacaaactacaaagtaatgttgacatagtgcaaattcattgtttctgatttcatactttttatgaacgaaatcaaattgattcttaaattttatatggttgtaaaatactaccctgccctacatatccctcacatttaccttctgtcaaatatttgctaacccgttatacatacagggggaaatgaggca

SEQ ID NO: 40045 - DNA, 8031 bp, Oryza sativa
ttaattaacaagtgctatataatatatactagtaattgtatatctaccctgacttagaacttacgctgctgatctatctcacctctctccatccttgcactggaatttttaattttctgcatactagcatattgcccatacattaaaacggatatttaacagaaaattttaacccattttttaccactttctatatatatcttctcttaattcattcatatcctctcaactgataagtgggcactttgaactcatattctacgttctttaattcacaaaagtagggagctagttaggggtgcatggtggcagatttaccatcgccccactactgtttattttaaagtaccatatatatagattaatttcttcatccttccatactggatgctaatcaagcagagtttttttctagataattaatggataactcgactactgctgcgtcatcagaaacgcgcaaattaagcacaattattggcagagttatataggaagagtgatttcttggatcattaagcacatcagtttgtaggagtatcagcaatgatcagccattcagcctgatgaatgttcacaataatggttcctattttttttgggtacattctaaaactctaaattgttaatattttactgaccaccaagcctgcaagcatacatgatcagtcatgtggcagtggtccttaattacataaggaagccaggttttattttattgtattttttctatatatgcaagcaagtggagcatatactagtacagttcatgttcatggctggcttctagacaagtaaagctgtaactgcactatgcaagttgcatatctaagctagtagccccacatatctgatctactgatggttgcatcatggggagtagttagctaagctatctggtgatagttttgcatgtgtgatccacttgccaaccaccttccattggcagaagaaatcactttaattttccttttaaaaaagcggtagaaacttcaatggaaaaagtgtgatcctaatcgtttaatgccacacatccaacggctgatataatgtgtgaatgctgcattcatacaggaatgaaacaaaatcttaaataaatattgctaacaccctgaataggacctagtcatagttgtttctggttaatcaggaggaactaggtcaaagatgatatctttaatttctcctgaaagaaccaaagagcagtgtactttcaaataatgaccctagttggggcatgcacatggatgcatgtcatgagcaaacctttgtgtaaccgtgttgctcttgttttctatgttttggaaagatagcttttctccaagtggttttcaactggactaggagatttgtaaacaatatgcatggtatcatattgttgatcttgtttgtcaacatccaacattttctatctttttggataatttccacccttttctattgggaatatgtacatatcactggtggagaagtgctttttactcccggttcgtaacccctatatagtctcggttttccaaccgggactacgaagccgggattaaagatcgctatctttagttccgggtgaaataaccgggagtaaaaatacatttttagtcccggttggtaacgataaagcatttttagtcctgactaaagagactagatccggttgcttctttattcttttattttcttcattgtttttaatatattgatttcaccccatcccatccccaaaatcccaaatcaatcatcctcaaattgcctccaaatccacaaatcgatcatctcaaatacatcacaaaatcttaaaaaaaattacatcacaacttctacaaaattcatcacatattcacatcacacacaaatcaaatacatcacacaccaatctcatatccaaatcacaagttctcccaaaaaaaaaagaaagaaaaaaacgttggcgcagaccgccgcctcgtcgtgcgccgtgccggccggctggccctccacgccctgccgccgcgaggccgccagccgccggccctccgcgccctgccgctgcactagagaggagaaggagaggaatagataaggagaggaatagataaggagaggaggagataaggttgaggagaggaggagaggagttaacgaagaggagaagatacctcgatccgatcgcgcacgcctctccaatctccgcgtcgatctttttttcccggttggtgttaccaaccgggactacaaatagatctttagtcccggttggtaacatcaaccaagagtaaagcatatggcgatcttttttcccggttggtgttatcaactgggactacaaatagatcttttactcccgtttggtaacaccttaccaaccggtagtaaagattgaaaagtaccctggagcttttaaatcgggactaaagatgtttttagtcctagtttttaatacaaccgggactattgtgaaatctgatggaccaaccaaagatggtttctccacccgtgaatggaatccttataaaccccattggtcatgcacatatgccttttcactttacactttcgttcattcacaaccccatgtgtaaaatattgtcccaaaaaaaggccctggcaacacaagtgtttcatgccacatcttctcactacttttatgccagacgcaagatatatagctaccagcctaccacccacgcatatatatagatatatataatagctttacacataagaaaaattaattgctactaattaaattacgaagtgagcttaacattcaactgattgattacattggaacctgtctacccagattagttaagtcctaaattgacataggtgcttgcatttatgactaattagtattattttagtgataagcgatatgatcaacaaggcgcctgtgatgattttcatttttgaatcttaagacatatatatgacggtctccccagtcttcaagatgctcataggggtaaggtgcacacgtgtttatatgagcatccgcgtctacactgtgtttcgaaaaataatgtatatcaaattcaatgtacaacaattgcttgcatggatcttaggttaattagattaactcttttggatttttaacccgatttatggcatgacaagtaaaattaaacatctgccttgacaaggcataacggtctgtttggttggagggagttggtgatggggaataggagtttatgatatctaggagtttaagtctgtagtttggttggaggacttgggaattcgagggggtttgggatggggaattaaggggtccaattcccacccatctcttacctagggaaggcctgttaattcgtgagacttggagggaattcgatgtgaaaccaaacaagggatgaggagtaaaaaagtaactcccatgaccaatcccaccatcaactccctccttcaagctcccattcctcttcccttctcttgccaaacaggccgtaaaggaaaatgaggcggacacgtgggattcatgtggaattttcggacaacattttcacttgggtgcatttatgtattattcttttcttccttttttgatcaaaagttgtgtactgaagaatttatactcctttgatcaagatttggtgcaagggtgtggtttccaaaacagattttatctaggactaatttcaagaaacattgagtactatgtcctcaaaacaaataatgtattccagaaagcattgcataattataatatttctacaataatttgaaatggaagtactacaactaccatttaattatggagtatatcacaaagcaccattgactccatctactatgattcaaatcctgttgttggtcgtgtgcatccttagttggtacagagaccgaaggctatatcttttttaaaaaaaaataatttattatatccaaatgaatactgtagacagtttgatggctgaaattacaattttctttcctgtaaatgaatactccaattttatttactgccttgcaacagataacacaatttctctttttcacaccaaacgtgccaatgtgcctatttaaccatctttgacgaagatagtgagaaacacgtctttaacgaagcgtgaaatgagtaaaacctatttaaccatgaatatttattttttgagaattaaccacgaataaactaaccatgcatgtctcacactaaaacgaacaaacctatatatttaaccatgctgaattcttgtgtcaggtagaactccacgtcaatcctaaactccagggaaactttcagagatcgatcactcttttctgttactccagggagtatatttttcttcatccgagcatgattcctgagcataaaataatgtcagcagttaattgcactggcacccatgcacccacgacggtgaccatcatactttagttcctgtcagtacacccctcttaatcttccacctgtgatgtgctcctcgccatgtgatcctcgccccctcctcctcctcctcctcctcggtatctacacgccaagatctctctctctctctctttcttggagagttgcagtgtgatctgaacaaaagcttcagttttcagtgccatcttgcgttgcatctcctcctcgctttgccgcttgtttcgccaagtataaagcctggtccagtgaccctttttgtttcgatgtgcagggtcaaaacaaacacacacacacacatctgtctcttcttcaggtttcaggtctcctggctgctttgcttctgctgcctctgtgtggggctccagccttgctcagattgtaagtgtgtggggattagtatgattggttgagttcttggtggttcttggatgtgttgattattggtttgctgatctgtatgcccatctgtgtgtgtgtgtgtactgttgcctgcatctgttgagttgatgcattattggtttcagagcttcagagttgcgtgtatgtatgtgtggagattcagagcatgctgatgccccatctggataactaatcagatggttaaatttgtatcattaatttagttagaacaaaaaactagtatgccaaatgctgggtttttttttttggtgtgttatgttctggttcccctctgctagtgtcaagatccagcatttgttgatcacttcttggatctctgattcagaggccaatagctttcacttcattgatccagttatctgcacattaatgttagtgttagttactagtttcatatgttgcttctagatattttgtctggtaaatctcttgccagagatgaacaaccaatttttattttctacaagtaaattgcaagctgctatgatatctgatctctgctttttctctgcaaaaggatgattggtgatccaaccatcttcatcacttacagagatggggtgtggtgcatcaatccctaagaaatgcaaggtaggagggaaggggaagaagcgccggagcgtcatacaggaggttgccatattcgtgccgacaattcgcattccggtggacagtgatgttgcccatccactcagaggactagtatccaaggagctcgtcgaccgcctctcaaagttcagagaccgcgttgtcgcgctctctgaagatatctgtatgtcactgcctctctggctactggattctgaacattttgtaatgctaggatactgacaattgttctttgattttgttgtgttcggttgctgactacatatgaagattgcgcggatgtttcggatgtttcagagttacagcatgcccttgaggagtacttgccagttgttcttggtttaacaatgaaaggtctggccttttgcttcctaaaatttgtgttaatttcaggatcaagcttgatgttgacagtgaaattgttatgatttcaacagaaagccgtcttgaatcatcggtggaattcagatggaggaccttggatgatgacgaagtgagtattctggataagcgccaactgtaattccagttgtctgatgtttttcattgctttattgaaagatgatattttgaattcaggagtgttgtctttcaagtgcatggtatgaagttctgtcagtcatccacatgatggcgatgcttgcattgtttgaagccaacctgatacttattccgaagaacggtcaagttggaggtgaaaggaaggtatcagaaggtctgttcatctttttgctgtaaatatctctataatttttatgaatattcatacattggtgatatgtgcttagtttttaatcttaattgtaacatagttgaattgtctgaacaatattatagaatgcattttgatatctatacaaggaaattctatcacttgaagaatacattacttactaaatttagtgatattgatgaaaaatgaaacattgactgatttatttctgtagatgcaaagaaggatgtcgtcgattcgttgctcagagcatcaggatgtttagattactgcgtgcaccgtatacttgtacagatgccggcacaagtcaagtatgcctgaaacctgaaatgcacaaatccttgactatatatcaccttttatcaatccctttatggataccttttcagacttgctttgtactattgcaggaaaagttttcctagttattttcaggaaggtatgcttgaggccatttcaattcaagcattggctcaggtagtaaaatgtctcctttatataaatcctatgaataaaattttattttgaagaaactataatgaaattttgaggcatgcatttctttatgtttgtctccactatgaaaacagtgtgtagaaatacaacttggattggcttcagagtgtgagaaggcaactctgtcagtaaagaggaggctagcctgtgagctagtcagttatttctcacaggtaatgcaacttttttatttcagaactatatctgatcatgcatactgaacattgtctgtgaaatttctgatatatctcactattttcaggctcactattgcttatcgggatgcgacacgagcgactcgtttgggaagaagctcctgctgtttctgaagtggaaatgcatggaagccaaggttgcctgaacaaacaaaacaaacacagatcctgaaatctgcaagaaggccttgaattctgatatttaactcaatgttgcatcttgtcatcaggcagtagcatactactaccatggccttgtgcttgacaaaggcaatgaagccagcagccacatcagtgcagtgtgctgcctctctgcagctgatgatctagttgcagatagcaagagggcttgtttgagcttctgcttggcaaaccccatcacaaggtctgaattttctctgagaagaatgtatttttatgtgtgatgctaatcggaatatgcggtgataggaattttgtttctgaactgaattcagggtacctcctccttggggtatcatgaggaatatgcacaagaaaatcccagattctgcgtgcaagagattccaaatgtatggatatctttttgaacaagacaataacaggtaatactctgatctcaagagaaattccatgaaaatgattcaaaagctggaaattgaagcgaaatgctttttcgtgtttgttgatatgataattttctttggatttggctcaagaacatgcttgaacaatctgttcctcatctttattatgatcatactcaaactcttatttcctggagcagtgcacttcaatccttaccagatctaccagaatttgcgctgtcgctgagacccgaagggtatgaactgcctagcactgattcaatctgggataatgttgatagccagcctcagattcagagcctcaaggagcatctggatgatgaagacgaagtggaaacaaaatgatacttcagacatccaaaacgcttcatttcattgtgccatgaaaagtagcattagtactagcaaagacatcggaatgctcaattcagaagtgtttggattcagcatatggcattgagccaaaaagaaatcagaatatgtaccttctgtgtagttgaaagtatctatcactgattataaacagaatcaacaataataggaaagaagggtgtttcttatttttcatcttcttgctgctgggctgcaggaatt

SEQ ID NO: 40046 - DNA, 779 bp, Oryza sativa
atgaaaagcactcttagttaccatatcaaaatgaaaacgcactcttagttaatatatcaataaaaaagaagggcaaggataacctgactgtgatctacttcgtttgacttggttaatcgactaattattcccaaaagtatgtgtaagtggctctaaatccaaaaaaaaaagcactactaattagctgttcagcaaaaggaaaatataagagattaatgtatgaatttccgtaagccacctcacgtatcaaaggatgaaatctaggctcccaaatatacaacacagaatgaagcaaaagctgaaaacaaaaataaaatgtcaagactgtgaaatttaaaaaaaaacatctaataaattttaaagtaagtacccacatcaactgatggtaccacttcacagtctgaaatctcagtaagtatctcatgattttgtttgagattttcaataacatcataagaacaatcagaaacctgcaaatcattaagatataaaaaattgtgctttcaactaacatgaaatgaataaattcaaataagtaccttaatgtagggtttcagtttgacaagttcgctaagaaatttacatatctgcatgttgcatctgaagcaagtccttgtgtaaaattgtcgctgcacaaagtcaccaaaaagaagccccttagccaatataaatacacatgaatcctctttgcttgcgtgtctgtttgaagatggagtgtatataaaacgcttacttgtcggagagaagaaatggtcaccatataaggatgttgatagctg

SEQ ID NO: 40047 - DNA, 5727 bp, Oryza sativa
atccagacgctaaagctgcattcagcgctacaattgtctttgccttctctagaaaactcctgccacagagcacgggggaaagtgcagaaagcatgtcagaacgtctaagttcaaaataataatattcaattcaagagcaaaaaaaatatgaatgacttgcctggatttgaaaataattatacaattgttgacaaaggacaacaaggtccttgccagcactatcagctgcacctggattcagtttgtgtctttggcactggattgcacaagtaagctgattgtctagacgtctaactatagatggaagcaaatcatccacgatgaagagcctgagactcatatcatcagttgttgcaaggtgaatgagagaacgtaaaaaaggaatagccttgcttgttgcttcatcatccacaaagtacccaaagaggctcatatccagccagtcaaaacaatcaccagttaaaataaacctataagattagcagctttttacttgttctttatatcaaaattatcatccaacaaaaaagaacataaaaataacattgatagtagattacaagttagccaaagtagtacctaaagagagagattgatgacatagattcaggatcttgcaaatagttttcttctgttactgccaatactccaagaaattctgaaacttcacgagtgaaatcaagtagtaatttttgctgtagcttttctgtctcaccaaattcagaaaggaatggtacttcagctttccctttgtataaatgattgaaccaagcaaaattaagtacaaatttacactgtcgtaacatgggttgtacaaacttgattgccaatttcttggagaattcaggagggcaacacaaaaccaatggaatagctacataatggataaggctttttcaaatgcctcacttccatagaccctagatctttagtgatagtagcactgagagatagactacccaataactccgaaaatgatccaccaatggatggacatagacctatgccatcatatctgcagtatgacacaggccattataggatgaaatataaaagcagcaaataagtaattatcataacatatatttgctatatgagagttaggttcatgacaggaagctctgggaaccagcaaagggaccaacaaagaataaaggaatgattatttaggagaatatctaacaagtagaaaaattgaaatagtatatctgaaccactataaacagcatacttacactttctgttgaattccctctaacaatgctcttgtcttaggttcaacagaactctccacgatattaatgttagacaatccatcagtgattttaagtatatgagcaagctttgtaaggctcatatgtttttcttttttaagatcttcgaataaaccgtcaacaacttgattttcccgaagcgagtgtatatattgaatcagctgaagacaaagaggtcaaattaatcagatactatacatgtagttatatgcaacttaaaactatagcttcaataccataataccgtataacttagtttgaattaacacaaggtttatagggatattgacatgtagcagcaaagcaacaattgattgtaaacgtgttactcagcaaatatgataatgcacaggcattaagtttttttttttggcaattcacacaaatttagggttttatttttatgagatcaagatcaatgcataagatttgccactgttcactggaaagcactcggatttagtgttttgtttttataagaaaactggcctatatattgttttccatgtgagatttgcaactattgattgaaaagcattctaaaatttagtggtgggttttaagaggctaaaagacacaaattcaacattaatttattggtagtatctccataagatggctaattttcccgtgaacaataaaggattggaagattagaggctaaaagacacaaattcaacataaatttcttgatagtatctccataagaagactagttttaccgtgaacaaaaaaggaagacacaaattcaacatgctaaaagacttaactgaatccagttcctaaaagaaagagctaattcaaccatctaccatcttatgagattgagaagtttgtgatgctggcacagaacttcatccatctacatttgtttattagttagaaggaattttgttgaaaccattataatccctttgcagaaaaacagtacaacaaccaatcagtaaacaatgtcaacaatacagaaagacttgttagttagtatcaccggatcgatgtctgccacatgcagcaagtatcaagatacttccatttgaggacagcacgtttatgtttcggtgtgcagattaacttgatatacttccacacacttctaatatattaacgtgcaatccttttgcgctttcgtaaagatatacttccacgcacacctggaatttgcaggccggtcaaaacctaatactagcggacaattgcaattcaggttgcatttgctggacaagaaacctaccatggcttctggtaacccacaacaatttcaattttaggtttcgtatatcaacaaactcagtagtaattggcattagtaattaaaaaaaacgcagtctaagctacctgtttttgttttttttctgaggggaaaaaaaaagcacaaacctgctgctctgagagccctgaatctccagcgacaggagccgctgagtcaggcacagcggaggggaggacagtgtccatggcggtgcgggtaactgcttccaccgctcccgttcaccgccggcgcacctactcaaagctccggtcctcccgtggcagcgaaggcgaggaagccacaggcgagggccggagggccgcccgtggtagctaggcggcgccggcgtttccgcggggcgagagggcggccgccgcccgtggcacctaggccgggcggcgcgtcgattgccgggatcggggttagggttggggcagcggcgccggcggcttggcttcccgacttcaagttgcctacgggctacacgtttttttttttttctaaagtaaatttcactttagtccacttatatcgacctactgtaagttgtacattgtgctaggggtgggccactttttttcactttacaccacctatttttaccctcctttacaagttgtaccatgtttactgtaaggctgggtttcgacccacacaagtaggtgtacgtttactagcggccgacagtccccgtctctgggcaccagctgcgagggctccctcgacggcggttccgcctccctctctggtatgaccgtatgagtacttccctcccaactcaaaaaagtctcccttgacacgtgactgctgtgcagcaacataaactcaacaatcggcgcacaaacgccaccgtctaggtccaccgtccaccggctgaagaccctcgttgcatacggctggggcgaaaaggtacgtggtcgtcggcgccaaggtggagcaagtctcatcatccggtcgtgtcgccagcgtcagggcgaagggcctctgcgtattggacgcccatgccacctcgatcgatggcttcctgaggatggaatcgctggggtcgtcggctggctcgttactagcatgcttgttgggtttatgaggtagacaggtatgcgtctgctattcgatcatggagcaatccatggaggaatgatttgaccctgggacttgggagagtgaaacaaagcaatgtattcaataatttctatgagatttgggttttgtggggtaatcaatattcctctctactcttcgaaaaaactagagtaattaattcgtacgtgttcctcggttggtaactagaaacgtgtcgaattatctcaagaaaagaaaagatcggatcgatcttgattactgctaaatggaatagttggcttttttttcttcatatgcatgatctgaatgggatagttctggacttctggtatagtctcagatcctgtcaacgtaatcagatgtgtcgcgtgatcactacagggtccacgtccactggacgacgaaatgctcgccctcgctgatgaccaccccatcgacgcgtcgcacacgctcctggtatcgcgtaccaccgccaccatgagcaaattaaacaccagctgctcgcgtggattaggccaaagcgtagcctatgccgtaaacctggtccaacacgtaaacctggtccaacatgaaaaagatggtaaaattaggtggtgttaagtgaaaagagaaacttaaccctagcccattatgctacattggtcaatataggtggttcaactttttttaattggaatacacgttaattgccttcacacgttattggggattttaactatttgccacttttacatttgtcaattgctcaaatacccctcttaaatttttagttaataatatgccattggatagagaaacttttctacttttttgccacttttcacactgtacactgccacatgggcttgccaacgtggaatgggcacgtgaggaatgggcacgtgaaataacgaatttacccctgtctccagaacactaaattaggttctatcccctctctatcctgattcccctcgtccgtccaccaccgtcgccgggcaacgccacgccgtcgacgtctgtccgccccgcgccatcgacactggtccgccacacagcttcaacgtccgcagcaggcattattctttttggccaataatgttgccacataatttagaccgatgtggcaatgttattatgtcacgccagctaggctggcatggtcaaaacgttcatatcttagaaataatttttggaaatgtttgtttttaaaattacataaaattttgaaaagttcaaaaaaataaaaaaaataaatgtgtgggtattttgctatttctataacactgccttcgtttttttaataaacaatgttgttaacttttaaacacatgtttgttcattttatttaaatttttttaataatcgatgttgttaacttttaaacacatgtttgttcatcttatttaaaaaattgatgtaattatcatttattttgttacaagttattttatcactaaaagtactttaagcatgatgattttatattttatgcatttactattttttccatgatgatttatattttatgtatttatatttttttaaacaaggcaaataaacaaatgtgtgtttaaaagttaatgccgtcatccattcatctattaaaaaaaacagagtgaagagtttatgccaccaaagataagtttaattttagccgttaccgagtgaaagatgtattggatgggagtgtgggtgcacatctacacccaaatcccggtcatcttcaacccaacttcaaatgcatttctccccgattcaattgagttgttcatactaaaaatcctacagtgattttttttcacagatattttttaattaattacacatgaaaattgccaaacgtcgtaactcacggacattttgccagttactattgatgttagatggattgtagaatagcaaaagttctcaaatgagtaatgaatgtttacagttggttacatagtataggctttgacaataattatgtcacattcataattagcttgggtcatgttacacagtatttgtattggtaaatcccacgagctacctctaggagccgatacaaagaacaaatggaaagggtgttctcaacatatttcatcgagctatttgttttctttaatgcaagggacagtcagtacttttgtcattgaa

SEQ ID NO: 40048 - DNA, 1648 bp, Oryza sativa
gtttagttccaacaatacgcacatagtaatccaaaaacaaaaaaaggtcaatacactgaaatatctaatgtcagatgaaaagaaaacttttgttaactgccaatatgactagcataagatagttgtactcttgatagagtaatcattaaattctgggtatacttccatgaatgttgacaacctagctttacaacactttttaaggatctaatatattatacgttagactctaaactctaaagttcccacttgaggaaagtaaaaatctggtttgagcatttccatgtgtaagtttttgtttcttcaattttccttgcagtctgtatcttcaagagaatatcgcaaaatggtgagctgggattaaacaatgttccattaaaagtctgtccacactactccctccgtcccaaaaaaaggcaaaccctaggtttctgtgtccaacgtttgaccgtccgtcttatttgaaaaaattatgaaaaaaatttaaaagacaagtcacgcataaagtattaatcatgttttatcatctaacaacaatgaaaatagtaattataaaaaaatttcatataagacggacaatcaaacgttggacacggaaacccagggtttgtctttttttgggacggagggagtaatagattaacaaatttctgaataaggtccagacagcatgaaacaaatttgtatcttatggctcattacagatgagcaagtatgcctcgccgcaagctcagctctcaatgaaagccacgatcatgatacctttgcttggacacttcttttgcattagtccctagccaaaacatcaagctcgccataaccgtgactgcttagcctccttgcactgcaatgcgctacactaatcccagaaactagttactaatagaaaataaacagataacaattggtataaaaggaatagaaactagtagtagctagtagtcaatagaaaataaacagatatatagcaattagtagaaaaacttcagtggaaagatcccaacaaaagaaatgaaactaaggactaatagccttacaacacagctgaaatttaagcccatcaactttacaaacaagaaatttatcagtcaacttgataagaaactctaaaaaaatgtgttagaggaataaaaaaaccagtattcagacacaaaaaaatcttattgcaaaagttatttttcattctcattgtaatatatttatatatgcacaagagttctcttatatacagcaatgctagaaaaacatttagagatgaattaagctgacctctcaatattcaatatccagttcaagaacaaaattttgagcttggagaaaaatcttttccaaatttaaacgaagctgacattccagatctggatcccgaccaactaattggattttcgattgggattgtttaacctgtgattaaaatataaataataattatacctaattgaaagttacggttgtggtatttataaacacgtaccttttctggaatatactcgttttcatgctcaaataggtctcttagtccatcaatgaaagataaaccagtttctgtggttggtgcttgataattagaactttgagttatccagtgaggcatagccttcgcccattgtaaactagcattcatgaatttcaccagttcgctaatgat

SEQ ID NO: 40049 - DNA, 2729 bp, Oryza sativa
ccaaccagcccctaatcggcgaggtacctcgagtcccaagacactcgagaagcgccgcacgctccccgtgtggcagctgaaggacgatttcctcgctgtcctccacgacaaccaggccctcatcctcgtcggagaaaccggaagcggcaagcactcaggtattgaatctgcacctttgcctgtacatctccacattgaactgtaaaagtattttagattagtcattattggttgtttattaggggattttttttccttctagatggaatcgcaccacagtacctcgacccccaaatccatcgatccgccgccatcggttcaggggagtggcactccggtaggccgctcatcgagttatcttgatttcccgagcctccgctcatccgccaccacgcgtgttcggggttctctgcgccatcgtcgccttcatcctcctgtttgcacgctgccgccaatctactgactctggtatgcaagtcctaaatcgatcttcttctccattgttgtcatccttgcttctatcctctgcatcgatcgatttgggtgacctatgttgtgggtctgtgattagggtttcaatacggagtggacaaagtgttccagccattgccctagtcgccttccatggggcatgagctcttctgttggggttcagtactgagtggagaaagtgtgttccggccactgccgtcattgccttccacgggacagtaagctccagcaagcggatataggtaagcttctatgccaccattatcttctctctggattaggccataaatcttgattccgatgcgtgcctacactcttccaactgctcccggtcacggataaagcttggccacttccccgctgctgaagcatcattagtttcaggcattaatatctaacatttgattcttttccttgtagatctgcatttccatccgcaacagctcttcatctggtctgcctctattcattttgttgtcaattggttggtttcaccatcctttactctacaacagatgatttgcatggccattgtttcatgcgcaggaaattcatggacggtttacaatgtaaatttgatgttggatggtgtcttatctcgaccaaagtttgtcaaattcgcttgcctgttgctgcgttgtataacttgcaacctatttttcttatagccatgccataagcttagatgcaccttctactcgttgcctcatgtatgcagccgtgttttgatatatatggtgcagtgactttgtgagcagctcagtttaatagaaccaaggtacgttctcttctccttttgttttaatatatttgcagattttcagaattcttcagtagcttaatttgattttctttacaatcttataggtaagatggttgatctcgatcattgtttcaaattgattgcctacaactctttgaaatagaaggtaagttaaccagacattcatctactatatatgtttgtgtatgtcatatacttgatgaaatgcttgatggacttagcccgtcgatatgcattattggttaagtactcaaaactgcacactgctgtcacttaattttagatttctcattacgttcagttatattagattcaggccttaagggatatggcagctattaactgtataatattttgacccaaatgattcagttctagagcacttaaagatggctattgcaggtattataggccagcacaaagtttgttgttgttatctctttgttgcttgcagtatactcatatcacattgaagccaagttatgctatgtattacgttgatttggtcatgaaacgtttctctctattcaggaagcatttttattcaacaatgtatgcgccttctttgctaaactactatgcagtggatgtgttcatgattgttttcttctgatcctagcacattccctgagatatccttcaaatatgatgacttcaaagtcatcgtgtgccttttttcctctcatatttacattgttatgcctaggacaatagcttcagtttaacagtgcaccttcgctgcttgataattgcgatgggtaagatactatcagtcaactgtgaatgtattatgtactaatgttgtttcacctctacaaagccaaaaaatgaagttctccctagacacacccaaaccttccaagtagagcaataattttattagcaaccattatttccacatatctatcgcctctttgatttaaatagtcatccaagataaaggagttaacgcaataaactaaatgggctgctcattttgtttaatgtccatagatttgcaagcaggaatccctcaatctatattttctttgcttggcaggagttacatttttttagatgacatccagtagggattcaggccattggagcttgagggatacacaccattcagtagtttgagaaattgatgtttcaacttcgcctaaatttataggttaaatatgatactaattagttgtgcttgtcgtttttagtaatcagtgccacatataaaatgtagctcaagccatttttttgtgcttttacctctcctatcaaggtaggactgatgttggcatttgggaacgccttttcattttctttatgtaatgaggattaatgtatttccaactcctaattagtaaatcacaacaagaggaaagcaataaggatataattaccctttctaaattgaggtgatgtatgcaagaaactagccaattgaaataaccaggctatgaatgtaatatgaaaa

SEQ ID NO: 40050 - DNA, 4953 bp, Oryza sativa
gttcattgccaacagtgttcgtttttccaattcctttgctttgcttataaaccacacttatcgtcgtgtttttttttcatggtggtaatctctatatatctaatacaaaagctcgaatttgagtttgaatgattttaggcttggctcgaatgtgggttttggctcagcttattagcagcacgtacgcaaatcaagtctggtcatcaactcatgattaattaactgctataaacttagacatagatttatttatttttaataaacttctatatagaaagtttgtatcaaaagtgtatcttttttagcagttcataaagcgtgctaattaaaaaggcaagggagtagctaaatcctaaaggtgcattcaaatcacccttagttatttacaaattgttagttacaatatattacctccgtcccaaaataagtgcagccgtgggaatccttatctaacgtttgactgttcgtcttatttaaaaaatttatgaaaaaaataaaaaaatagtcacacataaaatattatttatgttttatcatctaataacaataaaagtactaatcataaaaagtttttaaataagacaagcggttaaacgttagacaacagtgcaaaactgcacttattttaggacggagtgagtttctaattgaacaatatggagtttctaatgaaaacctccttctcagtgtctcttttcattgtctgtactacacaacatgacgtttgcaaaagaagactaacagaaatataggaaattacatttaaaaagacataaggtctagaaaataaaatgtcatgaagtgggtgtgcatgctcaaaattttcgtacatgagtttggtgttacaatgtaatttttttctgaacgcacaaaagaaattacatgttattcctttaaatgttattcctttaagatgaaagaagggtttacacaatgtaaaagtcggagggcgtctgccagggattaggggattgaaggattaataccagaaggtgctattagaggaatgatccccaaaaaaaaggaagaagggaaggaagctacataggtcctatcctcctaggaagcccactagaaactacagaagtattgatacaatgtcacatatatactcacatagttactatttattagtgcattcaattatttattgtgttgatcattattttacccgagatgcctgatttaatttgtctccagttttcttctcctgttcggtctcccatattgattttatctatgacatatgctaatgacctttctataacccatttattcatgtctcatatatattgcccaaatttgctccttggtaactgcgatgaggttttctaaagcaatgggataacaattaggtaggagatcaatacatacatgacaactagagctagagggatccaagaggtgtgccgcccgactacttgagtagaggcataacctgtaggttagtattgaagactattgggaatctgagatgagagaaccctgatttagtagagatgggggaagaaaaaaaaatgaaaacttaaaattaggcggtccgataaatttttcaataatacttttgaccacaactacttattatgaactatatgagattgtaatataatcaatttttccactgtattgacaatgcacaacatgcccgatggtatggcctaccctttcacatcatagaattactctgcagcggcagcccggcaaaggtatcatccatgacaaacgagtttaccctaaagattttaccataaaaatttgaatactataaaacatcttaaatgaaaatttgaacaaacataacatagaatttatttaactagcgctatacattttgtgtaattttacatacaggcaacaacttaagttgccaaataaaactcattacaaaccaagttgttaccttctaatataagctaaaacgtaattgttgtgaaaaaaaacaaatacagttttatactccttctgtttcatattatttttttctactagtgaaacattttttaatttgaccatatttatagaaaaatatagtaacatttataaaaaaaaaaatattatcaaactgtatccaatgttacatttaatgaaactaatttagtattaacaagttaatttagaaaataatcaacatgattataaaacagatgaagtataatttattcaagcctcttcatttattaaaactgaaaaaagaaatgtaatttgagaacaaaaatcccttgctcatctcccttcccttccgttcgccatctaacgaactttcgcggaataggcggttcccacttccatccatgtccattcccctttttcctctccccttcgctactcgccaacagaagaaaaaccctcacctccactcccccctcgccggagccacggcgaccctctccaccccctgccttgccgccggcgagtgtccttgcgtgcgccgccggtgagcgggtgtggatcccagcggcggcgcgatcggccttcgaatcgaactgaaaggtattgggctcttctctctcgtaactggggatcgattagatcggtgttagattggcctatttgcgtccaattagccgatcctatttcgtcccgatttcatttatatgatccgtggtgcgtgctgcagtactaattgcaattttgtttttatttttttttgcaaaataattggggctcagctgaaccctcgttgccactgctgtgaacatgtcccaaattgagaagatcgtatgagctatggggaattattaggattcttggaggcggcggcggcatatggtgttcttcccggaggaggtggtggagcacatccttgggtttctagcgtcgcaccgcgaccgcaacgcggtgtcgctggtgtgccgggagtggtaccgcgtcgagcgcctcagccgccgctcggtgctcgtgcgcaactgctacgcggcgcgcccggagcgcgtgcacgcgcgcttccccggcctgcgctcgctgagcgtgaaggggaggccgcgctttgtccccgcggggtggggtgccgcggcgcggccatgggtggccgcgtgcgtcgccgcgtgccctggcctcgaggagctccggctgaagcggatggttgtcactgatgggtgcctcaagctgctcgcttgctcattccccaatttgaagtcgctcgtccttgttggctgtcaggggttcagcactgatgggcttgctactgtcgctaccaattgcaggtgagactaatgcaagcttctagattttgtgtcgtaatgatctgaatttaggagtcctccattagatattgactttgttggctctgactgtttaagttaatcttgcatagccattttaattagctatgctttacctattgttaggtactcaggttttcaaccttcttgatgttcagtttatggcaatgctcaagtctagttcacatcatggaacctcattcgtccttgtgtacttcgtttcagtttaggctatatctatctattacaggtttagagatcataatcgcgtaactaaaactgtcaaacacaatgcacaagctcctcacaaaatttaggggcaatctaagttttgcataatttagtttgaatctccagttaaatacttacactatttttttgcattagttgttattagttaacactcttttattcatatcaaatcgtgtgatatgatttgcttgtctatttattgggattttgtgtgacttatgtcagaagataattattgaaatcacgaaaatatcacatattcatttttccatgagcacttaactgaaatacttcaagattcctttatccatagttctcaatgtttatgtgaactccatatagcaaggtggaaacaccaagaacaaccatgtaatgttggaaaattgagcaagtcactgctactagtatattgttattgcaattttaaggagcactggaaacacttcattgtatacttacacatgtttgggaaatgttttgactaataaccaagaaacagtgctggagggtggagaactggagatcaacaaaaattatacttcctaaatccatcctaaaggactaaagaaatttaaactattcactgttttactttttcctatctaatagcttttgcatttctcagtttcacagtttcatttataagccgtctcatgtttttttaataacatctattgaccttttactccaaattgaattatgataagttgtttggttatttggatgatatcatctttaagggtgttcaccatccagtattttgtgcactacctgtttgtttttggtggaactggtggtcagtgctcaagaggcaccagtgctaagcatatttcatcggcttgattaccttgatagtcatttaatcatagtagctggcaacaatttggacaactttaaatttgtgatctcatacttctgttctgttacataaagctaactttagatttattttcacctctactgtctctagtttttctgcagaagtattttggctgacacaatgcatcttatgaattttatttataactcttcgctcttagatttatgaaggaactggacttacaagagagtctggtggaggatcgagactctcgttggcttggatgttttcccaagccttctacattactagaatccttgaatttttcttgcttgaccggggaggtgaatagtcctgcattggaaatactggttgcaaggagtccaaatcttagaagcttgagattgaaccgttcagttccacttgatgttttggccagaattctttgtcgcagacctaggctggtggatttatgtacaggatcttttgtacgaggcaatattgttggtgcatatgctgggctattcaatagttttcaacattgcagtttgctgaagagtttatctgggttttgggatgctacaagcttgtttattccagtgattgctcctgtttgcaagaatctaacgtgcttgaaccttagctctgctccaatggtca

SEQ ID NO: 40051 - DNA, 11083 bp, Oryza sativa
tattgaatttatttgtcaatgcaagaaactccaacaattgtgggtaagacttactagaagtaatgcaaatgatttgctagggatttatttaagtaatctagttatgaagtgtgatactgtgttggttgtttatattttcaacttacaaaatttataggggttgctggcgaatgggaaaaaatataggtgtttttttgcgaggttaagtacactgttaacgttcctgcagtcgataggtgcatttgttgtgacttgtgaggttgattatactgtttccctgtttacaagaccgttgcactggaagtatatggaatgacagtgtagatgggatatcattttcttcttatttggaacttctgttttggcaatcatatcctacttcaatcagcttatggtttgagttacatgcttagtaggcaagaatttcatatacttaaacaaaccaaaattcattttagtccactttctagtaactctcactgtttagcagaggtgaattgcacccctctgagttaaataaaaaaccacaaatttgtttgtgcgaatgttgatctgtttgtgcaaatgttactaaaatatctagatggtgagatagatttacaaatgttctagaattttgaaataacaacgttttgaattttcctgtatctttagtaatgctaccatggttttaatgttctgatttgtgttttggtcgcatcatatacagttcaacgtttgtgtcaacatggtactgattccttgatattggaagattgttaattgataacttgataaaactagtctggatccacttcataccagggaaaaagggaataatgccaaatatttgttggactagagtatcaatgtgacctaatcagttcactgtgtgattagtgcacataatgacacaataaatcaagtataataataattggggtgttatactcaggttagataagctttgtatgtgggttgtgttaacaactatttgaatagaagttaaagcttactaactgcagtagaatgctatccctatgtttcttctatttgtgatgcagttgttggttgtttcttcataaatgtgttttggttacctaggccttatccttggtttcaggtgttagatcacattggtgatgaaggattgaaaattgtagcctcatcctgtatacagctccaagagttgagagtatttcctgcgaatgcaaatgccagagcaagcactgtgacagaggaagggctagttgccatatctgcaggctgtaacaagttacagtctgtgctctatttttgccaacggatgacaaactctgcactgattactgtcgcaaagaactgcccacgattcacgtccttcagactgtgtgttcttgatccaggatcagcagacgctgtgacagggcagccattggatgagggttatggggcaatcgtacagtcatgcaaaggccttagacggctatgtttgtctggacttctcacagacacagtgttcctctacattggcatgtatgctgagaggctggagatgctttctgtagcatttgcaggagataccgacgatggcatgacctacgtgctcaatggctgcaaaaatctcaagaagctggaaatcagggacagtccttttggtgacagcgcgcttcttgcaggcatgcatcagtacgaggcaatgcgctcactctggttgtcgtcgtgtaatgtcaccctggggggttgcaagtctcttgcagcaagcatggcaaacctcaacatcgaggtcatgaatagagcagcaagtatcaatgaggcagacaatgctaatgatgcaaagaaggtgaagaagttgtatatttacaggacagttgctggaccgaggggtgatgcgcctgaattcatctcaacgttctaaatccatatatttttgaagttgaaggtttgttcttcgacaaccaccttttgtttatatcatactctgctacgtcgagttgatctacatgttctaaagatctatctatcttcacggtcgaagggatcttctaggattattttgtgtaaattcctttgctatcacctctgctatgtcattatcttccagcagtgctacacttatgattaatctccaaaattgaaactctatagttatggttaacttggcagattgattacacatcatggtaacatctaagccttgtaataccataattctagcaagtcatatgcgtggttcatcttcatgtatatacgatttcatatcgatgctctcatgtaatgtctgggaaatttgaagtgccaaattgttacttttctgagtcgaaagatatgatcagttaagcctgatgaacagctgattcagtagttggaccctccaatttgttgcagcatttcagcactggtcaagactaatctgtgatttacaagttgagaatttgagtagatccccatcctgtttaccttcaaatactctgaaatttttctttctgatgtcgcaatccaatgtccatgtcgctgcaagacagggtggcttggaagtcagtcatctcgctgtcagttgtagcgtgggggtgtactggtgttgctcacagtttgatatcatcatcatggccatcacacaacatgcttattcctgcacggtttagcaagctttaattgaccaccatcatcgcttgctgtttgatcattagtactacatcaattggagtccaaattccaaaatgtttggttataattgcttcgaggcaattaagatgtttatgagggtaaattaaggacttgtttagttggggaaaatttttatatttgattgtcacattggatatacggacacacatttgaagtattaaatgtaatctaataacacagtaaattatagattccgcctgtaaactgcttggtgaattattgagcctaattaatccgttattagtaaatgtttactgcaacaccacattgtcaaatcatggcgtaattaggtttaaaagattctcctcgtaatttacacgtaatatgtgtaattgttttttcttacatttaatacttcatgcatatgtaaatattcgacgtcacagcgtgaagatttttgttttgggaactaaaggtgaaaacaacatgatggtaggaaaagaatgagtatgagcatgcagcgacgtgtgtaggacagtacgggtctgtgtcatcatgtgatgggagagccccattgctctgaaaattaatgtagagaagtttctgcgaacgtgatatatatacgatggagagggagaggggagacagattgggcggtgagaattaaatcataaaatcaggatctcatcgacatgtatgcctatgcttatgtgtcggcgctgcgtatgggtcacatgcacgcatgctactgttcgatgactctgtaattaacattatatttttgtttctttaattagtttttttctcaaagaatcaacccacttcttttttttttcgtgagtcgttgacgcaattcctgacatttgaccttatcaggtacgaatggcagtatggcagtgagaaccgagatatccagtacaagtacagtagaaaaaaaatactcatcgaagggtgataaattacactaaatttctcccccaaatgttttgattgatttatgtcaaatcatacacaagtactatatccgtcccattaaaaaatcaacatagcaccacgaatgtgatcatacatttgtccaaattcattgtattaaaatgtaacaattcgttttttctttcgtggaacagaggaaatacatagcaatgatacaagtgtactggtaatagtgacacgttctttatgaactgaacttcataaatatttgatactcattctgtcccatattgattcctagcaattcttagataaattagtaatgagaaaatcaaacaaatactattgacaagccagcaaatatttgatattcgttctgtataatgtggcgtggaggagagagatgcgagttgagatagtcaggccggcactttacatgagcagtcgcttgcacgggtacctatgcaaccagtgggatccatagtaatatctccgtcccaagataagtgaagttgtggggaaccatgtccagtgtttgaccgtttgtcttatttaaaaaatttataaaaaaattaaaaaaaattagtcgcccataaagtactattcatgttttatcatctgataacacaaaaatagtaatcactgaagcattggatatgaatagtataaaactgcacttattttaggatggagggagtagtagcaatgtagcatgcatggagggagcatggcttagggttgtttctgagaagttggttggaagaatataaaaaagttaggtttcctaactcctggctttgaatttattttctggattctacagctatagcttcttagaatctggacacgtttttggtgggctcaggtgagacttttcatccattaaatgtatcatgtgtatatagcctcgtagagctttaggtggtgtttggatccagggacttaactttagtttctatatttagacactaatttagagtattaaatatagactacttacaaaactaattacataaatgaaagctaatttgcgagacaaattttttaagcctaattaatccataattagagaatgtttactatagcataacataggctaatcatggattaattagactcaatagattcgtctcgcgaattagtccaagattatggatgggttttattaatagtctacgtttaatatttataattagtgtttaaatatccgatgtgatagggacttaaaagttttagtaccatctaaacagggtcttatacatcaactcttcgactagggctgtgtttagttttacgctaaaattaaaagtttgaagaaaaaagttgaaaatttatgtgtgtagaaaagttttgatgtgatagaaaaaatgaaagttttttaaaaaaagttgggaactaaactcggcctagctatatataaaaatcggagtaagcagtaagtttttttattgactttgatcttacaaacaagtaaataaaagtacgccgctagtacaacatctagtaaggccatgttcctgcattagtagcagatagatttttttacacataaaacgagataaaccattcaaacataattaatcaagtattaattattataaatttgaaaatatatttatttgattttttattttttattatatatcagttttaataaaaatatcgtttagcggttaaaaaagcgtgttaaacaaaaacaaaaaagtttatagtttggagttatagtctagaacgggacctaattagtactgccagcaagactataaatacgttgagtgagttgactgagatctatcaggattcggtcattcccaacccaagacactagacatagttttgataaacttcacatcatcatgaaactagtactagacactactctttcaatgcaaacatcactattccgtacttaaatttaatgctacttatctcacatgatgtcttggatgttgtgtagaaaccatgtcttatgcaagacatggtttccttctctttcctcatttattcacttgccacatcatttttcattctagatggcagcttatttaatgctatggactctatcctggtcattgggttgggaatgggcttataattatttccatcagctttgcttgcttgcatatgatacataggggacactggacacaccatctgattaagggtgtttagttcgccaaaagaaaatttttggtgtcatataggatgtttgaccagatgttggaggggttttcggacacgaataaaaaaactaatttcataactcgtctgaaaaccacgagatgaatttattaagcctaattaatctgtcattagcatatgtgggttactgtagtacttatggctaatcatggactaattaggctcaaaagattcgtgtttaatgctctatgcatatgtccaaagattcgatgtgacgtttttaggaaaaaaaattcgttatatatatagctatttcattggttcaaaaataaatcaatcttatataggatatgacacattctaatatgatgaattcaaacacaaaaaaatattcagattcattatactaatatatgccatatttgttataaagattgatttattttaaaatcgtgatagtagatacttcctctgttccaaaatataagggattttagttggatgtaacgtatactgtactataaatctatacagggtatcataatactactattatgaatctagacatgtttcttatctatatttatattactagcatacgtcatattcaatcaaaatgctaaatatttagggagcgagggagtagggccataggagatggaggacgacatacttgtaaaatcaaaaggtgtttttgattattattctgtgatgaacaattgggcattggagattattggttttgttatttggaacttattcacgaagtggttttggagatgattggattttataggtgatcgcaggattcgtcattttatgtgaccggtcagaccgggatctggtagccggtcagaccggcgtgtaatgcgcggtcagaccggcgcagcccgcggtctgaccagccgacactgtgtcggtttcggtttcgggttgtttatttggatatccgagtttatttcatgattataacttctagatggatactatacgtatgtaatactattgtttgttgctaatgagtcaagttggagatagcttggtctcggaatatagtttctttgtttgttccatatgtaagtgactcgatgtcttgggagagtatttgtggtgatggaccgggagtcggcttggggataagacgacgtccgtggtggtcagagatcatgcaggatacttaggctagagttgatacacgtggttgatggagattctatatggcatacgatggagttattgtgtgcatatgggatgcggagtcgaatttggaaggagtccaaatttggtacgattggttatgtaaagtttctttcttgtactatagagttttctaaagtgtttaggactcctagtatgagtttggtttgtggctttaggctgcctacctcatatataaatagagggggagcgtgaggcttcccggtatcgctttagagaccaattgagttgagttttcagttagggtttcaagtttagtcgaaatttttgtaaggagtgctgttggtgcactttgtaaacacagagagaatcaataaagtcgtcatctactttaagagttcttcgatttgtgtttcaccgggtttcggcggtctaaccggcgatctacgggcggtcagaccggcggcaagtggcggtcagaccggcgggagcacggcggtcagaccggcggcggcgacaggcgcggcaggcgactttggcggtcagaccggagattcaacaccggtcagaccggcggcattcactcggtcagaccggcagatcaatctcggtcagaccgatctccgtcgatttcgagggtaacttttatttccgctaaaagttttcggtttttggtataccaaccattcacccctctctagttagcttagttcctgtgatttgatcctacctgtatgcatggaagaacgatgaatcagcataatcagtgcgatccgatattgcggagagcagcttgccgccggaccaatcatgcaaccctacatagtgcgtcgaaagcgacacgtgcatgcattctcgttagtggaaacgtacaatcgaactttggaactttctacgtgtgtgtcatttggcgcatttaactttgagcaaatttcgttaatgaaaaaccccaattattatattttatttagaggaagttcatattttgagagacaaaatgtttcaaggagccccaaaattatataaaacacactcattttcattgttatatatgctttcttaatatacattcacaaatataataggcgcaaaatgcccatatattcctcatgtctaaattatattcttcctcaccctcgctctctatgattgcacaaacactcaacacaatcctcaccgttaatgacagattaactggttacatacatacaaaatggtttatacttttgataatttacaagtgtaaaaaatggggctaatgtgtatatatacttgaaaaatatcacataccatttttttaaaattattatatataaatatattagtcaaatagataatataagtttaaaaatagggttctcgaaacattttacctcaaaacatgggttccttggaacaaaaatcaatacatgggtttgtgagttacacaagccaccaaaacatgcgtttaattttgtggaatttactctttaactttcttccggcttcattatagtgtaattcttccactgtctttgccgctcgatcacatcacttctcctccatcttcattggctccaatacctcctatcaccatcctacactgtctctggtagctcatgccaccagctcccacagccccctaacagatcgaacggcgagattcctctgctaccaacaacgacccatcgctctccttgatcttgtgcggccaaggaggcaccaccttcgtccaccccaccacggcggccacagccccaccaccattctaagctagggaacaatcccatcttcccctaaaacctaaccactcaggagttcactggagacgaagacataactgaatcatataacaaaccgtaaggtcagatattcacacattttgcctacaattaactttatactcggcacttctcctactctaacacgactcgatcaacggctaactttgcataatttgcgacatctactaggctaacactaagcaaagatcggacgatccacgtaaagtgtaaccaacaaaataaaccgtgaccacaccagtcgggcaacccttgtttatttttatgtaaaaaaagatggaatgctacagctgcgaaatgaactaaacaactgcctaataaaatgtggcacacgtctaacatttagaagaataaacctcaaattaataagaacaaattaactaaagctagctatgtactccctccatatttagacttgatcagcatatattaatctataatccatgtaattagtgcatcgaagaaagaaaattattgcttaatttggtggatgtttcattcactgcgtgaaggtgaagagatgcagtgattccctacatataaattaacagtcccatgcgcatacaagcacagattcattcacttcatatatagaaacgaatagaccatgagtagagtaccaaatatatgtgccgatcatttatgaaaaacatcgaaatcttattatgacgatcatttataaatagagggagtatgcatcaatgatgttgagagggcagacgtttacatatgcatttaacctaccactgcactagtgcacacccttagacaacattgtaggatcataggattgacaagatggatcgaccatagcttctaacctacctggctggcatggcatgcatggctgccggatctttgcattggtggttgttacatgcacataaggttaagttgacggtgtagtcggttgggtagttgccatcactcactcatgcatgctgaatacacagcgcaaaagcagccgacaatttgggattagggtttctttctcctggccggcccctcggttcatttattttctcaatccgacttaatgtgcgattgagcaatgataataatgagctatacacttacgtgaaaaagagaaaaaaaatgagtagtattggctctcacgtataaaagtttagctctatacatgctccaaaaaatacgcattatagaaggtttaatagagtatacataaccgctgacgattaaaagtgccacttcagattggagtgatcaagagaccgtatgtttagcagctggctattaacacgaactccaatagattgatccatattttttaatttaactttcacacacaaaatgcttttacgtggaccccacaaccgtatttttactggttggtggcttggtgctgcctgtctcacctaggaatgtgtttggagccaacagttcatcttccagttcatcacttctgcatgcatgcacactacagaaaaaacctcatatacagaggcacttttgtagaggcgttttgtaaattacttctaagatcagaagttttatactgtagagacaatttatagagacactttaaaaattgcctcgaaaacttttactctagaaacattttcagctcagtttatttgattttatcttgatgcattctttcggcacggtaaaatgtgcctgatatgtaaaggcattttcttaagacattttagactatgtagagacactttttagaatgataatgtgtactaaaggactaaatataaataattaaaggcataaacatacgagtaatgacatggagttgagttggttaatgcatcaagagatcttgagtttaaagcctaactaaagcaaggaaactattttattctcctcttttggactagtttcatatgtttggtacaatttaattcctttttttactagtttcatatgtttggtacaatttaattcctttttttactagtttcatatgtttggtacaatttaattcctttttttactagtttcatactattttattctcctttttttttgactagtttcatatgtttgtggtacaatttaattccttttttggactagtttcatatgtttggtacaattaaattcctttttttgactagtttaatacatttgtggtacaatttaatgtctctagaaaatgactctaccatctaacatgcattttataaaatatatcttcatatgtagagacaaatcatcataagacacttattagactttttaaaaatgcctctacagtattgtaaaggtatttgaaaagtgtctctacagtaatagaaaaatatctctacaaagtatttttcttatagtgacattataccatcagtttaaactgtctattatacttgctcttaataaatttatagtaagagagagagagaaggaaaacaaatagagctaacattatagacatgtacatgtgagctctgcaaggaaaagcgatcgagctctactattaaacttgctagcttttaagttaaaacacatgtgat

SEQ ID NO: 40052 - DNA, 19765 bp, Oryza sativa
ccatcagccggcctttctctagcaaagacatgtgtatacgcttaattgtctctgcttatatattgtgattgtatatattaacgcgtacacgccatctatacttagtattcatgaattgtgttgtgttggccatttagcatggaattaatgttttcttggtaaccaattacttactaaaacaccacttgtttgattcattggtttgtctggttattgtgattgtatatgtgtgtatatatagtactaccagggcccaaccctactggaattggaggtagctagctagctagagaggatcagtatatatatgtgtgtttatctcttgtatgcttgctttgattggtgattccaacaataattaattaactatatcatcttcttggtgttttcttaactttgtcttacgtgtgggattagtgatgagcctcttttgctttggccggcctctcctgcatcgtgcatgtgctttgttaggtcgattgatcacatccctaggcagtttactgatttgccagaaaggaaataaaaactaattaataatgtgctcttgagaaaataaaatccctttttaattgtgaagagaaaatatccaatacacacaagcttcctgtgtacactctgtgcataccaattagcaaatatcctagaaaattctagaaaaaattggacacatacttccaatagtattacacatatctgtaaagtctcatattcaaattcattatattttagccgtaacaaaaatgtgaaaaatctggcagttttaagagttaaaatatatcaaaattttgtctttttgttacggctaaaaaatatataatgaacttttaaataagatttcactcataggagtgtgttcattttctctagaatgtgtttattttttctagaattttttatgatatttgttagttggtgtgcacgaaatgtgcaggataagcttatgtccataggatgtttcctatagtgatatgattatttaggcatatatattgctatagtttttcactgtctattggagctatagctgcaaaattgtcatactgattcgtgcacacactggcattacttgcttcaacaacagggtgtctcaactagcatgtacacgtgtcacatgaagataacactttccaaaaaaaatgcctggctttccaatatttttacaaaaggaatattcagcaaacaattaacaaactataaattactcaaatctagcacatatatgtgtatgtactatatgtggcaagtgcactgttactttctcacagttgctagtaggcagtagctccctatatatgcatggtcctctaatcccatatgcattcatgcaatatggcactaattaattacaattaattcgattatatatgattatgatgacacaggagtacccagcagctacggcctacaaactacaagccagcagctttctgttacaccttccgcttaagaaagcgatccaatctctcttgttgttagcaaagctaattaaacttaattgatgagatgccaaatgcaaaggctttgatttgccgctgtcagcaaagctctctctacttttatattttgagcgaaaatttgtcagctagctcttgcatggatatattatcatcatatcgtacgtacgtacagtgtcattatcttaatccaataattaatctgggttttactcttttgctccctagcttcttgttgtttctttcacgtcgcttttggtagtacacctaggcttggtccgggtgcatgactttgactcctcaatttcgtgcataaaattgacaggaaatcgggaaggaggtacggacgcaggattttacaaaagatggggggtacaaacttgaaaagaaacatcaattaacatatggaaaaacttaaaagtttttttactagaggaaaaaaactaaactatgtaaaaagatataaatagtagctcactataaaaacgattttcctgtataaggagctcttttgattgcaaacggaccgtaattggtcgcgtctgcaaaaaaatcctcccattttcgcgtgcagaccgttaagagtatcgcaagcgaaaatcgattttcgcaggtgggcacgtaaaaataagcctatttttgcaggcggatctcttaaggggccacacgattttcgtgtgcgggcctcttaaatgcccgcctacaagtctatcctccctcctcttttccctgctcaacacttcaaaatttcatccttatccactcatccttatcctctcctctcctctcacactctctcactctgtctcctccctcactgtcctctcgtggtcatgtgtgggcgacgcggccgacgacgggcggcggcgcgtacggcggtgggcggcgaacgcggacggcggaagcgaccggctcggtggccggcggatccgcctttgccggccttgcgatgggcgacggtcaacgagggacggaaggcggtggatccctcgctctcccccgcacagctccggtggcaggctcgagcgggaggccggcggggctctcccctgccctctcccgcgtggatctagcggcgggcggcgcggtggccactgccgacgaggaggaagaagaggtggccgggaatggcgtccttggccccaccacggccggacccgtgccccccgacgatgacgaggaggaggaggcggcaggcgggagtggcgccgccagccccacgcgcacgcgcgctgggcggatctgcgccgccctcgccgccgacaaggaggaggaggcggcggccgggagaagatccgctggattctagggtttttgttttttcgaattttaattttttccatgcgggcgacgtaagcaaccgcatgcgattttcgcgtgcgggtgcgccaccctcatattaaaatcagattttcgcataccttttggtgcagacgggttgggcttacacacgcgaaaataggtttcggcccgcacagaaaaattgtttttgtagtagtggattttttttgtttgaattgtttggggttattttgcaattttggaatcaactatagtttagtcaacaaatcattttacacatatataatacctaacaaatccaagggtatttaagaaaattttgaggtataagtgtagcacatgtcccatgctgtgtccgccatgtgtacgtattatatagataggcatagatatcatgatcggtgttttatggagaaatttttgtatgggcctggaatatttggaagcaaaggaatagtttcatctttgagaatactcttccttccttggtttattggagaacactccttaagggtgatctccttcttttgttatttagactgaatgaatgtgaaaactatagtcttgaactggattagattgtggtaatcttttatattttccatttattattaataaaattttttaacggcgggggcctccctgctgtgtttcttataaaaaaatgtattatatagattgcatattattgccaccttctttattgtcgataatgtagatattaagatggtatatatgtggggatattgttttatcattgactagattatcatgttaaccccacgtatgatataaccgctataaatttaggcccatatggggtaaagggaatagtttcaaaagttcaaaacgatgtacgatttgatagagttcatgacttaattttataattcagtgaaatttccaaattataaaatagatttttgtcatggagaaattgtgaaatcatgtgataagcaattgtcaaaagtaagtgttttgtgaaattgtagtgaatagtatttttgaatggtgaatagtgtgcttggcactagaggctgatcagaccgagcagggccttccaagcagatcggaagtgtccgagcggtttgatcgggcagaccgacgactctaggagggagtcggtttgaggtgtttgggtggattttctagattgcttcatattgatgacttctagatggtttctatacgtatgtgatattattgtgtgctgatgtgagtcaagtcgttggtacaaacttttactcggatatggagtttctttgttattcatgtgcgggtgttgcttgaaaccaatggagtattgtggtgatggatctggacaaggcttgggagaagttgagatccagacggttaaggagatcatgcgtgatactaaggctagagaacgatgcatatgaaggtgaaggtttctatatgacattacgtggtgttgtgtgcatgtggaaaaaggagtcaaatttggattggagttcaagtttaggaatattggagtgtgaagttgtaaagggatgttgtttccctagtttgaggggtttcttatgtgattaggagtcctaattatatttggattcgtggataggtgtagccatgttttgggtataaatagaagagtggttgaggctagaagtatatcaacttttaggagagaaatattagggtttgcttctaggcttcgattatagttcatgacttaagagaggagtgctttggatgcacattataaatatcttgatgcaataaatttgatctatattcaagatcatatttagtttgattttctctagatcccaacggtctaaccgatggcaaaggagcagtcaagccggcagtggcggcgatggtggcagcaagtagacgaggagagcgactggaggtctgactaatcggtaaggcagtggtctgatcggtgaaaagcagttatttgaccaatgttatctagtggtctgaccggtgcactccattagatttaagggtccttttagttccataaaatgatttggtttttgtggtcctaccattccctcctctgatagtattcgatattacaaagtggtatcacaactctgtttgctatttggatctttatcgatctttgagtttttgtcatgactgaaaagttttcgaccaagccttattttttttatggagttgattttccttattggtgcaaaaaaatgaatcttttattatctcaaagttatgatatttggcaaaaagttgataacccctacgagatttagtgttgttctcaaagttgattttgaaaataattgtaaagcttgcaatattcttgttaatggaatttcttgttcgaatttcgatcgggtttcgcgtcttgacactgcgcttgagatttggatgtctttatttgattttcattaaggtacttccaataccaaggaattacgcaaagaagtttttaaaaagaattacataaaatttgagatgaaatctggagaagctttagatgactattttgcaccttttaacaaagttttgagcaatcttcgatttattgatgagtcttttgatattaacaattcttaatttgaaattgctcaatatcttttgaaaagtgttgatatgtaaatttgggagatgaaagtcactttgattcaaaagtctggtgatatgtcttatttgagttttgaattctctttacactaaactgaaaactcataaaatgaatattagttacctcaagactgatttgaaatctactcctttggttccttcttcgagcttccattgatgcttcttcttcatcggtttttacgagttttgagtgccatgtatgatgatcaatttgagcaactaggtgaggaaaccttggttttgattactaacaagttctcttgagctttgaaaaattcgaagaacatgaagcgaggttgactagttcggtgctttgagtgtggagttcaaccacatcaagtacaattgtcgtaaacacaagaagacgatcaaggaggaggaagttgacaagaagcataaacaagaaagaaaaaatagtcgcaattagcctgaggaagaaggatgcatagctattgtgcatttttaacattccttaatactctctctatttcatattataagtcgtttgacttttttcttttggtgtggtagttcttcttctgctgctagaagtacatgtatgatagtcttttaccactgtcacctgcaaatcaaatggaagaaaccttcaatatacaatcattatgagacaacatacaattatcatcgaaatcaacaaatatataccatcactctctgctgattaggttgcttatgcccaacagtatgccaagggaaactttccactttacaaccacctatagatcgttcaggatcagtttttagcacatgtagctcaaattccttgtttatggcaaattgccacatagacaatctaaactccatacttaattctagccttcatgcaaggattatcagggtcgtgggggcatcaccaactctctaggcacttcatgacaggtattgcagctcctttggtgtcttcagtaccaccatctgcaccggtagcagcatctgcagcacccacaccatctgcagcagcataagctccatcaccactaacaacctgtttagacatctcggcttgctcatcctcagccctcaaacccagcaacttgtagaatttttcatccccaatgatatctagccacccttcatcatcatttgggggcaagaacctctagcctatcccaatccacaatatcggtaggaacatatggggcatcaacaatagggactgaaactagtccattaccccatcggtcgcaacgaggaaaacaaaatcgtcaccaaattcaggtccagctaccacgatattaggttctaacatagctaattaagctaagcgcaggctcctcctcaagcttgaaggaaaaaaaaaggtggacgaatgttagagtcctctctaactgattcgcaccactcgcaagaacaaatacatgcaagaatcgatttgaaaaccaaaaagaagttgaagttcttaccccatcagtagctcatgccaggtgcgctttgtcgataccatcctgcgcctaagctagcaccatttggtagtgacggttttgtgcgccaggtgctaggttgccactcgacatggtggcctcgacgctagcggcagtggcggtggcggtgatggcgatgacgggagcggtggtggtggtggcggctgcggcgatgatgggagcgcctggatctggatcccctttcctctgctccacgagtggccaagctaaaagaagcagcttgtaggggtattttcgtcagcccgggtgcgaaatttggtggaaatggagagaattagcgaatatggtaaaagaaatatttggcatcgcttgggcgtggcattttaatgaatccaattagcggaatgtcatttaggcaaaactctttagtagtggcaaaatgttcaatttcttttctaaaacggactatgcagtaattagtaaaattaatgaagcatccttgagttaaataagagacatctacttattttatatttgaacttaatttctactactatgtgcattgcgtttgctgctttggtcagcagtgcaactaatcgtctgaccacgaattaataatgccaataatgtctactatcaaggacactaccaacccgtactcacaagtggctctcaaattatccattaactgaaatgcgatgacctgtactatagtataaataaaaaattttatggaacgttgtgacttgtgaggattgctgatcacgctacgtaattaagacaatcagtaggtcgtcaaagtcattatggaagtaaactaacgaaaaacgtcgtgacttgacgaatagaaataatatatgttcttctcacctctcatgtgaaaattaattttggatctaacacatcatctttggcagtcgtcacggtttacgtcgtctatacccacggctctccatgattaaattgttgtttaattattcatttaaagggtttctaaaacaatccattttgctcttgcggaagatcaggggaaaaaattactagctggcgttctaactaatggaggccaccccaccctgcaatttatagctttcgcgaaacacaagaacttttatagaattttcatatgaattagttcattttatactgaatttctctagtaatttatagaaaaccaattgcatgtgcaggtgaatcttatgcttgaaaccttagaaccactatcttgaaaaattctgccaataattttgctgctttccaaacatgttttttttaagataatggaatagataacatatcagcctttgcttaatagagttatagccaattattaaaaaatacactcaaacaaagagtgtagttcaaataaaattaaacatactcaaacagaaataaaagtgaccaaaccaagataaaaagcacacaattatttaagtctatttgtaaatctccacccatagttggcaaaatgttgcatggccgccgtcttaagcttatgacatgcaaccttcgaaagcttcttcatcataccttaagaaacatgttagccaacaatcaacatgatctctagaaaatccttctgccagaaacttccttcgtctcccattaaatttctctaaatttccttcattaattccaaactgaactttataattaaagtgtgatatatataagtaatctaggtttctcattaatttgatagtattccacacagtgtagctggctagcagcatgcattatatttgttagacaggtgcctgcaggcatgaaccccaacaacctctaggaccaaaaccgcataacatgtagaattgggttccatgtgagtgcagccactttccaactctcacttgtctttcctcttatctcacccctcaccatctttccatttccactgcaaacagttggcctaccccccttatgtgtgatccacatgactgcctgtaaaaaaaacaaattaattaattaaaacaagatgtggaccccagggacaaaaaaaatacaggcaactctactgtcagaatactatataaaggaagtagaatacagtgacagtgctagtttgatatactagctagtagcaggtagtaattgcatggaggcattgttactcccttctttgtgaaaaaagaactagtaatttttaagctagaaattatatttttttatggagggaatatttatttgagatattttattcgttaatttttttcagacaaatttagtattaaaattttcagattaaattttgactatggatttgtcataaattgcattctttgtagccataaaaataatattggctgtgtttagatccaaacttccaacttttccatcacatcaacctgtcatacacacacagcttttcagtcacatcgtaccaatttcaacccaaacttctaactttggaaggaactaaacacagccattgtgtaataaaactataagagccaaattaataagagaaaaaaaaggcagctctactggcggaatactatatactggtatgatactgtgacagtgctagtttgatagtcctccgggctattaaatagccaatcttgctatttagaagtattaaacatagattaccgacgaaatcgattccataacctctaggctattttgccagacgagtatattaatccatgattagtggatgattactgtagcattattgtagcaaattatagattaatatacctcgttagattcgtctcgcaaaatagtgtaggggttatggaatgagttttgtcagtaatctatgtttaatactgctaaggccccctttgattcaaaggaaattcataggaattttaaaggatttaattcctataggaatttttcctatatagccctttgaatcaaaggaatgaatcctatggaatcctataaaattcctatggaatgcctcttcccatgcaaattttgaaggaaatttaacatgaggttctacctcatgttaagaatccttcgagtctttctctctcctcaaattcctgtgtttttcctgcggctcaatcaaacggtcattcctatgtttttcctgtgttttgcaatcctctgttttacacttgtattcctatcagaatcctatgtttttcccattcccccgttttttcattcctgtgattcaaagggggcctagatagcaagattttggagagctatttccggatccaaactggccaagctagtgacagtggcagatagtaattgcaagaaggcaggcagctattgcgtcagaagaaaaacagtgacagtgctagtttgatatactactactatatttcattcgctatttttttaagacaagtttaatttgaaaagtttcagattaaattttgagtatggattgtcataaattatattcttggtagctataaaaaatactgtaataaaatataagggacaaattaattaataagagaaaacaaactgttcgacccatcctatacatttccatcgctaaatctatgtagtaataaataatgtatctgctggaggactgggaaattaaagtggttgaaatagcttgtaaaatattactagcagtatcatgccacttggattttgaagactagaaagtcataacacgaaaattgatatagctaacacccaaatgtatataacaaaacaaatttgctctgtaatatggttatggaggaacggttaatttgtgaatctaactttgacatggttgttagggtttgcgagcaaattttcgtggggattagtatgcgtgtatttatataagtgcatgccaatgcactgtgttaaaaaaatccctttttttttctatacttcgaacaaaaatgttgtgtaaatggctcaatttttcctcttgaacaaaatagtcgagaaacataatttgttggaagtgccttacatgttaagctcctcttcataattcaaaaatttcacgaaaatttcaaaggctttaactaaatcctaaaaaaatcccctaaaatcactctgttcttaatagcacaaaaccctttttttccctttaattctcatgtaaattattattattctgaaacaaggcaaaatcatttccatataaagtattatacactctttaatttttgagaagcaagtattatacacttgctagtagtagttgctcctcctactgcctagtgtagtgtattaattcgagttgttggctttgcttcccctttctcgtggcgcgcagattcatcgcggtttcgcagtttcccccgccaacccattcccgctccccgccgcgccgcgcctcgccacgccacgccacaccgcgccacgccatgccgccgccgccgccggagtccggcgagccagccggggacgacgtcctgcagaaggcggagtgcctccggctgcttgacgcgctcccggccgccgcggcggcctccccggccttccgccgccactggccatccatctcggcgtcgctcgccgcgctctcggcgtcgctgtcccaccccgcgttcccgccctccgcgccgcgcctcctggcgcccctcgcctccgcgctctccgcgctcgtgtccgtcgccgggaacgacgccgcgagcagcctcgggcacctccacaccgtgtcgctgctgtcgtcgtcggctgccgagctgtcccagctcgccgccgacgcgcggctgctcgtgtcgccggggaatggtgggggtgagggggtggcggcgggggtggatgggctgatcccgcgactccgcctcgggtccgcggcttcccgcgcggcggcgctggacgcgctcgttgactccgtcgggtcgctgccgccgtcggcggcggcggtggcggtgtccgccgtggccgcgatgctcgactcgggggagatcctgccggcgtcgcgcgagaaggccgtgtccgtgctcgccgcgttcgcgtcctcggacgccacgtgccggctcctggcgcaggaggcgggggccgtggtgccccacctctgccgcgcgctggagtccggcggcgccggcgccgaacaggcgtgcgtggcgctgcgccctctcaccgcggactcgcgggacgccgcggcggccgtggcggcgcgcggcggggtgtcggcgctcctcggcgcgtgcgccgcgggcacccccccggcgcaggcctcggccgcgggcgtgctccgcaacctcgccgcgttcccggacctcctcccgacgttccgcgaggagggcgcgctcccgtcgctcatccagctcgtctccctcggcaccccgcgcgcgcaggagctcgccctgggctgcctccagaacctcacctccggcgacggcgacgagtgccagcgcctcaaggtcgaggcgttccaggacggcgcgctcggctgcgtcaaggacttcctcgagtcctgcgtcggcgacgagccgggcctcgccccggcgttcggcctcctccgcaacatggcatccttccgctacatcgccgagatagccgtctcggccagcttcgtcgaccacgtcctcgccgcgctgggcagcgacaaggccgccacgcgcacggaggccgccatggcgctcgccgagctctgcaacgtcaccagccacggcaagacgcgcagggacgtcggcgacgccatcccgcgcctcatctggatgctcgaggccaagcccgccgccgagagggacgccgcggcgagggcgctcgccgcgctcgtcgcggcgagcggctacaggaagctgttcaagaaggaggagcagggcatcgtcaatgtcgtccagctgctcgacccgagcaccgcccgcggtggcgtcgacgcgcggttcccggtgtccgtgctgctcgccgtctcgccgtcccggcggtgccggaagcagatggtggccgccggcgcgtgcggcttcctgcaggccctcctcgccgcggaggtcgacggtgccaagaagctcgccgactgcctcgccaggggcaagatgctcggcgtgttcccacggtcatgacacggctgccgccattgccaccgatcggtgaagaatttcagagcccttgtgaagatcaaatctttgagctgtatgtatgtgctttttaaccaacctgaatttttacatcctgcttttgctctctgtatcaaaaaatatgatatcaatgcttctgatgaaactttgtacaggctgcttgaacctttctgttccatagcttttagagtgctagatgatgcgtggtttttagtgtgatcaaataagaacatggaaaaagatcttgtaatttaatctttgatctgaagaaattgagcttcgtttgccgatgcgcattactgttgcttgtcaaattatcttgtgttgttcatttggcctgatggttttgtttttcttcagggtatatgcaattatgcatctaatgtcatttcataggtactataattgtattggttgaaatggatacaacaccgacaattgcatcattattcatgagaactagtggctaacagttttggttaacattttcttgtccgaagcaagtatggcattgttctcctcaattattaacttttgttctacattattgttctcctgaattatttcaccaaatgttctctttgattatgaactggttgctaatgagggtacaataggtctgagtggctcatttgctcataagtcataattcaatgtgtagaatagagatggttcctcttttaagatgagggatcagctttggtacattttggtacaagttgggcaaggcctacaataacttcgaacagagaaatgagtgtacgattctgcaatacccatccagtcgtgtctttttctttcctgactgtatgaccaccagtaaaatggttaactgtccactgttacttaagcttaatttttgttaaagtttatgtagtaatccttgttcttttgtagagtaattggtaattaggagatgttgatcctagcttcatttttaactggaggattactgatgggtttataagctgaagctagatccaaactccaaatttaagagttattttcagtaagatgttacctgatctagttgtttcactcgctaaggtccaacagatatgtttgctggtttcaattgcatgatttaattcacatttgttctgtcttcatagttcatcagtagaagtctgtaaaacaatatgtgcagagctagtgaaatgttgaaatgttaaaaaccaccctgtgttgttggtcaatggtaaactgcctatggactcaactcaaactcacatggggatggggtcaactggtgcagcaaatctaccactctggcacattaatgagcaagcttaaatgtgactacttgggggcatgctgggttaggtaaccttttttttcttctggaccagactgactcagattggagatgatgagcactacaccaaaggtttactagtaacatccatgcatatacactcacatacatccataaaggttatgtttagtttacactaaagtttagaagtttagttgaaattgatacgatgtgatagaaaaaatgtgtgtatgaaaggtttgatgtgatggaaagttggaagtttggaaaaaaaaactttggaactaaacagggccaaagaaacaaacaattcatatctacgaatctaattcatagctagtatttggtttattttgggatatattcatagccaggaattgatttatttcgaggcggaggaagtacacattgtgcaatcatgcaagaatcatcaatcatatcacactgtccatgatactggtagctatggcattctgttgagatgcaacattcttcttcttcagtccaagatgcatgcatggatgcacagccagccacatggccacaactcatggacacctggtgggtatagttggtgggcaatggtaggaggaggctcatgtcatgtgtattgctgtgatccaaaaatgctgaacagtgtcaggaaaatggttttcccagagagggggcatgccatgttctgatgctggttagttttttctggagtgagtgccctgaaccttcctctgatgataactgatccctctgatcgccactgttgtcgccttgtgatgaaccatcatgcatctctcatctcttcatgcacatcatcattatggcctcatcatccattacggctcgtttgctgattttttttttctgaacgggcaaaagccttttaccctgagcattgatatattagcaaggaaaaatagttttaccaattaattgcaaccagctgacgcatgtcatggaggattacatagagggggaatggcacactaggctaacggctagtgtcacagtagtcgttcgtctcttctttaatttggttttttttttctcttttcttggcataggtcggtctgactgattgcgtcgcgtaacaaatattctattcctctaatatattgacgtgcaatccttttgcgcgtttgagaaaaaaagcacactaggctacctaacgaagacaaccagactcaaaaacaacgagaaaaaaaggatagagaagagtctctgtgaatatggtaaggagagctcctaggggactaggtttcatcgtaacctaaaccttttcttcttacacgatgtgatcgaccaaatatcactctctttatacaaaaataatcacttatagtatacttatctactccctccgtttcacaatgtaagtcattctagcattttccacatttatattgatgttaataaatctagacatatatatctatctagattcattgacattaatataaatgtgggaaatattagaatgacttacattgggaaactggagtaagtagatttgtaaatacacataccataggcagttgctgtcgtagccgcagtgctagctagcctagccgaacgcaacctatatcttgcaacagatggagtaatatttaacttcaaccttcggtctccttgccaagttgagagtttcaggcatgaggtgattaatcagcaaaggcaggcttaacactggattgggagtcagtatcattagctcctaagcctgggacggtaatggtgcttaacactgattttttttttggcaattgcaaatttaccactactttaaatcgttatcgcaagattgctactaaaaaattataaaaataccactaaaactatcattcaaatgacatcgttataatattaaaaaaaccggtgacaaatttacaaatgcccctgcaccgacgcacacggagcattgcagttgcatttgcaggcagcagcactagctgagctgtcggcctgatcggcaacggccctgcgtgtgccttgagcggcggacggaccccggatcctctgcgcccaaggggacctccggacctgtaatgttaagggcatcgtgcgtcgcccgaaaattaattgtaaaccgtaacggtatactagcgataaaaatatgttgattacactgtttgactactcgtcttatccaaaaaaatttatgtaaatataaaaaagaaaagttatgattaagttactttggataataaagtaagtcacaaataaaataaataataattctaatattttttaataagacgaataattaaacagtacaagtaaaaggtcaaaatctcttatattatgtaacggagggagtattaggtatgaaaaattttaacttaaaagttagtatcgccgaaaaaattatttttacaactatctaaaaatcaaatttaaaattatgttttaaaattaaaatctttactttggcttattcttttttacaaccgataggaatagggaactatgagaagttttttttattttctttgaaaaggtatgattatataattaacacaatccccacggtaaaaatatacttcaaacaagcaattacaacgcttttgtcctaacaaaaataaataaaatatgtgctagagaaaacaaacaggcttcacttattggaatgacgaaacagtgaagtacggactgctgaatttattttcctcgagaaattcgatctgaattatttttccttgacaaatccacacatgtgacattttcgtgccgccaacatgttttccttttttttaattaaccgatagttttgctttaataaaattccagcacaaaagaatcttagaatattttcaaataaaatcttgactttccctatttcttagtgaaaggagaggaatcacagagagttttccggcaaaaggaattatggacaatactcttggacacgaaaattaatggagatgccaaaacttgagccataagaggagcaaaacatctctcagagtgaatatcttagtattttccatccctatgtacagtttattattatttttattattacctatttagctttttttttcatgctttgatgaaattgggacaaaccaatattggtttgttcatatttttttgccctatttcttgtataatcgagtataattaattggagccggactgttgttcaaattagcatttgtcaattgtcaatttgtcatgcttccaccagaattggactactcctatctgaattttgagaccactgtgtttcaaacttaccgacacaatgcttggctaaattgtgagacaagccacagtgaaatcaaactgttattatgtccatggtgaagggctcaacgcactaaatcactgtttagtgttattaacttcttcatgcacggccgtagaggtggatcagagacaattaaaaatttttccggctatttataacggccacagtgaatccaggacattgacagctttctggagaaagggctcttctgtttagtgttaaagatgctgctgctgcgtgctttgtttgacctcactaatctcgcttttccactatggaagtctttctagctactccctgcaactgtcctgtcctttgtgttttcctttttgcaaagttgaatcactgttgtagaaggctgaaaagaaaatttttaggtgtcacatcggatgcttgactgatatcagaaggggtttttagacagaaatgaaaaaactaatttcataacttgcctgaaaaccgcgagacgaatcttttgagcctaattaagccgtcattagcacatatgagttactatagcacttatggctaagttcaaaagattcgtctcgcgatttccatattaactgtgcaattaatttttgtttttatctatatttaatgcttcatgtatatgtgcaaagatttgatgtgatgtttttaggaaaaaaaattagaactaaaccagcccttagataatatagctaaacagtgcaagttcatggatggaactcgatcgtaagctccaataatgactcgatcgttcggaacgcacaaattttcaatgttttcattggatttagttcaattattgtattttaagaaaattctctattttacagctgatttacaggatttatgacagctagcttaaagcatactctctgcatgaaaaagatcctttttaatttttaggttttccaaaaaaaaaacatatttttatcagtggggtctactctatttcttaatatcactgtttcttttgggtacattttatgaaaccctacctattatggtctaagttgcacaaaaccacattaattttggtgcgtcacataaccttagatattatgatcttaaagtttcataaaaccataccgttaatcaaattgatatactactgtatcaaaattttaaagctatacttatatacttatatgaatataacatttctatgatgaacaaagagcttataattttgagatgtaattgtagaattccaaagtatgatgtaatttctatgatcaaagtatgatatcacataaccacactattgttcattttgactttgatctactttggtggttctttgaaattttatagccataatacctaaaatcatatgccacgtactgaaaaccccaaggttttgtgtatcttagattataatacatgtggatcggtgaaatttactcttttcttttcaatttttctatgcaaccattagactcccttcgcctcctcgttttaaaaaaaacatttggaggaaaagacgtcccttcaattttttttaaaaagaacaaattatgagcatatgattgaacatgggatattgggattactacacacctcttgtcactgcactatcaattatatctttcctccttgttttttccccttagtttctctattcagtaatgaagggtatgtttgtctcttggctctttgcatgatatgcatttgactttataaaacatctttcttggctccttgcatgatatgcatttgactttataaaacatctttgtgggacggaaggagtatgcaatagtaattaatatctgacccacaaaactacctgctgtgctagtagacaaatttgttgatgtggaaggaaaagagagggtgaggggagaaaaatatatattaacctttttgacttgtcatcaatcttcgacaccagctacatacggtgaattttgttgtatacttgtatgtgattagcgaagatgaaaggtaaataaataataataataatttgatgtattaatttttagagattggctccccgcaataaaaaaaaaagagattggcactatctcaactatatatactactttaattaacagactcaactattttaattatccttatgggtaattttaaaggaattaagagcttaataatatgtcctcacaaaataatagcttaataaatagtattatatattgtgtagtactatgtaattgggaaagacaactctagtagtgctagatggtctagctcgtggtgggtgaatcttagcccaagttcctcttgttcgagcgtggactgaaattgggcttcgatagcttgggctttaggacgaatatttaacttcttccctgaagcaatagctacatgatttgtgcacaatttccacacagtctataatataaaaatgcaaatttggaatagaagtagaactttccaaaaaaatggacttaatttcttttcgaaaataaacaagccactgcagatgttacggcacaattagactcttatgtagtgcttaaatagttggaatccatgcatttttctagtttgacacaactcacaaccttctcagatgtttt

SEQ ID NO: 40053 - DNA, 723 bp, Oryza sativa
cattatgtggttgtttaaatccacgtagccatcacgcatgaagcttactggttaccctccatcagacaaacatatatattcgatctttctccggtcaagttctagcacaacaaaacacaagccaaaacaccatttaaccacctccaagcttcgcattccaagagaccgagcgactgttcagccagagattaatcagagaatggctggagaaggagatgatcaactgaagcttctcggattgtgggtgagcccatacactcaccgagtgaagcttgcactcagcttcaagggcctgagctacgagtacgtcgaggaggacctcagcaacaagagcgagctgcttctcagcaccaacccggtgcacaagaaggtgcccgtgctcatccacaacggcaagcccatctgcgagtcgcaggtcatcgtgcagtacctcgacgaggagttccccaactccggcgtctcgctcctcccatctgactcctacgatcgcgccattgctcgtttctgggctgcctacatcaacgacaaggtaatcgtcaaattgcctcggttaatcgatctgaatttgcatcgattgatgtgatgttgtgtgcgtgtgctcgcgtgtgtcgtcgttgcagctgatgccgtcgtggctgcagtcgtcgatgggcaagacggaggaggagagggcggaggcgctgaagcagacgttggaggcggtggcgaacctggagacggcgt

SEQ ID NO: 40054 - DNA, 1217 bp, Oryza sativa
aatcccaaaatatccaaactcatgttttgtttccttccttgactccttgaacccttgtgtacaaagtatcaaatttagattcaaaacccaaactccaaatctctccaaatcaaaatctttcagcaaaaatctattttgcctcccttgtcgatgggctgatgtcacgccccgaactagtaccgaccggaactagcccgtgacgctccaaattaacctgttaatcgataccagtcccaggaaacagtgctggtatcacaggaagacagaatatcacagcaacagaggtctctttattatagagtaggagtacaatcaagtcgggctgcggacagatcccgagttcacaactgcattacaaaagggaagcggaagccaggacttggaccaaacaacataggcgcgacttgggaactaggccgaaaccctaaaactcatcgtagccggcttgctcctggaagaactcctcgtcagcgggatccgcttcatcttcttcagcaactgggggggagattatttatgtacagcaagggtgagtacaggagtactcagcaagccatgggaaataagtgtttaatgcaggcttcaagggaaaggctgttgtttttgcaattgattttatttaaactctttttcgaagcagctaagtgagtgcttctcaaacgacacggatgagacagtgcgtctcgtctggtcggagtatgtgcaatatatcagtctttgaattgattcaaggttggcacccggccaacagctttcaaacggccacccgggcctggctgatcccatcagccgcagattttccaaacatcgatcccattccacaacagcaatttcacaaagcagtagtcaaacaaaactacgctaggaatcacctcacatccgcccatgaccgtgggtacggctgttcgaacagtttaataacctctgcagagggggtacactttacccacacgacattactaacccggataacccagcccgtgcagaacggccacgtctggagaccttgaggctttcatgacaaggcatttcgaaagccaacacaggtttaccatatgccaacaagaggggtcccagaccaacaacaggttaggtcccagaccatactgtgccaggaagcccgagggttctccccgacaccaccccgttgaatccacatgtctcttggcatcatggctcccccgattagctaattactcagccaggggcgtcccatt

SEQ ID NO: 40055 - DNA, 714 bp, Oryza sativa
ccaacgatgacgtctggagttgtcagcacatcctcggcagtcacgtggttcacacgaccccgaatgacatccttaccaccattgttggggcggggaggcgcttggccttgctggcgcctcggctttgggcatttatccgcaaagtgcccgggctcgaagcagttgaagcacagacgctgctgaccttgaacttctctgcggccttgaccaggctgcacaacgggcgcaggaggacggggcacacgggtcccttgctgactctgctgttgctgcggctgtgaggaggatccccctggatatggattggtgtagcggaccctttggttagccccctgttgattgcggagattcgccaagcgacgcttctgcgactccagttccttgtgcttggcttccaagcggatgctcttgtccaccagacgttggaaatccggatagtccccggagaccagacgcacggacagctcagggtccattcttgccaagaacttctcttgcttctcctcatcttcacgaacatcctccggggcgtaccgggccaggttgttaaacccatgcaaatactccatcacagagcggttgccttgcttcaactctcggaattcccttttcttaagggccatgactccggcgggcacatgggtcctccggaaagcggcggtgaagcgggcccaagtaataggctgcccctctggctgcgtagcctggaagtgg

SEQ ID NO: 40056 - DNA, 716 bp, Oryza sativa
ctaaggcttccttttttgctttctttattttcaatagtttattgctaaaatggttacttatctttcctctccctttcaaaattgtagatggcagtgaacgccagcttcagttcccacggttttggtgagggtcaccacgtcgctcagcttcgtgacctcgcccgcttccttggcttctcgtgtcctgagtacacggggtactctgtggaccgtgttccctctcgttatgagctttcggtgtacctttaccctcgtggaggtatacacggggctggccttcgcccacaccacttcactgtggccaggcccactctccagatcgcgtaccaggacctctcctagactgcacttcgtcgcttggcccacgactacagccaccgcctcgggggctctgcctttcggcagctcctgcgccttccttctggccgcactgacactaggtacccttgcccgtacagcgagtctcagcctgtgctgactcgcatggttgagctctctgaggctcaggccactcagcacgacctactcctcgaggcttcccgctcccttgctcgccgctacgctgctttggaggcccgtctggccgaggagggtgtcacctcagttgacactgtctcttgggacttaggccgcctctgccacgccagccgcctgtcctcccacagctctcgcggctctgcccgcactcctagtggcccgcgctcccccagctcgcg

SEQ ID NO: 40057 - DNA, 1827 bp, Oryza sativa
agtataagaaacgcaagtctacccatcagggaaattcttcccgaggggaacctcgccctcgctttggacaacccatgcaatatcaccagtcagtcactcaggctaaccgccagccaagctatgcccctcgtcctcagatgaatcgtctggcacctcagccgcagcagcgtgccccaagtggcaataccgcgccaaacagtgttacctctttcaagtcaccgccaggactatcagcagttcagtgtttccggtgcaaccagatgggtcactatgccagacagtgccctcagaatcttaccaactccaactcagggcataccaatggcagcaccgccagaactcctactcctgcagcagctcagtcccgtcctagcacgcaggcaagtggacaaggttcccgtgcttccaacaactttggtcgagaccgagtgaaccacattcaagccgagaccgctcaggacgctccagacgttgttatgggtatgttctctgtcaactccgcacccgcaatagttctgtttgattcaggagcatcccattctttcatatcgcaagcttttgtgaaaagaaatggttggaaaacccaaaatttgcgagtaccaatgatagtacattcccctggaagggatataagggcaactaaaatatgctcggaagttaaccttagaattgaggaagttgacttcctagccaaaccgatagtcctagactcgcaaagcttggacatcattcttgggatggattggttggctaagcacaaaggacagatagattgtgccgaaaggtccatcaccttgcaaggacctggaggaaagcaagttcgctttacccccaacactcttactgcaagtcggtctatcctaaccagtttgcaagccacttctttggaatcggtacccatagtctgtgaatatcccgacgtatttccaaaagaattaacggaaatgccaccaaaccgagagattgagttcgccatagaactggcactaggcaccgcaccaattgcaaaaagtccctaccgaatggcagctaatgaattagcagaagtcaaaaagcagatcgaagaattggagagtaaaggttatgtgcgacctagctcatccccttggggagccccagtgcttctggttaagaaaaaggatggctctgagagaatggtaattgactatagagccctgaatgaagtaactaaaaagaacaagtacccgttgccacggattgacgatctgttcgatcaactttaaggagcaaaagttttctctaaaattgacctaagatcagtttaccaccagttgaaaatcagatatgaagatatcccgaagaccgctttctcaacgcgctatgggctgtatgagttcacagtgatgtccttcggactcaccaatgctccagcattcttcatgaacctgatgaacaaaatcttcatggagtacctggaccagtttgttgtggtattcatcgatgacatcctgatatactccaagaatgaggaagaacatgttgaacacctgaggctgataatggagaagctaagagatcatcaattgttcgctaagttctcaaaatgcgaattctggctggaccgagtagcattccttggtcacgtgatctcctctaacggtgtcgaagtagatcccagcaaggttgaagctgtccttgcttggtatcctcccaagaatgagtcagagatccgcagtttccttggcctagctggttactatcgaagattcatcgaagggttctctaagctagccagacctatgaccgagctgttaaagaaggaaaagaagtttgaatggtcagcagcctgtgaagacagctttcaag

SEQ ID NO: 40058 - DNA, 1726 bp, Oryza sativa
tctgacccgggaggtcggtacattaccaaatgagctgttgaaaacatctcttaaagtcaaatcgagacgcaagtctcttttcggcccaatcttagaaagaaataaatcacttagtgatttcaaaatgatttcaaacaaaagatttgcaaaacaaccttgcctctcttccaagcttgcattaaacacctaagttcccgtgacttcggagtacgaaagtactcacccttgctctatataaatatatatatatagttcctccaccctgaagggaagataaagtgaagtgaagatttgggtttcgtcctggttcccagccgtcgcctgtggtgttgggtgttagaccgttggttccgctgctgctgctgctgttggtgtttcctcgtccgcgtcgtcggttgtattctcgggctgtctaagctgcaacctatgttaaggtaaataagtcctccatttattttaaggattgctatgattcatatttgtcaccgtgggtgccagcactatgtcctgggactggtactgagatcgcagtttcgtaggaagtggtttgcgccgttttccctacgacacgctcctgtcaggtgccgttgtacggcggtatcagattggggtgtgacaatttaactagtatgtattaatgtaaagtcaactaaccattgtaggggtgggttttttttttctgatgtggaatacatgagagccccctactggaccctacctacatgacctaatcattccaccacacctagcaagaggatggtgcatacttacaactgaaaaaaaaaggcgtggtgacactaatgtttgatctgattaattatttgaaatgctaccattttaagcattttcatacaaagaagaccatatgtgcacattttcattcaaacgaaaaacatatgtacattgcccatttttcacccacaaaaacaatgttgcatggaacatttgattgtggcaacaatgttgtattgatttttttttttgcattttcaatgaaatacatctggtcatttccatgaaaaaaattcaaataatattgtaaacacattcccattaaaacatacatttccaaatatgcacatttaatttccatgaaacatgtgcaactccattgtacaaaaacatatacatgttgaaaaaataacaactgcacactaccattcaaaagaacacttagcatcactctttattgccccccttatgttttctttttcagaataacatctgcattttacatccgtatgttgcctattttgtttcaattttattataactatttaaacggcatgtgagaaatgatatagttcgccattgcaggcttaaaatcatttgtccaaacatcatatacaatatatgataatgagaaaaaaaagtctctgctacatcaatttttttatttaaaagaggcagttggtgttggtgacgatgagtttgccatcatacactctcatcaccaactaaaatacaggggccaataaagattgagacatacataccatccattcctgaagttacgaaggagaggtagtaatgcatatatacattaattatttccatgcagattaaatgttgatagaaaaatcaaagatttttataggataaattatgatgacacgagtcatatacgctaaatttgatatgcacttagagaaaagagaaattttacggtccttgagaggtagtactgtgcaaatttccattccttactggaggtactaagagataa

SEQ ID NO: 40059 - DNA, 1305 bp, Oryza sativa
tgaaaggggtcaaatttagaggtagtctaaatttgagaagattgatgaatgaattggaataaatgtgtgagggaacgccagtagaattgagagacctagctaataaatcaaaatttggagagagtgcaaaattaagaagattaggaaatagttagaataaatgcgtcagggatttctaataggattggttgtcctaactgatgtggttggttttgactatataaatactactagaaaaagatagcaattacgtacctaagatacttatgtggagaaatagaatgggttttagaatttctactttttcatctagagtttagttggtgagatgacatatcactactacaaaacgccggttcttaataaaaacaaaactgacacccaaatattgtcagtcgcatgtaccgtttttcttttataaaaatcgacacatataataaccttataggtgccgattttttaaataaaacgacaccctaaactgttgagccgagtcgatcgaccgagtcctttcgtccttatcctctcctcaccttctcctcccctcccacgactctctctctctctctcaaacttaaactcgccagtggaggtggcagtgtgcgtgctctcgcgaatcctaggtgagcgactcctagcggctcccacgcggaacgcgggcatgtaacgctccgctttttgcgtgacgttaaaaactaattcggcaaaatcctattcgcgaaaattttcgttctttgtgtgagagtctaagttgtgccaaggatctcaatttaatcctgttgttccctctcattgaaatcaaaatcctccacctcgaaaattcctcttccgattcgagtctccgaaatcaaattccgagagtcaatcccttcccttgaatcctctccaaataattgttcccattcccgaaagtatcaaactcccactttgtttccttactcgtctccttgaacccttgtgtacaagtatcaaatttagattcaaatccccttttttgaatcccgttggcgactccctctcatccaaatcccaattcttgaagtcaatctctcccttccttgaactcgttgccaaatctttctcccgatttcgagagaatcgatcctcatccaaatcatttccttgactccaccctatgttcccgagaacaaatacccaagtattccttttgaatcttttccatgacttctcctgagtttcccttgatacatccctaaaccctcgagcccgaatatcaaatttgaattggaatccaaaccctaaatctcaaacaattctatccaaatcagaattctctgtgaaagt

SEQ ID NO: 40060 - DNA, 1982 bp, Oryza sativa
  unsure (1)..(1982): unsure at all n locations
tagttggttcaagtctctaaatttttctaaaattgagatctacatgttaaaaatatccacatgtactgttcatgcttgtttatgtgctgttttggtgattttgctcttttcttcttagattccgtcgttaccggagagtccgtttttgcagaagaagaatttgaagagttccaaggccagcaaggcaagtcacacagatcccaaacaaccctttgagcatgttgatcctatttaaagctattgtttctattcaattattgcatttattttcgaatgtcattgggtggaattaacctattctttgttatagcccttttgttcttgattactttattccttgataccttggggtaatataacttgactagttgaactttatatatattggttcagctagatattagatatgattgcttagccatgcttagaaatattagcacactattgggataacttatgactcactattacttaacgatggcttaatgatagttcacgatgttctatcatgattggttaattaattaatgtgccaactaaaacctgataatggtgggttgtgagcacatggttttgatggtcgtgctcatgacaattaaggactggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtctatgccttgntataagggggtgattatctccaggaaaggtgcgctgcagtggattgtgttgtacgagaggtattgtcacaactcctttccgaggtaccggggtggtattgaggcacatggtgacatgatgtggggttgtgtcttgtgggtacagtggtacacctctgatcagagtaaaactattcgaatagccgtgcccgcggttatgggcgggtctaacaatatctttcgtgattagtctcacccttctcaccataataaaaggtgctttaattggtaataatttgattagctcctggtttggagatagaactgtgcagccgggatggttgttcagaatggttgggcctatacaacagggtatgttgtatagcgttggattaatattgtttaatacttaactgttttattaaattctgaaatgtttgctaaatgctgcttttgcaaatgaaaccctactatgccatcctttggtatccttgtgcacttgcatatttgctgcgtgacttgctgagtatgtcatatactcaccttgcaatcattcatcagaggaagagttctacagtgatgctgatggtgtggaggattaggtgtagccttggtcaagctgcctgtggagtggagccgtctgcgccgtttatctttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatgccgcccgctctcggagaccgcctctcgtcgccggacctccacggcgcctccccatcccatccgacgccacaaacgggatccctaagtcctagagatgctcccacccctttgaatcgaactcccgttgccccggtgagatttccccttctctccgccggcgatggccgccgccgcaatccaccaccgtcggctcctttcgctccgattcctctcgctgccacgctcccggggatccccttgacctccccctggctgccccaaggccgccggccttctcctttgtctccgcgtcgtgtcgccgtttccgccgccgcataacaacgccgcgcgtgcatcgccggtgaccatcgggtcccgcgtcaccgcgtgcgcatcacggtcgcgtaccgtttc

SEQ ID NO: 40061 - DNA, 1774 bp, Oryza sativa
atctgtgtgattcgggatgtctacgggcatcatagactaggcttcctgagtggaagcggattgttgtgctgctgggcagctggactctgggagtccgagaaaatgaaaaaggctctgggagccgattaatcaagtggaatggctctgggagccgagaagtaatgatctgacctgggaggtcggtacattaccaattgagctgttgaaaaacatctctcttaaagtcgaatcgagacgcaagtctcttttcggcccaaacttagaaagaaataaatcacttagtgatttcaaaatgatttcaaaacaaaagatttgcaaaaacaaccttgcctctcttccaagcttgcattaaacacctaaattcccgtgacttgctgagtaggaaagtactcacccttgctctatataaatatatatagttcctccgcccggaagttgaagatgaagtaaagtgaacattagggtttcgtcctggttcccagccgtcgcctgtggtgttgggtgttagtccgttggttccgctgctgccgctgttgttggtgtttcctcgttcgtgtcgtcggttgcaatttcgggctgttctgagctgcaacctaagttaaggtaaataagtcctctatttattttaaggattgcaatgattcatatttgtcaccgtgggtaccagcgctatgtcctaggactggtactgagatcgtggtttcgtaggaagcagttcgcgccgtttttcccacgacacgctcctgtcaggtgccgttgtacggcggtgccagattggggtgtgacagttgactacttaagaaattttatatatattaatgtgtagaaaatacaaatgaatttacatcataatataaaattatattgatgctagccgcacaattacatcataaatttatatagatgctagccacttgattgcgcaaaagcatattctggcacacaaacttcccgtgtactgtccgtgcacaccaactaacaattatcatggaaagttcttgaaaaaaattggatttgtgctcctaataatattacacatctttgcaacgtctgatattcaaatttattatattttaaccataaaaaagaaaaatctaatatttttaagaataaaaatctatcagaattttctcttttgttatggctaaaatataatttatttaaagataaggtttcacatataagtgtaatacaatttaaagtatgtgtccattttcttctagaattttttatgatatttgctagttggtgtgaatggaaagcttgtatgcataggatatggtccatgattgacctaacctactactttactttaataacaaataaattaacactctctatttcatattataaatcatttttattctttacttagtgaaacttctttaaatttaattaagtttataaacaaatatagtaacattttcaacaccacacaaacatactatcaaaatatataatcaatgttacattcgataaaactaatttggtgttataaagttactaaatttaatctgagtcaaacgtaagtttgatttagaaaaaaatatataatatgccgtcccaaattatagggcgccctcttttttaaagaaaaatcaaactcgataacttttggactcataatcatactaaacatatatatgctaagtattatgctttcatgtgttgctaagttcatattcgttaggaatatgatatggaataattttttcttgaactagggctttggaaagccccaaatatgtctctgaaaaccgtgtaaaataatata

SEQ ID NO: 40062 - DNA, 756 bp, Oryza sativa
attccgccggagctgggaaaggcagggaaactgatagtgttgttcatgtttggaaatagattatcaggcagcatacccgcagcattagggagtttgacaagcttggaggatcttgatttgtcagataatgatctgacaggaggtattccacctgagttgggtcatctcagccatttgacattcctgaagctgagccataactccatttcaggaccgattccgggaaatatgggaaacaatttcaagatgcagggagttgatcattcgtcagggaattcctctaacagcagatctggttcggatttctgtcaactgctctccctaaagatcctgtacctgtcaaacaacaagctcactggtaagctgcccgactgctggtggaacctgcaaaatctgcagttcatcgacttgtccaacaatgcattctcaggtgaaatccctacagtccagacgaactacaactgttctcttgaatcggttcatcttgccgacaacggcttcaccggtgtttttccatcatcgttagagatgtgtaaggcgctgatcaccctagatattgggaacaacagattctttggaggtattcctccttggattgggaaaggccttctgtcgttgaagtttcttagcctgaaatcaaacaacttcacaggtgaaatcccttcagagttgtcgaatctctctcaacttcaactgttagacataagcaacaacggtttgacaggattgattcccaaatcttttggcaacctaact

SEQ ID NO: 40063 - DNA, 1083 bp, Oryza sativa
cacatacggaagtatatcgtatggatgatggtataccatactcgtatgtttcgtcagtcataggataagaggtatgttttatccgtaaccatgatagattcggtatcacaacagcatgctggacggcaaaaaagctcatcattcaaaccttgcagtagcacgaggcataaggtaatagatgataatactggatcaaaatttctgcttattacttgagctacgaacatgctttctaaactgctaaacgatataattttttaaagaaactttttatatattttttctttaagcaatgactttatatttcaaatttataatgattaatacttaattaaatacacgttaattgctcgtcttattttccttgctaactagccaagcacaacagccatatcaaacgcagccgtcatcgatgacgaacaacggaacagccgaacaagcaagcgtcactgatcagatattacagtagttgtgccacgtgtgtagcacagaccaggcaagtaacgaggaacaagagacagaccagcaccatataagactatctctaacaataatacccttaacaggagacccattggacggtatgtgtcacctgtggcaaaagggtcacgcacctatttcttgccttctccaacagcgaacgcaaaaggaaaccctgcaacacggacagtttccttcgtgggcccgcgatgaaatttttacgcgggaaacggagggtgtcgtgcgagatataccgggcgcggggcgcgggactgcggtgttggctcgatggcgggattgttttgccgccccggctgcatgtgagaagggagtctcagtggcagcgaggtagccgccggcgagcgaccgttcggacaaggccgaacgttggcgcagcagagtcaatcagaacacaggtaatatgatttctagcatttgcttgttcgatgtcacattcccttttaatttgtggctaattccgttcgaacatttgcttgttcggacaaggccggctgcatgtttgcttgttcgatgtcacattccctttcaaaagaatgcaaagcggcagaaaaaccaaaagcccactgatctgtccaaaagatt

SEQ ID NO: 40064 - DNA, 2315 bp, Oryza sativa
accagcgataaaggagggtggggttggagagagatccaaacttgcgaatcctagctcagagcagatctcgccggcggcggagcttttcctatcaccggggccaggtgcgctttcctcttctctccgcctcccgcgaaacagttacgctaggtgttttggttgaggagagagggcgctcatatttgagttccgcctcggttggcacccaaagtaggtccttagtatgggtactctgttggaccctgtttttttccgctacagtagcctggagcacgcattttgggtttggttgtcgctatgcctaggctgttggagatagtctaacgactgcgtttatgcaaagcaagggcagtgaaagttgcaatctggatggattgtcagcatctcaaaacttacagggtgatggagaatagtattgcatagtagtggtgggcaagaaaaatggaaaactcaattcatgctttaaggggatatcccctcatttttacatgttacttaaaatgtcataaaaaattgaaaaaatttagtaggatagatcaatatgtgatatgtcactttacaaacatgcatattaaaattcaacttatacaagtagaaacaaaaataataaatttgactacgaatagaacgtgtaattcacagtcaaatttgttatttttgtttcgaattatataattcgaattttagctcgcatgtttgcgaaaagatatatcatatatttatctatattgataaaattttcaaatttttttataactttctgaatgctatgcataaaacgagtggatatcctcttgagggacaaaaatccacttccaagaaaaatcaatgaagtatattcaaaacaaattggtcactggctgaatagtttctacatcagttaaccctgcaggcagaggcaaatctctctctctctatatatatatacaccacctatcatagcttcgtacctccaaaagacaaggagcccaacaaaacaaaagccaaaagctccaatccttgggacgtactactgcttaggcctcagagcgttggatagccatggccggaggaggagatgacctgaagatgctcggcgtctacgtgagcccattcccactgcgagtgaagctcgcgctcagcttcaagggcctgagcttcgagtacgtcgaggaggacttcaagaacaagagcgatgtcctcctcagctccaacccggtacacaagaaggtccccgtgctcatccacaaaggcaagcccatctgcgagtcgcaggtcatcgtgcagtacatcgacgaggtgttccccgacgccggcgtcaccctcctccccgccgatccccacgatcgcgccgtcgctcgcttctgggctgcctacattgacgaaaaggttcgtcagatcaccatgcacttttattgattacttgatttctctcttatgtttgtgaattaagctgattgatcgatctgcgtgtgttctgtgcgttgcagctgttcagtgcgtggattctggtgttcagaagcaagacggaggaggagaaggcggaggcggtgaagcagacgtttgcggtggtggagaaactggagggagcactgagcgagtgctccaaggggaagcccttcttcggcggcgacaccgtcggctacgtcgacgtcgtgctcggaggcttcgtcgcgtgggtgcacgcgatcgaagaggtgttcggcctgaaccgtttcgacgccgccaagacgccgctcctggcggcgtggttggagcgcttcgacgagctcgacgccgtcaaggaggtcatgccggacattggcaggctggtcgagctcgccaagatgaggcaggcacaggcagcgggggcggccgcagccgccgcgggtgaggccagttgaagtttgctgaatcctggaggggagtttgaagtttgaaacacaaccatatagattgtcgtgtgcttccacattttcgcagttcctatggctgtacctcgtcttgtttctgcaactatgttcatcagttcgtattgccgcaccgtgtatcttcgccatgtaccgtcgcagttgccaagtgggaagtggctattctaccaagatgatgtatgatgtgctacgtctatattaattcatacgttgatttgtttcaataatatttgttcaaataaacttcttcatacaaatgtattttttcctactcccattttcatttctttttcgaaaggccgtcacccaagacattatcattcaagaggtttgctctggtctaacattgacacccctaggtactggtattggcaggtaaaaaacaaatccaaccgtttaatcacgaggggtacaatcgagaacgaa

SEQ ID NO: 40065 - DNA, 36906 bp, Oryza sativa
ctcagcaatggaacagttgttctaacacaaataaaataattgcaagatgcagtccacatttgggatcaagtggattggaggtcaactgtggtgaaccttgctatatctccaagcaagtaaaactttctgaggatggtcataaccatactgcagaagggacttatgctattttgcggagataacttcattgttggagttgttcgggaattacatggtatgtgcatttttgtgatacttatattggtttagcttgccttgatatttcttttcaaattatcaaaatatgttagccatattgatcagcaggcataatttgatgtacacaagacattttcagggtttatatttacagttattaagcccttagttttaacttttaacagatttgaaatgttggaatagaaagttagcataattcttgcctctgttctattgtcaatccagaatcagaaaagaacttaatattgttccttctggccatgaaattttcttatttgacattacttacctaaaatgtagtcatgttattaacattgtctgctattcccattcaagaatttattgttcaattttaagcatgctctattccagtgttggctgattctgttgtgttcattttcagagctgcgaatggacatacaataatgttgttgtccgcctcctgaagattttggagtcatgcacatgtgaggagtattcagctgctctcttaatacttctcagccaacttggaaggtttgcccgacttgtcactcatttcttcaatatactttcaaggaacaattattaatgtattacatttttatattgaagcatttcttcctttctcttttttcattgttcttctgctatggtttaccgcacaattcttcattctagaattctccaggtgcatatgttataccctgtttgggttgttgtgtgcacaaggatttttaatagaaaaacatattctgagaactcacaagagctaagctggtaatttggtagttagcattaccagtattattcctgtctattgcgtctcttctacccgctctgttctcaataatctcttttactagcacaggagcgtgcggttctaatgtgatgttctaatttgatatatgtatcctgtcccctagtataactattatactttctattggtcaatttgctcctaatacacatgatctaaactttgttgacaactcatttgtcttttataggttctttgttgacgatgttggttatgagcaaagagcagttagtgacctgaggaatcacttatcagtgctaatgagaacaaaagtttcaaactcaaggaacatgcctgttcagctttctgctattggggcattgcttagcctcctcccattggcattcgataaaatagttgcacattctgggcaattaccagatctatatgttttgcaaggaagacagatctctgaatggttttgtcagttaagcaaggagcatcaatctatagcttgttcgttctttagttgacttcatatatattggtgaattcaggcagtcagttttaaccactgtgttggagttacctcttgatttggccttttatggactggcgaagaaattcctagtggttttctgggtgttccttgctggtatgatcttgatataacaagacacacttaagataacccatatagaggagaatgctcattcgctttgaatgctcacctgctttgaagactggattgttctgcagactagatgtcctgttgctggaatgtttctgcagaagaggccaatgttcttgatttgatgtgtgaagattcaaatgcagaaccgtgaaatgctggaaagaattgtgttccttgcacaaccatttcagctgatatacaagcagaactgggcagctggaaagatcatgtttacacagctggatttcaaattgctgagtaacatcagagtgtgtcgaagcaaggagttcaagtattgtcagtcattcagttaaccggacttatttggtcttcacgtgaactaacattgccatgagtgtctgatatgccctggtattatagtcgagtattcttatttggtcttcacgtgaactaagattgccacgagtgtctgatatgccctggtattataggtgagtattctttcaagtagccccaatcaagtgaaacttggttgtaccaagatcaatgtgcttggtgaaccaagagcatgcatgcatggcgtactgttttttgagaagtgtacactgactcgggggtttacttcacacctgtggacctgtggtcgctgggttgggcgaggttttctgtgcaaatgatttttgcaggaaggtggttcaaatttttgtgacatcaccttcgtacgttctcattttgtttccgactgtagaggtagatttaccaaagaatcaagagaagtgtttgcccagtgcgctgggcgtgtaacttgtcatgtaactcacaatttataggctaaaaaaactcccaagttatgaaggcaagtgattttaacggcaacatctttacaaatttgagtctcaacagcccatattactataacaacaatccgttgctttgtattgtgttcggatctcgatcaatgattcataaaacaatatatttgcatcgatttctttaggataagacaatttgaaggtgctcccatcatttctcgaactgtgtgatactttgatcggttcacctacactcctacagccaaatgagcgtcttactttcctttttcctttggcgaggagatttacaaagtagtagtataaaatactctatcgatgtaacgttttatagtacacatgtttagatttattgtaatagaaaacgttacattctgttctgagttgttttttaaggacggagtaagtataagccatccttttgtagacaatacacaaaggaacttgtcaagttgagtaacgagcttgtttttttttaactaaaccggcaggagaactgccaattatatttcaattaagtagaatggttgtttttttctttttctgtaacgagcttgtttcagtagtgtcctgcgagagacctcgatcgccgacggcggcgtcactccttggaaggctgtataattgcgtggttcggggcgaaccgcgacattcaagagatcgacagactagcctaatgggttacatgacgcgaggttactactgctaccaatatcaccggtcatccacgcatcctacgacgactcgtccatgccggcccaccctgaaccgaacatacgcgcagaccagggtggcccatgtcgtcgtgccgctctcaccaccaacctacctacccaccgaatcactcaccgttgttgccgattgaaaaaccgcccagaggccgagccaggagtagagaaacaccggtcagcgaccgtcccacccccgcccacgtgctcgcgcccgaacggtgtggcggccgcgtactacccgtggtgggcacggtgcgcgagttccgtttcggccagtgcccacgcgtgcagcctactacgtgcccacgcccccggcgcctcgcctccgcgcgcgggcggggccagcgcgcacgcgtccccccctgtgagatcgtcttgccgtccgtctcccccgcgccgagctcgcacgcctcacgtgcgctggccaggggacgcgccgccccgcgcgcttcgccgacggcacgtcccgctcgatccgatccagcacctggctggctggacgtcaaacaccagcacgtcccgcggagcagcgcatggcatgggggggccgcacgccgtgccgtgcgtgacgcgacgagcgctactgctactactacgcggagtacgttaattaggccgccgctagcctaaccgaagagggccggtctccttttccgccgcgtttgcttatgtgtcaagcgacacctggtgggacggtggattagtataataggccgcgtgtgccgtgcaccgcgggagatccaactaaccccaacgattataccgactataatgagcagttagcaccggtctttggccggctttagccgcccaatcacacatgtcctactctgctccagttaattcgcgtgtgatcacagccacttcgcacgtaaccgtcaggttagctggccatctaagtagccctggtacaggcggtactcctgtggagtactatcttctcgtcatagagaattttctcggttgtgtcacccgtgcgttgactcaggtaatttttactctgagttcaattcgaccgtctttttcgtgcttactttcaccgttgatccaccggcttcgtccagttattcctaatcacagctggaccatgaaactgacatatagacaccgaaaacgcgatggcctgaccgccggatcatcgtcggtggctcggtgctacagagcagagccaccggcgagagagagacggggtatcgtctactaactgcctgcctggctgcctgccatcgagctcgtgcggcaccgtgttgtccaaaatgagaaggaaacgcaaccatgagagccgagccttgtcgaaaacgacacggctgaaccgccggatatcgtactactctcgccgccgagacagcggagagacaggaccgacgagacgggggggatggagttttgatccaaaacgagaaggaaccgcaaccaccacccgcgcgtgcgctcgtcagccgcgttcgtctcggcgttttttttgccggccacgcccgcggataagcacgcggggagatcagatcaccctgcagcagaagcagatcgtcctgcactgcacgcggacgcgggaaggagctagcggcgtcgctagcgcagcgctacgtgtccaccggcttttgactgtacgtggagcggtgtcgtcgttggtgcgtgagtagtgacccgtccaaaagcgaaagcggcgattaaaaaaaaatctttggagagtcgcacacaaaaatggtgtcctgcttgtgtgtttctacgttgacgtatccgggtttagaattgatcttccgatccggtcggtgtcaagcccgataagaatatggttacatccgctgatattttgtctgaagctggcactgaataattggttggtgtatgtatcgggtagcaaaagatttacagaattctgcgtaaatcgttgcgatacttgtagaaaaggtatcgcgccattattattctgggggagatttttcgggggtttaactaaacttttttttctcttgaagtcaaatattaattaaatttatgaagaagggatttcagattagcacttcaaagggaattgtcacgtgtagcacgatccttactagctagcttctaatagtacattacatgttgctataaatcttaagacaaactagcgaaagtagtaatcctcttggcgtattaaatgtaaggccgagtttagttccaaactgttttttcaaactttcaacttttccatcacatccaaacttttctacacacataaatttttaacttttccatcatactgttccaatttcaattaaattttcaattttaacgtaaactaaacacactctaagcatcatcttctctgatgattgatgtaacttcgagatacagtaacagtaccatgcacttttaccatcactttgtaatcctacttgtgtagctagagaaaggcaacattaatagtgtactgctagaaggcaactgttgactcgttagtagctcaagctcacatcacactcgcttattgatcccacagattcctggccagcccgaggtttcatgtaggagtattctactaaaatccagagcctctgatgattaaccaagctccttggaacatattcctcccaaccatctcaatgaaaaagaatattccgctcaccaataactctatcatctcccatggaagctgaaaaagaaacgtaacaaaaaacaaaagtgctcttgcaaagtgccgtccaaaacgaaagcaccaggatcgaatacttctatccgcacatcttagctttgatcctttattaaaaaaagaaaatgcgtgctccttttgaaggatcatgtttggtaccggctcttcacttggcgacagcttcttctagttgtcgttttagctggaagcttttgaggttaacaaaaagaagacgaagaagagaaggctaaacaattggaaggccagtggcatgtttattttaagtggaaacgaaaaggggggaaaaaagcagtgaacaagtgaaatggtcactgtgcttggctgcttgctcgactggtttgctggtagcgtatgatgtttggtgcgagatgctcacgactacacaacgtcaaacccacacgggaccgtggagcccagatcggttgcaagttgcgaaagtgtaccgatgaaacagtgaacgaagcgcgccaattgcgtcctctgtggaaaacgatgttctgctcagttgttgtagctgcattttgacactatatacgcggacgaatacattgcatgaaatcatgcatttgctacaattttaactacacattttataaatctgcaaaaatatcctttgggcttggccaattttttttaagtatacggacgtacatttgaagtattaaacatagactaataacaaaacaaattatagatttcgtatgtaaactacgagacgaaattattaagtttaattaatctatcattagcaaatatttattgtagcatcacattgtcaaatcatggcgcaatttaggctcaacagattcgtctcgcaatttacatgcaaactgtgcagttggtatcaaactgatattgtatcttcacctcttttatttataaaattcaggtgagaaagctctccacccccgtgactagtcaaaaaaaatctgcaacaatattagacaattttattaatatacatataattttaactgatctctcagttttaaaataaattaatttctagggaagcatatatccaaattcatctctgaaagttaattttgccaggaacggagcatgtattgttcttctccgacacataatcctaaacttatgcaagtgatgtatgctacctgacaggccagcctagacctgtcacataaatatttttttagtttttaataaaatgatatgctaaaattttagcagacatatagctttaacaatagctatagtttcctaagatttattaattctattgaaacgatacgatacattatttctaaaacagactatactaaagatcgttgaattttacacatgctatctacatgtattaaaatttaaatgtattagaggtttatatgcttgatgcttcatgttttatctatgtaaatatttgaaacttagttacaacagattacatacatatggtcctcctctcaaatttcctagagtacctgaaacctaccaccactggcagttaataattcccctattgatcacaaccaattgctaactgagtgccaaatccaccctaaaccatcatcattgtgacagataatcatagaagagagagaaacaaggtaaggattaattgtaacaccagaacaaattttaaatcatcaggcctaaaaaagcaacatagaaagagagaaaggagataaaaaggcaaacacaaaggaaataaatattggtagagtaacaaacaaaccaagctaaagtcttctcctctcgtccttaagaccctgtttagatgagactaaaacttttaagtcactatcacatcggatgtttagacattaattataaatattaaacataaactattaataaaacccattcataatcttggactaattcgtgagacgaatctattgaacctaattaatccataattagcatatgtgatgctacagtaaacattctctaattgtggattaattagacttaaaaaatttgtctcgcgaattagcttttatttacgtaattagttttataagtagtctatatttaatactctaaattagtgtctaaataaagggacaattaagtcactagattcaaacaccacctaactctttagcatctctcatctaccacttctaatcccctctatttcctctcatcttcctcctcttaccttgcccttgctggattaatatttgtgtgccttccaagggaaaccctagtattttctactgcaagtcttctgcttaaagaaagagaaaaaaaagaccagtgttttttctttaatcttattcttattttttgggattcataaattctcctctggttgcatatcccaaatcatttttatttaaggcaggagagagaaaagagggaagaagtagtaagccgcagtgaggccgagctatccttcctctccttttcctcctcgcacacagctctctcagatccaaagccgtggagaaatcgcgcgaatccctcgcctagatgcgcgacgccgcttgctgctacagctgccgccgccgccgctgctgctagggttcttgcggagatgcggggtgtcgagtcgggtggcggaggcggcggcgcgtcttcttcctcccccgccgccgcaggtgaggcttctcgcggctgaatttggcaattcggtaacccaccttccggtgggtttcacgcgctgtttgatctggtctccgctccggcttttgccgctgagctggttgtttccagtagttgctgttgttttggtctgatttggtgcagaagtcggcgccttactgttaatctgttgcgtctctgatgcgaatctttgggagtatcgatggagaattgttcgaattcgggctctttgagttctcaactagaaaaaaaaatgatgttcttttgttggcctgattggcgtttcgtgtggttcttgccgttgttgtcggttctcgcttgtaatttggttagaagttatggtttttttacgccgattaatattaatccgtgccatctgacgcttctcgatgcaggtaattttgatgctgggcagtacgccttcttcgggaaggagccactggagggactcgagctcagttgcttggaggatggcggcggtgatggcaatggcggtggattcagcgggccagaagatgggctgtaccggctctcttctgttggagaagaggtgcggatcccggaaccttcatttgatcatgtccacagctgccatgcttcttgtgaactatcgtcctcttgatattgatttgtgttcttggttcggatgccgtccttttatctccttttccgatagcacgtttagttctaggaggaattaagaataaatccttgtgggcctatatggtcttatcagtggagttgaggttcacatcattagcgttggagggcgggaagttttatgctcaaacataggcagatcctttaccttgatgcatgttgaatggtcattgtttttatcagttgtttgatagctaaaaggttccattgcaagggtggaattccatgagacggggatagaagacgaatcttgctgctaaatgtattaagttgagaattactagaacaaatgatgttttgtttcggataaatgttcaaggtagcctttttggctgttttgtcacaaccctattattggcttgtttcagtccagtcatagttctttttggtagcctttcaggctatagctgtatagcttgtggccacggtatgattttttgatttggttagttttctggcacacttttcctagtgttacttggcccaacgctcacttgctctggagccagaagagaactatctctgcattttgagatcaatagcagaatgggacaaaaaacatataacctattttgatacagaatgctagagttcactgtttctactgttggctgtatgccatttcttgaatgttcaagttgcttttgcattctccaatcttcactgcattattgatagatcgtattgacagggcttactattgagcatgcttgaaatgttatgaggtaatttggatcttctatggatcaaatggtggtttttattatcaatatcatgtaatcctaagcttgtgctggttaacacaactagttttcagcaattgtaatgtataacaactttatacttatgctggttggatgaaacaactttaggggggttgaatttaattagttaatgtgcatttctaaatagccacttggagtttattgtgatgggcaaaaaatcgtctaatatttcattacaattggccaatattacattacaattgccatcaatatttggaactgtatcatgtggaaggtaagactctacaaggagttagggatgtctgcatgtttgaacagccttgcaccccatacatgaattttacttttgtagcgctttccctttcttcttctcatcataaattatggatttactatcgtctttagtgttgtggagttattctgattcaatttactatgttctgcagattgataatctgagtaacttgtcagaaattgatgatcttgcgagcacttttgcaaaggtttgtttcacaaactccagtgttataaattgatgtttcattatttaaaaaaaaagtgacttcgcttggatggattcactttgcagtagccgtttaagtattagatatgttaaggccctgttatgccttaccagtgtggccaagtggttactctgactcttccatacttcattcttgtattgataaataattatatttctccagaaaattgcacccccaggccacatgtcaacgatacatgcaggtgcaaatcctaaaggtgcaatctttgtggggcatataacttatacccctccccccaaaagctgaaataatctaaacattaagtgcccattttattcatttgtagttctggctatctgattatttccactacaattgggctgcctgctaccccaagcatgtactggataaatgatacatattagtggtctttaggctgaatgtagcttcttcttgcgttagcctgttttgcatctgtaagtattttgccccatctaaggcccatttgcacatagaagatctaggagtaggtaccaactaccaagtctgtaatgtctgaaattgtttcggagtgatcaactaggctgctgctctttttctaaggatacgttatatatcccatcccttagtcccaagaggattgggataatcactaatgagtaatgaggcctcaacttttatctacacctgacatattgcttgcatatggatccgtaattgcatgatattttgttttaaccttggcttctgttcttgtttcttttatgcgcttgttctgctgttgcacattgatttatttacattttttttatcatcagttgaaccgaagcattagtggaacacggaatcctggtgttattggtgacagaagatccatctcaagaggaagtaagtcagcattatgttctgatggaaaatgactaatgatgttttgtttttaaagatgttgactacaatattgacaatatgcatgtcttttgtgcatgattgttcatttttaaaatatgttgaagtcaaccattttgcatttcatttctaactcattcttggtataattttgacttgctgtacacagttgtggatttgtttatcatgtcaacagtctgttgtagaaaagaaaagaaaacattatgaattataattgttttcattaagagtgttctatagtgtagcttttgtatgcaacattgttgaaagctctatgtaatctcatttatgaaatgcttccattctgcattactacacatgttttcaaaattttaatgccgtcaatgtcggctggaagaaaggttatcttgtgtctattacacctttatttgttgaaaagcaaccatgctattgaaactctatggtgtagtcaaagtcaaatgaacactggaaggctgaacttgttactgaactatgcaaatgaccttttcaggttctctaactgttgattgggctgaagatgctgagtttcccaactgggtagatcaagacatattagagggtgaggaacttcaggaaagtaaaagatggtggtcacagtcacgttctctggggcagcaaggggatgccaaaccattgagccgaacatcttatatcctcaacaaccattgcagcaccgcgcaagtgaacctatcattgcaccacaatctcctccatttacatcctttccacctccaggtgctagatcaccttatactgctcaaggccttacacgtcatgggagcattccatcagttggtgctggtctacaaatgggttctccaagcatgtcacttccaagttcttcatatcatatggctggactatctcatggactaccatatggagggagcgtgtcctttggttctccaaatcttcctggaagcaatccaatacaaaatgattggccaaaccaagccaacccgtatgctgtggatcaatttaatctacttccgaacatgttacagaaacaaatatcacttccaaatagcccaatgtcatcactgctattttctcaacagcagcagagattggcacaagttcaagtccagccatcccatcagaattacctaaatttaccacctcacctattttaccaacatcactccccagagttaacaggaaggtttgattctatcagcaatgttccttcattgagagacaagaggtcaaggtcaggaaggggaaaacacagcacacgtttttctcaaccattgactgatactggtagtcaaaatggtgatagtggtggactaaaattcaggtctaagtacatgtcatctgaagagatcgaatctatcttaagaatgcagcattcagcaagtcacagcagtgatccttatgtagttgattattaccatcaagcttgcatagcaaaaaagggtgccagttccaggcaaaaggccaattttgccccaacatcaatgaaagacttaccttccaagtccagatctagcagtgaccatcatgcatatcttcaggttgatgctctagggagggtttctttctcttccatacgtaggcctcggtctcttcttgaagttgaccttccttcatctggtgatggttctcatgatcagaagtcttctctgaggcccctggagaaagaaccaatgctggcagctagagtcactgttgaagatgccatctgcctacttcttgaggtggatgatattgaccgtctattgcagtctagccaggcacaagataacagtttccaactgaggcgaagacggcaggtcctccttgaaggtctagctacatcacttcagcttgttgaccctcttggtccgagcaaatcaagccattcatctggattggcccctaaggatgatcttgtttttcttcggattgtttctcttcctaaaggacgcaaacttttgtcacggtaccttcgacttcttacccctggaagcgagttgacccgtataatatgcatggctatttttcgacatctgaggtacttgtttgggggtttaccatcagattctagtgcagcagaaacaacagttgctcttgcaaagactgtttcatcttgtgtgctccatatggaactaggtgctcttagtgcttgccttgctgctgtcgtatgttcatctgagcagccacctctgcgtcctcttgctagctctgctggtgatggggcttctcttattattaaatcagtactggaccgagcaaccgagttgctgactgaccaccatgctgcagccagctatacagtgtcaaaccgaactctctggcaggcatcatttgatgctttctttggactcctgacaaaatactgcctcagtaagtatgaaagtattaagcagatgtttgtcatgcagtcaccatgctctgtaactggatctgaagtctcgaaagcaaccagcagggagatgccagttgagttgctacgtgcaagccttcctcatacaaacgatcagcaacgccagctgctgcttgattttgctcagcgaacaatgccagtgaccggtattaatcccactggggcaaatggtgggtacatcacctctgagtctgttcctggttgatatagctgaagatgccaaagggtcgatcgcaaatgcttaaaaggactcgatgcacttgtcttgcagatggcaattcatatatatctggagacatgcatgcccttcataagatgtgagcttggaagaaagttccatttgctcagggaaaaactagccttcttcagattgtgactttaggtttcagattaatctcgtagaccaacgatctcccctttctgtgggtcatttatatagcacccacctgatatgcatatgtacgtacactgttgtaacactatgctgtgatgaactagccaactcgttgggggcaaaatttagtttttaacattcatattccccagcgaagaagacgtccaagattagtgggcttagcagcagtggttgtacaggtactagggccttcctgtctgtcgttttactggtgtggaaggtgcctagcgtcaagtaaacactagtctggtcttaatctattttagtcaggaccaaagtgtgttggaataatgaagttctgtttattaggtttcttggaaggatacttaaaatgtcatggagatgcctgtatttccaggtgcctactgacactatatggtggggtactggaaactgggggtatatctcttaattgtaaatcgttacagtttgttgtcatttcatttcttcacttgttcagattggcacaagatttcggcttttagccttgtgcgaacataaatgtttggtttgttcattactctgcctacattttgtttaaagggaactccggttgcactatatacttcctgccaggattgaggctgcatgcctttatttgtaaatttgtgtagtagttattacagccatataaactggagcatttgaatgcttttgtctttttgatggtgtcaatatgctggtcttgtgcttgctgctattggttacagctagcctcaagtaacggtttgatgtacactatctcagtatgaaattccaacatctgtgagggcctcttttggaaaggaggaattttcagtatgaaatcttcagcaattgttaggccttgaaatggaggaattttacaagaactaaactaatttatgtgaaattcctgcctattttgacgtttcaatatcaatatgacaacaaatcaaaactctggtagcaaacaactggcagcgggtgtcaaactggttgagcagcaaccttggtatcatcgccggctaattctataattcctattttacccctaacccatccaaccatccagtggatttgcggccagagcagaggggtaaaatcggcagaagcaaaatctttaagtctcgcttcgaacccatcgccccgcacgacgacggcggcgggcgccacggctacacgactccgcgcgggtgcgagcggcggcgccgaattcgtcggccatgatgcagagctcgctcgcgcggccgttgccgcggcccccgatccggccggcctgcgggaaccctgtctgccggagccggcccggctcggtctccgtggcccggtgccgcgcggaggctgcgccgccggctccggcgccggcggcgcgtagggcggcggggccgtacaccgggagggacccggaggtgaagaagccggcgtggctgcggcagcgtgcggcgcagggggagaagtacgcgcggctgcgggagtcgatcggcgagctcaagctcaacaccgtctgcgtcgaggcccagtgccccaacatcggcgaggtacgcgattcagtcgtatcgtatgggactagagcaaggtgatcctcgcgagcaatttctgcgagaacagctaaatcctttgctcctggggcgcagtgctggaacggtgggggaggggcgggcggggaaggcgacggcatcgccacggcgaccatcatggtgctcggtgatacctgtacgcgcggctgccgtttctgtgccgtgaagactagcaacaagcctccaccaccggatcccctggagcctctgaacacggccttggcagttgcaagctgggggtatggtaactttgcctgttcgctccatctccagattagccatttatgccttccgaattgtctgagttactgatcgatggaatgatagttgtaggaaggaacagagataacagtgcattttgttaagtctggaagtaaagaaaatcaatgcacatgcacttgtttgtgtggcaaaattagtacagattgtctgacaaatgttgctcttttcagagtggactatgttgtactgaccagtgttgacagagatgacttgcctgatggtggtagcagccattttgcgcagacagtgagagctttaaaggtttactaccttatgccttgtgttgacagaagttgggcatttatttgtagaagtttcatgctgaagttttctgaatttcctattcaggagctcaaacctgggatactggtggagtgcttgacctcagattttcgaggtgacctggaggctgtttcagctttggccaactctggtctggatgtatttgcgcacaacatcgagactgtgaggagcctgcaaagaattgttagggatcctcgagcagggtaatgtgattcactgattttactggcacactattatatcctgcttaggactatttgtacatttataatttagagaatcaataaccaattcacccaaggcatcaccctaatgaaattacttcctactggaaaggaacatctaaactgtacctagttccagattttcatttacactacaggtacatgaaatctacataatccaaactttgaataatatccacatgcacatgttgcatgcgcttttctgttaaaagttaaaactaattccatgtggtttactctattcaatggagtaccattctattcaggttattgttttttacaagactgatgtgcccagtcatgtcttaaactgacctaaaaagacaaattaacactgcgttcgagtattctgtccctggcatcaattttacagcttgactatatgatcattctcaggctattggtgtgtcttagtttaagtgattaatcttaaattcgccccgagtaaaaatgaatctaattattattgagctatgcatactttacagtgtaatagtgcttatatataggttgcaaattgttgtctctgaagtgtaaactatattgtagactgtaacattgcaaaataaaaacagccatagatattttctatctgatgacctgcatattccttgctgtatttattgtatgagacataacaatagttttgcaaatatcaaagctttgcaatctgtttgattggtgagttgtggtactcttatttatttctgaacgtttctcgcatcataatcttgggagatgatttattttgcctgatcaactacctttcccttagaatctgttcgaaggaagtatagtggtaggatatagtttatccagtttatcctcgattttgcgcatacactatatttctagtatctcgtggcaatgtgcagttaataacttgtactatgcacagttcttttcctcatatcctctggcattgtaagaatttttcttacctcattcttacagatatgatcagagcttagctgttctgaagcatgcaaaaagttgcaaagagggtatgataactaagtcctctatcatgcttggtcttggagagactgacgaggaggtgaaacaagccatgattgacttaagggccattggtgttgatatcttgacactgggccagtatttgcaggttagcccagtaccactttatcattagtcaagaataactggtcagtctttgatgcaaaccatctgcttgatcttacagcccactgaaagacatttgacagtaagggagtatgtaactcctgagaagttccaattttggaaggagtatggagaatcggtgggtttccgctatgttgctagtggacccctggtaagtgctacatctaattagtgggactcttcagttgtcacccttaaaattgtaaatacaaataggaaattgtagtactgtataatttgctctgacaaatatcagtatgatgcatgagtaaagttctggaaatttagtgaagaacacagctaccagtgctattattatttgttgtacgattctgtaatcgactaatatgtaggaatgttggataaccaagtcagtgtcttacatgagcttattctctattttgtgattttttttttcaggttcggtcttcatatcgtgcaggagagctctttgtccaaaatttggtcaggaataacaaacctaagctacctgcttcatcttaggcaagtaaccttcgtacaaagaccatcggattctttctgtgcctatatttgtagcagcagaacaaaaaggagggcaacataatcattctattcttcagaaagtcgatccctgcctttttctttttggatatgcatacactgatatacactttcgatttttgctgtagttaccctcttgaatagagaacttgagagggcaattttcattgttgtatcatttcttttgatgccatacacggaagcaattgtaagaataggtgtcagaatgaagctatatatccccttatcgttgattacgcgatgctttattcatcatttggcaaaagtaaaagagagcagaaaaacaaaggaaaaaggctggaggaaacaaaagatgcaagtactttattcccatatccatagctaggatgattttgattcatgacaagcagacagtacgcatctcatgataagctcgccaagaagtaagaacccaaggtggtagagaacatgaaatcatctttgcatttcgcattgccggctataggctacaaagcacctgggttctgaagcatgcgagcacaggaaccgtgatagtcactactcactgcacggcatgcgacaagcgtgcgaataagaagaaaaatatattcttccgttgaggggtgggattgagattgtgaaatgaatgaatggttaggattaaatggaagggggagaatgaatggttaggatttaaagatgtcttatggtgggtgggaaatcatttccctatcccatttgccaaatatgaccctacatttttttaaacgacttataccattgagaagtttcatattaatatagctgtggaaaaaaaacaagattacaatcctgaaatattataaccgggaaaatcctgttcttggtaagttggtatatgtattatccattcatcccacatttccacatagtgcaattactggcttactgcagtaacggcactacacttcattccagcaaacagctacataaggggaaactattttaacagctcgagtggatgtccacctgtttattatatgtcatctaaatggttatgaaaaaaattgaaaaaatatgaataagatagatcaatatgtaatgtatcaatctacaaacatgtaagttaaaattcaacttctacagattgtaacaaaaataacaaacaaaacttaaattactatatgtatatttacagttaaatttgttatttttgttgtaacttgtagaagttgaattttaacttgcatgtttgtgaagtgatatattacatattgatctatcttgccaatttttttgaaaatttttcatagccatttagttgacatgaaataaacgggtggacgtccactcgagctattagaatccatccccgctacagaagtggggaataaaagtgtaacactgtaattgttggttagcaatgtgcggactgccagggtcatgcgtttgtgggtagcccactactagctccaattcatttatagccaatataatagctaatttatacaatagttgcttactatactattaatatatggtctcatctgttatacacacactgtgacttgtagtccgtgctgtagctagctataaatttatagcccgctactcctttctctcatctcttatcttattaaaatatgtttatatagctggctaatagtatgctattgtaccctatagctggaccagtcaccagtgtgcataaaaggctaaaactcgagtagtacaaagtggttaatgaaatgacctgtgcaggacatgaagttctcatgaacgatgaatcccatcttgccatcttgccaatgaatgcattgacattgcaagtgtgtgtgagagagagagagagagagattgtgtatctcaactgggctaaataaagtcacagctgacaagaggcggctagttagtcaatcgtacgagagtgcgatttacaacgtggccggccactacacgaccgtacggtgaacgacgccaaaagttgttgctgcttcctttcctttcatatcccctcatatatatacagtgttactagtaaaaatcttcacactgcttcagcatcttcgtgtacaggttccctatgatccacgcttgaagccgtgaacgattcacatcttgtcgtcttcgtttcactcctgcctggtatggccgtatggtacgccagcccacccaaccggtccaatgacagcgaggatctccatctaaaaccgatatatcacatcagtaaaaagctcgtgacattggcattaaaacgttgctcttttccagccagaggtgagaggcccagagaacatctgaagccaccacctactattgacctactttcccttctcacttgcgacttcactgacttgccacttcgccagcgcagcaaagaggacggacggacggaccactgcgctgcagggtgcgagatccatttgtccaccgtccacggataattcagccaaaccggcccgtgataatcgagtgacaggcgagtccgcgagcgtgtaccgcatacctaacccccatagccggcggaaaccccgccggccgcgtctcctggaaagctgcagcccggcgtcgcgtggggatgcgcgtgagccgaggacgtaaaaaaaggccaagatttgccagcgtgcgtgcgcgcgcgcgcccacccacttcccgctcccgtcggctgcccgcgcagcacagccgagcggcgcggcggcgcaacgaggattttggctcacgcacgcacgaataccgtgtcacgtcacgtacaggcacgcagactggtacgtactctcgccgatggccaaccggttgtaccgctgtagtactgcgacggagacatgccgttggtggtgtcctagggtttgtttggttgttgcctaatattgccataacttaatttgtcatagatgtagcatggcaaataaagtgtggccaataatttgttggccacaagtgtggcaatgtttagctagaaaataagtataagacatgtaggcccatgaaacaagaaagtgtggcttgccacaactgaaacaagcaactaaacgctaagctaacaatctgtggcatgtctaacatgtggtgtggcaatgtgtggcaccaaaccaatcagcccctaatccggaccgttttggtgggtatagactagtactgtactgtgtattagctgctttttaagccttttagccggtccgtgtcagtgttatccaacggttacctctcgcaacgtctcccacgcgggcacgcacacctgtcgccacacatgcccgcactgttcgacggccgctacattacagccgacgcagattaggcgtttggtttggtttgaggcctgtattggacttatcaatatttgataattttaataatgtttattatctatttggtttagagccaaattttagcatgactaagaaaataggtcatttcaacagttaatttaggctattttggcttcaatccaaacacaattttacctttgccaaaattagtcatgtcaaaagttatcaaaatttgacattgataaaaattgataaggccaatttagaacacaaaccaaaccagccctagattagcagcagataccaccactaaagtggaattgagagacattctcccccgtgatcgaatcaccagcagcaccccctaattccgaatctttagccgcgccgaggccccaccgcaccgcccggaaccgaggagaaaacaaggcggcgaacctgcaaattataagcggttggatgcatgcggccgcggcgtgaaccggactgaccggataatgctcgccctgcagcgaagtgcagcttcggcttagaaaaatcgtactgctagtacgcatgcagtagtgtataatctacatccgagtgagtgcgtgctatgatgaagtaggaacagattatactacatactacctcctttcctaaatgttgacgctgttgacttttttaaacatgtttgaccgttcgttttatttaaaaacttttgtgaaatatataaaactatatgtatatataaaagtatatttaacaatgaatcaaatggtaggaaaagaattaataattgcttaaattttttgaataagatgaacggtcaaacatattttaaaaagtcaacggtgtcaaacatttaggatggagggagtagtacagaaatttgcaaagtcggtagcccgcggatatgaaggaatcttggccgatggggcgatcatgtcgagcgtgcaagccagctttattatgtttacatgctcgtgttggtgcagctacgatggtctttccattttgtatgataaactttggcttgaaaactaccaagtatataattaactaattaaagtggtgtttatgatctgtaaacattgtttctccgccggtgtacgtgctctcgaataattcatgccatgaacaattgccggacatgcttggccaagctttagcccgccgactcactatgcgcaataattccagcccctttaacccttttccatcccttttctcctcgtctgcttctgcacacagcttagctagtagctagctgccctcttcgtcagaaacacctcacatttcgatcgatcgatcgatcgagccggtcaggatacgagaatggaccagctcgtagcgctgcactacgcttctctgcagccgagtggtggtggccggccgggcaagcagaaagcagaggagacagcagtaaaaaaaaaaaaaaaaggtgaccttggcgcctaccggctaccatagttcagtgctaccatcatctacctcccaatggaggccatgaaatgaagtgtttgcacttttcaagttgttaattaggaccacagtaaagatgcagcaagctagctagcagctgctgcaatgccattgtcacctactctaacagtgttggtgagtcgcttttcccagttttttttttttaaaaaaaaatctggttgactggttgcagggagccgagagcaatgctggccccaggtgaccaggagtgcatgcgtagtttgctcattgatctactactactcatcacgtgatcacgtactccaatttcttgtggcctgtgttctgtcgccatcggttagtatctttggttgcatgttaacatgcctcacactctccctcagatctctttctttaggacaaaaagagagagagagagagagatggacaaaggttcttggattgtctcgtggtagtacatgatcaaagtcattttggtttggggaggctcaaacttcgttttttttttctgcaaatgcctttgctatgtcttatccccattttcagaggtggattagcaacaggggtgggacggccttgaatttagggtctctcggttttgtgctttggatccatgaaacttttggtgatgattattggagatgtgcacctttggaatagatgatcaacgaaatcatgagctgccggcgactactgaagcacaccacggtttttataatcggtcatcgacaaagtgcagtcaaagtgcacaccgagcagcattatcaattggacatgcctggtattgtgcttcaaagctcaaagtgctgggttataaaagataaactgggaccggcgctgaacgtggccaagatcctttgcggttggagaattccaactggaaattcaggctttgcatgtttcagttgaaactcttaagagttttgtgttaaacatgtatataaaaacgattacagtttaaaatttaaagttatattagatgttcaaatagaattagagtcgccaatatggtcaatcaagggtcatgatatctaaatacattgtaatatgttaaatcaagaagtggtgttcgtaataagttttccagtaattcagttttcagcttaaaccttattagtaacaaatattgtgtcttgagatcgtcatcagtttggacttttctatgatattttttctattcagcttattaaggtctgtgccagtttttataacagagacaatattagattagtaggtaggagtacatgttaataagagcatattaaggtcagttagctttccacctcagctgctgataattgagtagcactagactaatagaacatgttaataagagcttgaatggtaagaacagtgtttcatatagtggaaagacaagattctgaaaaacctgcagttagaatctggaaaacagttttttcgggtagacaatgcagcatcacgttaagatcagtactccagagcgattaaaaaactgttagaaaattctaatgagcccagagaattgaccgttggatgacgtgcacggatgatgcgtcgctctgggccaacccatttaataatccattgaaatcatggggtatggattttttttccttttgtgacatagcagtacagcagtacagatcaataaaaacggaagagaaaaatccatagcgctagcactgttctacagcctgttcactctagctgcaacagtgcaaatgcaacgcttgcacatacaattccgttacagcacgcccgttctgaccaggtgcatgagtaaaacaatggtcacggacttcatgatcatatactgaattagtactactccctccaacctgataatattacttaacattttggatagaaacatgatcttcaaagccaattttgatcactattttttattacaatacatacagaaatatcaataagtatatgattttatcaagcactttttaaaatcttatatggtcaccatatttataagacatattttaaaagttatttatatagtaagacatttagagtttgataataaccttgttcaaaatgatacgagtaaatattattaggccgtgttttgttttaaagtttttcttcgaactttcaattttttcatcacatcgaaacttttctacacacaaactttcaattttttcatcacatccttccaatttcaaccaaatttttaattttagcgtgcactaaacacagcccttagtcaaaaaggagcagtagcagcagttgttgttgacagtagtactccactactgatcttgcaacgcgaggtacacagaagcagaacaccggcaatttctgttgtctgaaacatcgggatattagcatagcactgcactgtgaactctggtgtcatgtgccgcaagcagcgattcgatcaatctccgttcgatcaatcttttccaccacctttcttcatcgtactctggcagtaaaaatggactgtaaaatggcttcttccaagagaaggccggagtaccacacagttcacgaggtaatggaaaaccgaggcctcgcctcgtctgcctcactctctctgcaacgctgagctgtgtgttttgctctttcgctgagaggagagacgcagcagctgtgtcaattcatgtttggactccataagtttcacttaaagtttttagcattttcaaacagtatagattattatttagacttttagaataactaataattattacttccttcatttatattataagttgttctttttctaaaacaaacctctttagcagtttgattttatgaaaaaaatataacaacatttataacattaaattaattctattacatctaacattacatatactttaatagtttctttgttttgtgttaaaatattactataattttttataaacttgatcaaacttaaaaaattaattttaaaaaatcaaaacgacttataatacaaaacataagtagtactacatgataaaaaaacaaattagaatttagcagttgcttacatctctgctaataaacaaatataatataagatactatgacgatggatcgtaatttcgtattacatgtttatttttgacacgaaccgaagttttaaaatcaaatcaaagtaggcataaaaggggaggaccggaggagtgcgcttttctggctttctgcctcgctctttattgggtgtgctcgctgctcgtctttgtgccgcagctcagcctcagtgcaacccactcgctctctctcactctcgccgcggcttaaagcgcacacggcacggcgggggcggcggccacttccacatcgccattaatgagcctggagcaagccccataggccgtagtagtagtgctactagcttcatcagctccacctcgctcggaagagatcgtctcgtcgagcgaggccctttttgctcccccaatggattcttgccgcagctagtgtttcttggcgattcttgcggcgctttgggagctgaccggtgaagagctctctttgaggcgatgggttgggcgtggcggagggagcagtgggcggttgcatggctgtccgtggcggttcttggggcggcgctggtgggcgccgctggcgcgttcgaggagggcacggcggtgtacattgtgaccatgaagcaggcgccggtgttccacaagcgcctcgacctggagaggtttgggagcagcagagtcgccggcggcggcggcggcggcgggggggacaccccgtccactagcatcctcatgaagccaaggtttttgatggtttattactcctctatgatttggttttgctctatctttacagtttatgcgaaatatgtatgtacgattcagtttgggtgagaatctctccttttggggaggagtttttgggtgattttgattggtctatagtgaaatgttagagatgctacgtcattatctgccgacagctcggttcattggtgtagttgctgctaatattgggaaggctaacccactattgcagtagaaatgtttggtttttttaacacacaaaagatatggaatttaataccaacatgaacaatgtgtgtgcggctgtgctgctagcgtgctattgatgattctgtactttactgtttatctgacaagtttttagcaagtattttcccttgcttgtcacaaattaagttttcgtttttttgctcaccagtgttgtaatgcaggcatggtccagcccaacctatgaattatggctcgtacttagttcgtcttcaaaattcactcttgaagagaacactgagaggagagcgctatataaagctctacagctaccgctatctgattaatggttttgctgttgtcatcactcctcagcaggtatcatttttttctttgattccaccacttttgcacctttgttctgtaacgtcacattacaagtttttttaagttgcatttcaaaaagaagttctgaaatcttcagactattagatgctgcatcaatgttctcgaaagaaaagtccatggcaatatgaattatggcgtgttgatatctgctaggttacatacactgaacacttatgattttgcttctactgctatctctctctaaaatttgctatgttttagcatgttaaaatgttgtaccttgtatacccttggttgttttatcatcgttctcaagaacctgtcaggtttattgcatgattgtttagatttggtcacttctctaaatctcaactgatttttatagcactaaaaaatatcgaagctatttggattgacaataaggttttaactggttttccttgcattaaaatttaaaaggcagagaggctatctatgacgaaagaagtggcaaatgtaatgttggacttctcagttaggacggcaacaactcatacccctgaattccttggtttgccacaaggagcatgggttcaagagggtggcccacaatgtgctggtcagggtgttgttgttggcctcatcgacacaggaatcgatccaactcatcccagcttgcagacgacttgataactgacagttatcctgttcctgctcattactctggcatttgcgaggttacaaatgattttccatctggatcctgcaacagaaaacttgtgggagctaggcattttgcagcctctgcaataaccaggggagtgttcaatgcctctcaagatcatgcttcaccttctgatagtgatggtcatgggacgtaagtactatctgctgattcaccctttaaaattatttgaaggagcaagaatacgaagccattaccaatctactactggttttgttacattgtccaatcacgcttgcaaattttaagtaaaatagtagcattcttgagaattcatagtgctacagtagagttttcttatttttcttgtttgactatccagttctgcagcttctgcctaaattattcatagatatttcatttacatttttcactccatatgtcattgtggctctttttttgtcagcatatctgttttctgatatatattttttgtacatcgtacagccatacagcatccatagcagctggtaatcatggaattcctgttgttgtggctgggcatcattttgggaatgcaagtggaatggctcctcgtgcacagtaagtccattacctttttctgcggagacatataagatccactttattcccaaatgttaatgacaaattaatttccagcattgctgtctataaagctctgtacaaaagctttggagggtttgctgctgatgtagtagctgcaatagatcaggtaatggtttacctgcaagctaactatcttcttttgatttagcacaaattaataccacattttagaatgctacaatgcatatgggcacattgtgacattttattgatgacaagtcattcatcatattgcaggcagctgaagataatgttgatataatcagcttatccattaccccaaatagaaggcctcctggactagccaccttctttaatccaattgacatggctcttctttcagctgtaaaagctggcatatttgtcgtgcaagctgcaggaaatacaggtccttcccccaagagcatgtcatcatacagtccatggatttttactgtaggagcatctgcccatgacagggaatacaacaactatgttgtacttggcaacaatctgaccattacaggagttggccttgctcgtaagttcctagtagtattttccattgtgcgcaactgcacatggctggtgttgtttgattctaactttgtgttactccacaaatacagctggaacagatggtgattccatgttcactctagttgctgcacctcatgcactgaaaaacaatgtagccagtcctactgaaatgtccctaggggagtgccaagattcaagccaccttgatgaagatctgataaggggaaagatactggtctgcagctattccatacgatttgtacttggcctgtcgtctgtgaagcaagctttagatactgcaaagaatgtcagtgctgcaggagttatattctatctggatccatttgtcattggattccagctgaatccaactccaatggatatgcctggacttataataccatcatctgatgactctaaggtatgacagccaaagcaagagtcttgttattactcatcccttgctgatatgaagaaaattaacaaatgtgatgcaacattctcaggtatttctaaattattacaatgagtcccttgtgagagatgagacctcaaacaaaatcgtcagctttggtgcaattgcaaaaatactaggaggccaaaatccaaattatggtatttctgccccaaaagtaatgttttattctgccaggggtcctgatcctgaggacaactcactggccaatgctgatatcctgaagccaaatctgatagcacctggcagttccatttggggtgcttggagttctcttggattggactctgctgaatttgctggtaacttgacaatttacctactttctaatcttgtttagaacataagttttattctttgaatcatcaggcatataaaatagcaataaaacaaaacagtggcatgcattttctgtttttttaacagttctattaggtgctaaaatacctgttaatgagagagcttatgtctgaattgaagattcagcctaattttttccccttcaatagtaccatgaatcatttgtagattacggttggcattgatttgtgccaacagttgttctgcatttttgttagtccattccctttacctcgctgatagagtgatagagcaaaattttatgtagaagtaatcacagaaagcgctacatgatttcactctttaattgtgcattttaacacctaagtttaggtcatgctctagacataatgctttacagaaaaggttgtataaaaactgttctagttattgtggaagcccttaataagatgttcgtttagcattagaatccaacctataacatcttctattaataaatttgcttatataataatttttttcttacatagattaattgaataattatgttgtttttgacttactgtctaggtgaaagttttgcaataatttccggtacaagtatggctgcaccacacgttgctgggcttgctgctctagtcaagcagaagttcccttattttagccctgcagctataggttctgcattatcgactactacaagtctcagtgacagggaggggaatccaatcatggcacagagaacatacggcaatccaaattcaactcaatctccagctacaccttttgacatgggaaatggatttgtcaatgctactgctgctttggatcctgggctcatatttgattccagtaagttcaactgccatttcttctgtttattttactattatcagtacctctacctttggtagagttcactggggcctatgttatacaaactccgttccaaaatataagcattttttctatgcatttttcaaaatgtatctgatgcttctatctggaacggatggagtacctgatagtatgaatacaaactagcaagtagcaacagcaatatagcttgaatgtcatacatgcaatgcaacattttttctcactataaagtcagactgaaattctcagtgtagtttagtaattattcaatcctgacagcggcatgactttacaggttacgacgacttcttctcctttctatgtggcataaacggctctgctccagtagtgatgaattacaccggcaacagctgcagctcctccgccatgacaggggctgatctgaacctcccctccatcaccattgcagtgctcaaccagtcaagaacgataacaagaactgtaaccaacgtggcgagcgacgagcgctacacggtcagttacagcgccccttacggggtcgccgtctccgcgtcgccggcccagttcttcatccccagcgggcagaggcagcaggtgaccttcgtcgtcaacgccaccatgaacggcacctccgcgagcttcggcagcgtcggcttctacggcgacaagggccaccgggtgatgatcccgttctcagttatctccaaggttgtgcaccgttcatgatttgactgatggaagaacgctgtaatatggcaaaggatctgcctgatccggcgtatgcagcgggggtaactttgactgcctggggcttaacctgaccggagattttttgttgatcttgatgtacattttgatgcatgtcggtgtaagtaagatcaagatgagtgagtggctaatatctgtaactgtaaagagaatggtgtaccggactccgtcctttcacgaatgagaaatcatgctttttctcaattttcttgtcaccatgttaagtagaagaatgcactttgcatataggaataattaacttctttttgccactcataccactggtgataaatgatttacccatagactcgcatattataggtatatgagagcccacgtatcatagacacaaatccttaattattaaaaaaaagttaaatgtcacatactccccccagtcccataatataagggattttgagtttttgcttgcactgtttgaccactcgtcttattcaaaaaatttgtgcaaatataaaaaacgaaaagttgtgcttaaagtattttggataacaaagtaagtcaaaaaaaataaaaaataaatccaaaattttttgaataagacgagtggtcaaacagtgtaaataaaaactcaaaatcttttatattatgggtggaggtagtatgatatatggcgcctgctagctcgcaaactagaacaggaggaatatattatgttaatggattattgtactctctccgtcccataatattgcaatctagaatgagattagactcatcctatctcattataggactacgaatcttaggttgaaacattatgggatggagggagtaattggtttcaacaacggggtggtggcgcagttggctagcgcgtaggtctcatagctattgagtgatcctgaggtcgagagttcgagcctctctcaccccataaatccgagcgatgatgaaaaagctctcgtgactactttgggtcgtcacacgtctgccgatatcagatgatagagcaaaactgagcttggtttttcctttttacaatattattttaacaatgtattttgccatgccatgcatttaggattctcaaaacgtactaggagtagaaaaggaaacatgattagttctttttcacaattttattttaacaatgtattttggccatgccatgcatttaggattctcaaaacgtacgtacgagtagaaaaggaaacatgattagaaagtcctaggtcctaaaacacgaccgttcccgacacgcagcatgtattactatctccccatggtgcggagaggtctttttgtcttttttgcaaattgcaaacgcctggcgctggccacgcaagaactcatttacgccctccggtgcgtgctctcttcggccttcactaccaccaggaacatcctgttgagctcgtcggccgccctgtcgccgccggcgagtacccgcgcgcaacggccggtgctcgcgttgcattgggagattcgagaaacgattgccccaacgtttcgcccgtgcagatgcagtgcaggccctcgctcgcgtggcagcggagcacgaaccaaaccagcgatgcagcgagtggagcacacgttcgtattagcgcgctgttggcctaccatgctaatatgattttaccgtgctggccgccacctcgaacacaagggggtggtggcgcagttggctagcgcgtaggtctcatagctattgagttatcctgaggtcgagagttcgagcctctctcaccccatatgaaactcaagtgatgatgaaaagctctcgtggctactttgggtcgtcacacatcttgcccatttcagatgatagagcaaaactgagcttggtttcccttttttttccacaaactatgcaacaatgattttttgttaccccgattgtagtgcagttatttgcacgtatttttttttttaaaaagtggcaggtgagctccagggtaacaaaaaaacatcgagacggcacttcatcgtcgtcctcatgagcgttttcctcctgctctttgttgcaggcgctgacgatgctcgggggcacatccgcacatgcgcacagccatcgccagttcgccacctacccgtgtgcacaccaccaccatcgtcgtcgttgaagacttgaagaagtcgatgtgtaagcaattgcacgcgttatcagtccaagccgccgacgaagctcgatggcctgccagcatggctgtgatccatgtgaagttcgggcgccagcagcggaccggcggacccccgccatggcccatggggagctccatcactcggtaacagtacgagatccaactcgagaaaggtacagacagtaaactgtgttaatgccgtgtgttccgttgagaaagagcctcagtcctcaggtacggcagagtcttgatcggacggtgtatcccgcgtacttcctccgttcagacaacgaatcgagtcttgatcggacggtgtatcccgcgtactccctccgttcagacaacgaatctaaacagctctctatccagatttgttgcactagaatctcctcttaagttgtttttttagtaaatttcatcttgaaccacctatattaaccaatgtggcataatgggctagggctaagtttctcttttcacttaacagttagcaccacctaattttaccacctttttcaggttggaccaggtttacggcatgggagggatgcgtttcggcctaatccacgcgagcagctggtgtttgctcatggtggcagtggtgcgcgataccagtagcgtgcgcgacgcgtcggggtggtcatcggcgagggcgagcatgtcgtcgtccagtggacgcggactctagggtgatcacgctcggccctgtcacgctcaaaacaatactacggcacatctgattacgttgacaggatctgagaccacaccagaactatcccattccgatcatgcatgtgaaaaaaaaaacaaaggccaactattccatttagcagtaatcaagatccgatcttctcttttcttgtgaaaattcgacatgtttccggttaccaaccgaggaacacagattaattactctagttttttcgaagagcagaagaggaatattgattacccccacaaaacccaaatctcataggaattactgaatacattgctttgtttcactctcccaagtccaagggtcaaaactttcctccatagattgatccatgatcgaatagcagatgcatatacctgtctacctcgtaaacccaacaagcatcctatcaatgaggcagccaacgaccccagtgattccatcctcgggaagccatcgatcgaggtggcatgggcgtccaccaggtagaggcccttcgccccggccggatgacgagacttgctccaccttggcgccggtggtcggtggacctagacggtggcgtttgtgtgtcgattgttgagttcacgccgctgcacaataaccgcgtgtgaacagagacttttttgggttgggagggaagtactcgtaccagagaagggaggcggaattgttgtcgagggagccctcgccggagcccgtagacggggattgccggctgctagtaaacgcacctacttgcgtggccgaagcccagcctagtggcccaatcaataaacctggtccaacttgcaaaggatggtaaaaataagtggtataaagtgaaaaaagtgacccacccctagcccaatgtgcaactgaggtcaatataagtgacccaaagtgaaatttactcttttttttggatggaggagtatggccgtatgcaaattagacagtaacagtaaatgctgtatgggacttatcgcggggtctatagtgagaaaaggccctgcgtcactagcttctggccttctacttgtctacttgatgtggtcggcaaaattccgatcaaacgacccatagatgtccaattcgatccaaataaggaggcccaagtaagatagtgctgctgcagcaactacaacgtctagtactcgctagcaacggttgagatgcataaccgatagccgaacaactatgttgttcagtgcaatcctaatagctgtaaaacagactaccgaatagtctcatcgcgccgccactcatggtaacggagaatttagctctttaccacttttaggttcgtcacttatctaaatgcccctcttagatttgcgcttagtaatttaccactagagagaagtgattccttaactatttcctacttttgcctacgtggaaagcgacgtggtccccacccgtgaacccctcccttctccttcttctccaccttcagccttcgcacccccttcatcttcgccctgagctggcccagctcaactgcgagtgccgccaccaccgtggtctcctctggcgccacgtccccgagcctcacgtcctgtgccaccgctgtcctggtgatgagcgtcagcagcagcagcagcgccgtcagtgcgcgtgcgcctctcggcctgaggaagcagcggtggccccatcggcgtcatggtcgtcgtcctcctcctcgacggcgtcctctgcctccttctcaggaagcttgcgcaagtgaagcagctttgacggcggcaagaacccacggccgcctccgcccaccccgccgcggtggtcgccggttgctgccgcaagaggaggtcggcgtacaagcagctatatgcggcaaggcgagccgaggtggaggagatatggcggccagaggtagagaagaaggagaggggaggggttgacgggtggggaccacgtcgctttccacgtgggcacgccacgatggctcgttacgtagacaaaagtggcaaattgttaagaaatcacctatctccagtggtaaattactaaatacaaatcaaataggggcatttagataagtaacaaatagttaaatagcccgtggtaacgggctaatcgccgccgaatctctcttcttctcctccttcccttttttttctttagttattttccttcttctccattcccggccatgttcttcaattcctgtccggctcagtactttgtgacacggaaatctgctcttgtaaaagtttaggactgtttatcagaatctggagttttggacacaaggggtggtggtgcagttggctagcgcgtaggtctcatagctattgagtgatcctgaggtctaagttcgatcccctctcaccccacaaaccttgcccttgcgatgacgaaaagctcttcggtggcaacttgggtcgccaccttcgtctgaactcagatgatccgagcacaatccgagcttcgtttttttttctttattttttttgagtttttctttccaggtttctcgatctaacaaccatctgccacctggccatgatcagtcgcgtccgcgtccgcgtccgccgctcgccggtgggcccgtctcccgcacatgggcacgattcccttcccctcccaaccgcgtcgccgaaggaaagcaacagaaaaatcccgcgcaacccgaccccgaacaggctgccacgacggtgcgagctgtcctccataactccagccatctccccgctgtgcgctcccgtcctcccgcccccgtccccacccgtcagccaaacccatcccaccacgaggagtgaaccaaaaacgcgagcaaccg

SEQ ID NO: 40066 - DNA, 4041 bp, Oryza sativa
acccctcggtgccgcaggtgccctacctcacggcgagggtctccgcggcgcccttcacatactccttcccgctcggcgccggccgcaagttcctcaggctccacttctacccggccaactactccagccgcgacgccgccgacgcgcgcttctccgtctccgtccccgccgccaacgtcacgctcctctccaacttcagcgcctaccagaccgccaccgccctcaacttcgcctacatcgtccgcgagttctccgtcaacgtcacgaccccgacgatggagctcaccttcacgccggagaagggccaccccaacgcctacgcgttcgtcaacggcatcgaggttgtctcctcccccgatctcttcgacatctccaccccgaatctggtcaccggggatggcaacaatcagccattcccgatcgacgctggcactgctctgcagacaatgtaccgacttaatgtcggcggccaggcgatctccccctccaaggacacgggcggttaccgttcgtgggacgatgactcgccatacgtttttggtgcggcgttcggggtgtcctacccaaaagatgacaatgtcaccattgcctaccctagcaatgtgccggagtatgtggcgccggtggatgtctatgctacggcaaggtcgatggggccggacaagaacgtgaacttggcatacaacctcacttggataatgcaggtggatgctgggttcacataccttgtgaggcttcatttctgtgagatacaatatccaatcactatgatcaatcagcgggtgttcaacatttacatcaacaaccagactgcttttcagggcgccgatgtgattgcatggactaataacaatgggatcggcagtccagtgtatcaagactttgtagtgacaacagttggttcaggggctatggatttgtgggtagctctctatccagatgtccaggctaaaccacagtactatgatgctatcctcaatggactggaggtgttcaagttgccgcttagtaatgggagccttgctgggctcaaccctgttccaactgttgagccatcgttggatggtggagcagtgaagaagtcaagtgttgggcctattgttggtggagtgattggaggtctggtggttcttgcacttggatattgctgctttatgatctgcaagcgtcggagcagagtggggaaggacacaggcatgagtgatgggcattctggatggttgccactttcactctatggcaactcacactcatctggctcagccaaatcacatactactgggagctacgcttcatcgctgccatccaacctgtgccgccatttctcatttgcggagatcaaggctgcaacaaacaacttcgatgaatccctcctccttggtgtgggtggtttcggtaaagtgtatcgtggggagattgatggtggagtgaccaaggtggctatcaagcgtgggaatccactgtctgagcagggtgtgcatgagttccaaaccgagattgagatgctgtcgaagctccgccaccgtcatcttgtgtcactgattggttactgtgaggagaagaatgagatgatcctggtctatgactacatggctcatggaactcttcgtgagcacctgtacaagaccaagaatgcaccacttacatggaggcagcgcttggagatctgcattggtgctgcccgtgggcttcactaccttcacactggtgcgaagcacacaatcatccaccgtgatgtgaagacaacaaatatcctcctggatgagaagtgggtcgcgaaggtttcagattttggtctgtcaaagactgggccatcgatggatcacacacatgtgagcacagttgtcaagggaagttttggctaccttgaccctgaatacttccgcaggcagcagctcactgagaaatctgatgtctactcctttggtgttgtgctatttgaggtcctctgtgctcgccctgccttgaaccccactcttgctaaggaagaagttagcttggcagagtgggccctgcactgccagaagaagggtattcttgatcaattgttgatccccacctgaagggaaagatcgctccacagtgcttcaagaagtttgccgagactgctgagaaatgtgtttcagatgaaggcatcgatcgtccttcaatgggagatgtgctgtggaacttggaatttgcccttcaaatgcaggaaagtgcagaggatagtggaagcattggttgtgggatgtcagatgagggcactccccttgtgatgcctggaaagaaggatcccaatgatccatcgatcgagtcaagcaccactacaaccacaaccacgtccataagcatgggcgaccaaagtgttgctagcatagactccgacgggcttactcctagcgctgtcttctcacagatcatgaaccccaagggacggtgagctaacagtctttgcttgtcacctgcaggcattatttattctttaaacgtattctcatgagtttgtgatgttgattttctgtcaatttatggacctggaagtcagagagttgttccatattagatatttttgttttgtgctgtatattgtccatgctgtggtgacttggatacttattggctttgtattgtactctaccgctggtattaaccaccagttgatctctattactgtatacgaaagctatgcgcaagaccatcttcattttcattgcctttctgatgtgtttggtcagagcccagcgttagttagcagagagcctggtagtatcacttttttccgaaaaaaattctcgtgtacaggtatcattgatttggtgtgctatgtagatggtgtttgttgcataagccattttcatgcatatactgaaatactggactatgatgtttttctgatgtcatgttgttttacaagtataaatctagtataacaccaatcttgaacttttattctatgtagtaccctttttttttatgctggtttacttcaagctgtatagacgttcagggttatggattgttgtccactccgtgttatcttgatctggcgaacaattttttcttactgatgcttctcttccgtttggtagttgattaattttctttgcaactgtgttaatgagaattgagaggaacagagaatcaaacaattattctcagcatccacctacttttgagcaaaaggttgagcaaaaggacttcggctaaatgttcacatctgtcggaaaagagaaaaactctggtgtgatctgtttggctgtggtgacagccatatccagctaaatatcatcacaattcgcaaccgctaagctttgacactttgtaccagtttttctttttgtgtgggaatgggacgtcctgaaaattcatcgccaacctgtcgtaccatacgtgctctccatgcatccagctatatctcatcctgcaggaaattgtgcttagaaaaagaattgggcgatgtcagaaaaataaatacaccgaataccttttggtcgtttcttcatcattcgattgtttgccaaccgccagagcttagagattgcactggaaacacaagggaatatatcacggtttcttgacaaacgaatatcacggagagggtttaccttttcgttttaaaagtaagaaccgtatttcatcagtttatgaaaaaccgactgaaaatcaataaaaaatgaaaatcaataaaaccgatgacttttagtaaacgtcgtacataaaccgagtaatacaggtcggcttccacaaacggaatatcattggttttcatgcaaaccgatcggtttagtgaacctgatcacggttaggacttgagaattactagtgtatccctatcctagactccatttcgtctgttccactttcgtccagaacgagccggtttaggccattcctaacccaataactaagatggtgtctataacattaaataaactgccacctagaatgaaaaatgatatggcaagtgaataaatgaggaaagagaaggaaaatgtcttgcatgcaacatggtttctacacaacattcaagacatcatgtgagataagtagcattaaatt

SEQ ID NO: 40067 - DNA, 6369 bp, Oryza sativa
aatacttgtttgaatatactagttgtaaacatttctaatagaccattttaggtgcatttatacagaaacaatgtagatatcataaaaatacaaacagtcacaacagtgccacgtgaaactggagaaaacatgtcatgttgtgttcaaacccagtgacttccgttccaggatcatgccagtctataagcaggacaggaaacaaagtttggtttgtcatatttatttcaaaaacaaaccatagaagttaacaagtagtttggatgttccaaatatattctcaggtaaatgccaacactacttctgtgctaagttaagatcataatatgtgctcaatttccaggatttatcatacaatatattttaacagaataaatacgattaaagaaagaagctattgtaggatggaccatgtataaattcagcaaaagcggcttgtagatgtcaataatataaaatgatcaggattgagaaaagaagatatactctgtttgatctggtcttcccgcatcctcattgccaaaggatctcgttgtatgcgaacatcagtgcccatcatgatacggaattccccagcagtttggtgttgaaacattgttataagttgagtattctcatcttcgccagtctcctcaaagtgtttctgtacagcttctcgtgaagtgtctttgtttttatacgcttcaacccattccgaatagtatgctattggccctatttcttctagtctcctttgttctgcttctaacctgtgttttcattgtatatccaatataagaatggacggaaggcaagatagaactatataccttaagaatactgtgaaaatatcatgttgaaaggacgttgtgtcaatatttttttctgctgtcataacaagtaacattgaagtacaaaccagcaggtaggcaactagacataataacatccatcaaatatttgttataaatcaacgaggggataccaaaggtcagttaaagagtctacataagcttaaagagtatcattgcacatatggtgaagatattaaaattaaaagcacggttttcacatatggtgaagacccacgaaaagcaaaatcactaaattttgagaaaataatttctagtattcagccaacctttcctctttgaataaatgtcttcttgccttggcaagagcagcttctgttctggtagggtggtccccaaatattttgatctgcccagtttctgccattgcttttgcaaagacctacaataatgaaatgagtgttacaatttaaattataactgacaagacacagagctgtaagttagaagaaacactaatctgaataatgaaaaaggttaaaaacatcaaccaacaatatagattaaattgataagccatgtataggaaatgccacatctgcaagctgtgcacgtgtatctaccaggtggtggatttagtatgggggaataggcgttcaactgagccacacagcttttaggattcgtggaatagagatgaccccagaagatccttataaatgttaccagtctaggctaatgaagaacctaattctgtctgaacccaagatatatggttaagtatttcatctcattttgaactcccagaataaaaataccagctcatcactgtgtacactactctgcttgcatcttttatacactagaagatgcatacgatgatcatgacgacattgtgtggcttctggaaatattagcactacaaacactatactttggttggatattttggcacacacaaaactacatgtactccctccgtcccaaaaatataagaacctagtaccgaatgggatgtgtccaaccaaagtatatagtatcctgcgtcccatccaatactaggttcttatattttgggacagagggagtactaccttagtgtttgtgccttgtgctatcaaaatagggtatacgaagactagcatacaaacaattgaaaccctcaaaattgtggtgtggacatgcagcaggaggagtggagaataagaaccatactgtgtacatcatattcgctactaggttatgttaacaagtgacaataggcagaaaaacttaagtaaaaaagacttataagtcatttattaagttcaaaccaatcaagaactaaccgtgtcaacatctggacgcctcctctgccatcttgaccacatttcattttcctcagacttcctcctccagttccaccacagctcttcactagattttggttcccctacagacattgccttctgcgggtcaacgaacgggtgtggccgtcccatcatcttgtccatctcatattcactcaaattttcttccttgggcatctcataaacgacgtactcatccaatgaatcctttgtctcctccagtgtctcatctgatgaggcctcaatggccacaaccgactctccctcatctccactggtctccgtgcctctccctgccgtcgctgatgctacctgctccttgtaccctttccttctactcccgggcttcttaccaaacgacggtgtcccagctgattccccgaccggtgcaggtgcacgggcagcgcgtacgcgggatgcagtgccctccggccagtactcctgcccaggtatgcttgcccgagcacccgacgccggctcgagctggcccgacgtggagtcgaagtaactggagtacggtggcgcctcgatcttagatggatcaaaatggagcgagtcgtccttgacgctcctgatcctgcctcttcgcgttctgctcgacacaccagaaaacagcacccttctccggtgaggcaatccagcaaacaccttctgcgcacgcaccaaacacaaatcaaaataaaaaaatactcagcacccatgacaactgggagcacgggaacgcggtaaaatttcagcaattttctcgggcattccgatgggggaggagttaccaaggactggagggggcgaggaacagtctgggcggtggcctgcggcgccatgcctgcggagtattggagggaggtgagttcgcttgagccgtgcgaattggcggttggaaatgagggggagaggtcactgggaggagccaagtgcgggagcacgacgccatggctccgcctccgatgctgcggttggaacccgaggtggacgagagagagctaggggagggaagcggatgggttgagctccatggacgcgcaccgaagttcaggtagccggtttggtcttcggaaggggacaggataacaaggagaggttttcgaagaggaacacggggtttatccggtggacttcaaattcgaattttttttatttataattttttttattaaaagttttacaaaaataattttccattttgaaaattgacggaaatagtcgcctacagccctctgggagggcgatttttaaaaatcgccctcccacagggcggcgaaaatgacgtggcaaacggccgttctctctctggcgacagccgtcaacgaaatttgcaggcggcccccttgccgccctccgctagggcgattttgcactgtgcggggggccgcctgcaaataggcggcgagggggcatggaattttgcaggcggcccccttgccgccctgggggagggcgattttgtactgtgctctatattttttttatataaatatcaatagttatcaaatctttttatattgaaaactatacaagattaaaatatccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaataatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgtcacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgcttcccttctgctgccctcccctctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggcccccccgcacagcggagagtggccctatcggagggcggcaagggggc

SEQ ID NO: 40068 - DNA, 1355 bp, Oryza sativa
tgatccaagagggtggttgaacactattacatcgattggttggcgcgcaaaagggcggctacgtattcatagggattattgtctaataataatataatataaataacaaattagtgtaaactctatctaatgcatccattattcacattcacatttgttattttttaggccgggcccgcttacatctgatagcttataggtcatagactgccctcacagaccaacacatgcagccgggaagaatttcccggtcggtcacccatcccaaattgctcgggaagaatttcccggtcgatcacccatcccaaattgctctaggccaagcacgcttaaccctccaggccaagcacgcttaaccctggagtttttttggagatcggcttccggaaaagaagcttaaccctccaggccaagcacgcttaaccctggagtttttttggagatcggcttccggaaaagaagcttaaccctccaggccaagcacgcttaaccctagagtttttttggagatcggcttccggaaaagaagttgtaacttgttaatatgagtattctattaatcctattaagccctaggccgggatgttacaccctcacccccttaagagagatcgacgcccccgtcgatcaaccccgccctggagttctttggagatcggcttccggaaaagaagttgtaacttgttaatatgagtagaaaagaagttgtaacttgttaatatgagtattctgttaatcctattaagccctaggccgggatgttacaccctcaccccctgattcccggtcggtcacccatcccaaattgctctaggccaagcacgcttaaccctggagttctttggagatcggcttccggacaccctcaccctattaagccctaggccgagatgttacaccctcaccccctgattcccggtcggtcacccatcccaaattgctctaggccaagcacgcttaaccctgctctaggccaagcacgcttaaccctggagttctttggagatcggcttccggaaaagaagttgcaacctgttgatatgagtattctattaattctattaagccctaggccgggatgttataattttaaatgtattaatattgcatatttccaaagtgacgcagacccacctagtttgtaaagtaatattactaatttgaattgtattcttgctaatattgtagttatagaaatttgactatgggggtgttaagatccggggtgtaaagttttggcgtgtcacatcgggtattatatagggtgtcgcatatggtgtttgagcattaataaaaaactaattacagaatacgtcaataaaccgcgagacaaatttattaagtctaattaatcc

SEQ ID NO: 40069 - DNA, 921 bp, Oryza sativa
ctttttttctcagctccaaacttcaacttcctcacttttcgttcgtacgtttttcaaaccgttaaacggtacttacgtttttacgtttttagtaaaaagtttttatgtagaagtacttataaaaattaaataattttttttaattttataatagttaatatttaattaattatgtagtaatgagttttctcattttacgtgtgttaaaattattcctcgaactcccaaaaatgaaaaaagaaaatattcctccaactggtgccaccgaatggagacttagtgttctggaaccagtcaaccagattggtgataacaagagctgacttctttgatttttactgatcatcgtttgagcgtcacagcatacgcacacatggcaatcagaattcagagaggaagcagtcagtctaatctccctaataatgtatatgcacaagaaaacaggtacaagtgcagattgaaacaggtacaagttcagattgacgtttttttttaaggggaaggacggcaggacatctgccggaatttaacaatagagaaggtatgtcctgtttgataaagtaagctacttcggtttctgaacaagaagagtttgggaagattcttctatttctttctaaccaaatattcaaccaggtagttaacaacgagcctctaatcgcatgcgcttgctctttggaacctgcaggggtcagattttggaattggcaaactaggctccaaacttgtctgacaaagacacattcactgaacagatgatgtatcttcaaaagcggtacagagacaacatatccaattgcatgattagtgtctccggagcaaattctgggcaataagggtttttttttataaagaattaacaatccaaagaatttcatttttggttcaaccagggccctccatagagatacaaaatcattc

SEQ ID NO: 40070 - DNA, 2097 bp, Oryza sativa
caaactttcaatttttttcatgacatcaaaactttcctacacacaaactttcaactttttcatcacatcgttctaatttcaatcaaactttcaattttgacgtgaactaaacacaccctaagacatgtgtcatcgactactaaatttatatggttgtttgagttagcaacttagcatacgggcaatatactaatacctcagacccacaaatacttgtactggtagaaatgaagttttttgaatggagggtaattaattaccgacggagaaaaaaagagaatggcttggctcgactatgatcacacttttcaaaccagaaaagtatatgaattcccgcaaaaaaaagaaaagtatatgaattcttgtccaagtatatgaatttgactatccaaaccagaaatttcatccaaatatagcttgccaatcaagtcaaacaaagaaaaatcgccctcttcaggcaaactgctgagttcaagtgcagactaatctcatacgatttgggggggccttagctccataaatacacttcgtctccttcggtccttcctcctcaacaccaaccagacagaacagaggacaccgctcacaagcaaatacagagtcgagagtgagacttgaggcagaggccatggccggaggaggagacgagctgaagctgctgggcatgtgggcgagcccgtacgttctgcgagtgaagttcgcgctcagtctcaagggcctcagctacgagtacgtcgaggaggatctcatgaacaagagcgacctcctcctcagctccaacccggtgaacaagaaggtgcccgtgctcatccacaacggcaagcccgtctgcgagtcgcagatcatcctccagtacctcgacgaggcgttccccgacgccggcgccaccctgctccccgccgacccccacgaacgcgccgtcgctcgcttctgggccgccttcaacgacgacacggtacgttggtaccatgtcacctcacatcgcgatcatccgcatcgtctccgactcttccgtttttgattcaatttgatttgttcgcagctggtggaggcgtcgccgcggcgtcgtgggggaagacggaggaggagagggcggagggggagaagaaggtggtggaggcgctggagaagatggaggtcgggctgagggagtgctccaaggggaagcccttcttcggcggcgacaccgtcgggtacctcgacgtcacgctcggcgccctggtcagctgggtgcacgccggcgaggccctgtacgggatgaggctcttcgatgccaccaggagcccgctccggacgcgtgggtggaccgcttcgccgcactggatgcggccatggcggtcttgccggacgccggcacattagccgagtacgccaagaagaggcaggcggagcgggcagccgccgcggctgcgaacaactgaactggcatgcaggggccgtggttcgcgacgtggttgggcctcgacgatgaatttggtgtcatggtgtgccacttgtagtcccgtcacatgtggcgatgtgggctttgtttgccacgtgaatttgttgtctgtctgcgttcttacggttggatattgttcgtgtggttttggttagcccgtttcttccaataaatggaattattaatttttagaggaacaagagtgaacattttttttttcaaagatgacgaaaattattacatcctgggcttttacataaggaaaagtgtagttggactaaatcctagttacccttaagtaataaaaacaactgaaagccaaaaaaatcacacaaattttaaggatttagcaaatatatgttagctacctgagccaattattaaacattttggtttattattaaaattggtagtgaatatgtctcttgcatattgcgaaacccatatttctctcgctaaaatttattgaaatggctagaaatcaagtaattttaaagtggccagacgagacagtcgtgcccgctacaggacatgggtgcctctgtgatggcacgacagagcctgagctggagccacggatatgatgtggcgagctaatgggcactcgccatgtgcccccactgtaaatggccttattgcaccatttcttatgtttc

SEQ ID NO: 40071 - DNA, 1295 bp, Oryza sativa
aatagtgttaattagagaaaagaaactagtacaagtggcgtctgggtgagaaaggtctttacaacttaataacatggcccaatgaaaataattacagatttggctgtgaaaaaaaaagagagaagactatactgtgcgggacaatgaaaaggtacaccaataatatattagcggtcataatctaataacaatgcctattcgtaaataaattttaccggcattaaaaagaaggtaccgagagataataaatttgatacgtgggatactgagaggcatcaaattttaccagaaaggctatttctctttggtacctttttaagagagtatcgaacattttaagataagtttatgcatatgtatgcatttaaaataaaattgtaacaattattggggaatgctatacagcacgagattgtgctatttcactagatataggcgtaaaaaaaatacatcccctagaggcaaaaaagagctgtacaaaattacataagcgttgtggttaagttgggaggaattctccaagtcaccttgtgcctgccattattcaggttcttgactcttcctttatttttgccataaggttgggggctaccgtttccttgtgctcgaagatcctttagttcctttctttctagatttcttaggctatgagtaggattaaggatcgcagccctttcttgggcactttctttttgttggctagcatttcccaccattcatgtacgctttggcatggctcccaattgctcaggtccaattactgataagccacccagccgaccatcagtctccagatccttctggtgtatctaaaggaagctaataggtggcatgtcgtctcgttcgtcgtacggcatagggggcacactccgctatttggccatcctcttgtagctagtcgatcggaagtccagactctattttgaattacaagccacgcatagaatttgcattttgcaggagcccaagatttccaaattaggggattaaagtttgtgccgactattcctagacactgagccttgtatgccgaagaggccgagcattctccatgattcgagagcttccagacgatgtggtctgactcattttggtttagtatgatgtcctgggttgcgctccatagggacacaagttggctgatcaggtccactgtaaaagtagtgttcctatttagctccaggtcatcgatccaggtgtcattttcaatgccttcatgtagtgatttacttcttttcaatatgctttcgtttaattttttagaccaggttagcggatcacatgtttcaatacat

SEQ ID NO: 40072 - DNA, 1881 bp, Oryza sativa
cagcggaaccaacgggctaacacccaacaccacagacgacggctgggaaccaggacgaaaccctaatcttcacttcagttcatcttcacttcaaggcagaggaactatatactcaatttcaacaatggtgcccgggcaccatggagcaccaaacaaatgtactatatatatatatatatatatatatagagcaagggtgagtaatttcgtactcagcaagtcacgggaatttaggtgtttaatgcaagcttggaagagaggcaaggttgttttgcaaatcctttgtttgaaatcatttttgaagtcactaagtgatttatttctttttgagtttggatcgaaaagagacttacgtctcgatttgacttaagagatgcttttcaacaactcaaatggtaatgtaccgacctcccgggtcagatcattacttatcggctcccagagccatttcacttgattaatcggctcccagagcctttttcattttctcggactcccagagtccagctgcccagcagcacaacaatccgcttccactcaggaagcctagtctatgatgcccgcagacatcccgaatcacacagattcgtttccgaccactcaggtcatccatttgccacataggctgattctggtaacgattcccacaccacaacaacttttcacaaagcacaggcaataaaatctacgcaacgggaaccacctcacatctgcccatgaccgtgggcacggctgttcgaatagttagttaacctctgcagaggggtacactttacccacaagacacgaacttagtccagacactggccggtatcagaggttcgcgacaaagcctttctcaagccgacccagggttacctcatgccacatagaaggatcaaatcctcacataaatacaggccattctaggcattcacaaatcaactccaaccaccttgatcggtaagtgagcaagcttctcgtccttgccttaccaggaacccggtttgtccgaccccgccccggcgttcccaactattggcatgcgaggtttccctgaaccgactagttacttagctagggtgtcccattccaccttgtggttgcactttgatcatgttcgatgagtttcccacaggaatcggtccttatatgcgaatacgggacagtgccacataggcacaacccccgtatcgcgagttttcacaattcattttattttcaaacacatcgacaccacatgtctagttttgaagacttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgtaaacaaaataataatgacttttcaattataggggcaattgatcaaagggtaacttgccttgctcaaggtcttcacgaagcttcacgaatcttcgagaaaacccgcgatcgacgaaaatccgataaccacaactatacgcaaataatcgaaaacctaaacaaaagaccaaaagaaagatcctatttagactaattagtagtgccattaaatagatctcaatttacggaattattggaagtggaacggagtcaatcggagttgcgaattgggtgatatgaattttgaaagtttaattggagtttctggaataggagagatgatttatggaatttatagaaataatattctcaagaatattattgacagtcattgaatccaggaccaaggaaaatgattcatggaattttggaataaggaat

SEQ ID NO: 40073 - DNA, 1213 bp, Oryza sativa
ccgatgtagtagttccagccgatagtgataatagctgatgccgatgccagcagatagcgatagggtttaagcaatcggttatatgtccaatgtagataatgatataaaggcaatcggctgatgatgatgtaataaaataacaatataatccagtataaaccaatcggctagtaataatatgataaataagcatcgatccgaaggttaaagtacacatcggctggaggtctgatgtcatgaaatccacaatattagattaaacagtaaaacctttgttgcgataagctaaatccaatatgtatgcaatccttataagccgatgcaacatccagataactcatcggctgaaaccccgatgaaacccttattggcaatcaaaaagtaggctagagattatggttctaaacacgacttagtagatcaaacttaactgatgcagcactaagtatgaaaagaaacataatatctagacaatcaagccgttgactgagttttcagggtggtagatgtctaagctaatctaatctagcaacacgatttagccgataccggcagaaaccctaaagcgagaagcagccgatagaggtaaattgatatgctaagactagattaacagagacatatgataaataggtagacaaatatatcatccaaaccggaacaatccaagaggtcgaatgtattgatgcagccttgaacgacgctgatgtaaatgatacaatttcctgggccggcggaacattggacttaccccttagccggagatcgaacaccgatgcagccccgcgtcaggtgccaagtcccgccggacgataaaataaagtagaaaaggtaaaaggtggcgatgcgctgaattgtattgattgtagcgatagattacatagaccccgggtgtacatatttatacccatgggttgatacaagttcttgtcggacaaaaaagaaactttcctaaagataaaaggaaaaaataaagtccttataggacactaaacacacttttctaaagataaaaggaaactaacaaactattcctaattaatagataacttgccatgccacattctctttgaactcggtctcttctggataagcttcctttagtagatcaattttcttaaccgaatatagcaagaatccgacaactgacgacttgacaactctcatcggctaatctctggacttcgaagccaatgctgtctctaagccgatg

SEQ ID NO: 40074 - DNA, 1214 bp, Oryza sativa
tctactcatggtaccactagtatgattttaggtagatgcttcgcttgttaattaggcaacattaggtggttttacaactctagactttggaaatactcttatcacctggacactatggaatagttggattattgtggaattggattcacacctccccctctattcaaaaccctcaaaatggttttaggctgggctcggggtgcatggttttgacagtagcacctcggccatataaggaccggtcttcgggcctctgttgcaaagcactaccgtacttccacacgtctagtgggtaaggcttagtttttggctcagtcaggttataaacaaaagtacacggatggagatggacgaagtcgggagtcgatggacatctctagggcaaatgaaggctacacgagctgcggcccggtagtcgagatgtcatggcacagggccggtgtcctgctgctaggggctcagtcctgcctacctgtcccgggggttccggccataggtggggttgggtcggtactcttgtttatggctaggatgggttggaaactatgtcatgtcttccgtccgtataccgtggtggtatgtggcacgtggttacacatgaggaagatgtgtcttgtgggtaaagatgtacacctctgatcagagtataatctattcgaatagccgcgccctcggttatgggcaagtcgagcaatgtacccaagttagtgtttttaattcttaaaacctgcttaataactaaaatgtggaatggttggcctgggttggcttgggacgagttgggacccagggtctggttgccagttcggtctgaatcatcgtaggccttgggttaaggcaggttcgtgtgggttcacggccttgtttaataatattgtatagctctaggaccgtgtttacaaaatagctttgagcaactaagtgtcttttagtgctgtttactgcaaaccctaaccctttatattataacccccttgtactcccttgcatttattctgcacatatgggtgtgtcttgttgagtacggtggttgtactcagtcttgctcaatttttcccaaacccagaagaggacttcctggaagatgaaggcatctagctcgtgcctgccgtcatgcgcctgtggtcgtcgccctagtcttccgctgtttcccgtttgtctttgtgtgtgctgggccttcgccgcccatgtaataaagtaactatttacgcttc

SEQ ID NO: 40075 - DNA, 2064 bp, Oryza sativa
gctgagttctcatacaacaacagttatcaggccagcattcagatgtcgccgaatgaggcaatgttcggaagaaagtgccgcactcccttgtgctggaataaggttggcgaagcactggtgttcggtcctgacatactcaaggcagcagaagaacaagttaagctgatccgacaatgtttaaagacaactcagaaccgtcagaagaattacgctgacaatcggaggcgtgaccttgagtttgaaaaaggagatcttgtgtacttgcgggtatcacctctccgtggaatgaggaggtttgggatgtccggcaagttagcaccccgctacatcggcccctacctcataaccgccagacgtggtgtcacgccccgaactagccccgagcggaactagcccgtgatgctccaaattaacctgttaatcgatatcagtcccaggaaacagtgctggtatcacaggaagacagaatatcacagcaacagaggtctctttattatagagtaggggtacaatcatgttgggctgcggacagatcccgagctcacaactgcattacaaaagggaagcgaaagccaagacttggaccaaacatcataggcgcgacttgggaactaggccgaaaccctaaaactcatcgtagccgacttgctcctggaagaactcctcgtcagcgggatccgcttcatcttcttcagcaactgggagggggattatttatatagagcaatggtgagtacgggagtactcagcaagccatgggaaataagtgtttaatgcaggcttcaaggaaaggctgttgtttttgcaattgattttatttaaactcttttctgaaacaactaagtgagtgcttctcaaacgacacggatgagacagtgcatctcgtccggtcggagtatgtgcaaggtatcagtcttttgaattggtcaaggttggcacccggccaacggcttttaaacggccacctgggcctggctgatcccatcagccgcaggttttccaaacatcgaacccaaaccacatcaacaaatttcacaaaacagtagtcaaacaaaactacgctaggaatcacctcacatccgcccatgactgtgggcacggctgttcgaacagtttaataacctctgcagagggggtacactttacccacacgacattactaacccggatcatccagcccgtgcagaatggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttgaatccacatgtctcttggcatcatggctccccccgtttagctagttactcagccaggggtgtcccattccacccatgtggttgcacttgtcttatgttcggatgaaattccaaggaaacggtccttaagtgcaagagcgggaaaccgtacacccggtacattccccggtccgcgattttggaaattcatttagttcgtaagcaccgacccacgtgtcgggttttccatgtcttttgtaaaacccaagttttacccaaggtgtttctcagtttttaagtttgaaggcgaccgttgatactcgtgcagagtgcacgattaccgaggctcaactaggtggttacaagggaacatgatataacgattaacaaaggaaggatcagatgcaataagctaggtaggcccatcggtctgccttgcagacggggcaatcctatcaatgcataatattttgcaagcaatataattaagttcaaatataggctcaatatgttgaaaggtggcttgccttgctcgagatcttgagcttgatcctcgaaatccacgcactgcgggtcttcgggctccgaaactacacgtgaaacgggacaactcaacaaacggcgaaaataaagccctattattaacctctaagcgtaccattagatagatctcgagatttgaggaattttggaagttgaacggagtcaaacggtcatacggttgagaagatattga

SEQ ID NO: 40076 - DNA, 1856 bp, Oryza sativa
  unsure (1)..(1856): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacagagcagaacgcttcttctttgggttaaaatatttatcttttagtgcagccttgtatcgcctccaatctcttccaattgatttcagtatccattgaacgcatgatggagggtataggaactttgtctgaaatacataggaataatgagagtagaagtattttaatttgcatgattacgtcaatggttaggcaagggataacagcaagtaagaaaactcagcattgaatatctgtaaaatacatataaacattgaatcgaaaacattcagttgccatggatatgaacagatgcatcaatctgagagtaggcaaaaagtaatgactagtaatacaaacagagcattatacttatgctattttagcgtttgaggtacctggacaaattgtagtattgttaaatctccttcatctgctttgatctttctccaggtcatcttatctaatggacagtaagctccatttcttgctaatgtgcccaaaaactgtcctagcaatccaccttcatccccgataggttgccctaatctgttgcattttacaactatacgtttcccaggtggaagatcccaaacatatcgcaaggttgtccccttgcgcttcttcacctcttcatcttgtactacaaaattaattgacataaggctcactaactttaggttaaccatatatatgcaatcacaaactatttgggattcaggtagttaaagttttaccaggcatgttgaggggctcatcatcttgctgctcaacatgaatcacctcgtcttcatatggtagaggaggctcgacttgtggcaatgattgtccgctgctacttccctctccatttccatggtgacagctgctatgtactatgttcaaccttttctttctagccattttgcctgcaaaattggcttactgtatttcaagagcacgaattaatctatgtgtaagtatgcttgactatacgggaatattgtaccaactacaactatctctgcacaaggagtaaaagattagaagactatacaattataagtgtagtatatgcatgacaaaaatataatggatgtagcactttcagctagagaagaatccagaaaagaaccaaacaaataaatattcctttttctcagcaccttccattcccacagtactggaaagcaaataaatcatcaattgctcttaaatgttaaagctaaagcagagtgtaatatggcagctacaagagaaaagctataggttgaccgcctctacatgaaaatcatatgctttgcagaaattggaaaactacatctattgaaaacttatgaattgttcaaagagataactataaattataaatggcttaatatgatataactgtgtcggtgacatgggatcaggagtatcatgactagaggtttgaggcagacacaatcgcccacgtggcctggcaccctcgggggacgtcgggcccgagggtgatgtgttcgccctcctcttagtccccccgagggggtcgggccgcacccgcctcatccccgagggccgaggcgccccgacccctc

SEQ ID NO: 40077 - DNA, 5905 bp, Oryza sativa
tcacctaaccacatttattgtgatttggctgagcgtgtcacgccgcatgtaacgcagtgcagtgcactcatttatccggtctgtgaccagtcacagaccggtcagattgcgggttaggtggcgacaggcgatctggcgcacgcctcgccccatcccgtcaggacgagggcttctaggcgctcgtccccagctggagctagcgtgttacctcccagagatggcacgttagtcctggtcagatatatgtcaggcttcatcctaaccattacaggcaagatgttgtgtgaagaagggcgaacatgtagattgctaagctgacacgtggtggacaagaatgaccgacgtgactggtctgactccggtcatgtcgacagcagacagccacgattccacgtcgcatctgctcccggcgaaagtggaggtagttgtaggccatcccatcagaaggtgactcggacggcaactatacaaatctccgtccatttatgaaaaggtaggggaagtcctcacaaaaaagagggaaatggtgcatgtggtatccccttaagatataaaaggaggaccttgcccacttagagaagggggggactggacttttccagattaggaacccagaacaagggagaggctggctcatactttgtagcttcttcatacgcgaatccaccaaaacacaggagtagggtattacgcttctcagcggcctgaacctgtatacatcgccggcgtcttgtgtgcttcctgtctcgcgaaccttccacagattgggagcttagagtctcacccagggtccccggccgaaccggcaaaggggggccagcgcggtctcccggtgaggagccccacgctccgtcaaactggatgcatataattgagcttaaatgcggtaagtactactaaactttcagttaagacaggggcactatattcattatagacaagaacacacatatgacctgcttgtttgggtttggaagtacagccagagatacgagcataacaaattttcagttccacatggtagaggtggagataaaagtgagaatgaatgcagtaacctaaaattgactatttcacacaagaatcttcccctgcttctgtactttgcataaactttgattattagtcggagcatacattttgattcggtacttagcattatcaagatatctaaacaggaatattttgcacacaactaattacatagatctggcaacataaatccaattaattcatttcacaataatgtaatcaatgtcactgaacatatgtcattaacctgttcagattgtctagcagatgctaccacggtttatcaaataactgcatgtttgatcagaacttcaataatcatcagtgggaactaattttgtttcttgtacagaaataaacatggaatttagatggtggtaccggtgcttttcatcgaacacatggtgtatatagctctaacagagagcaagccatccagttttatttaaccctagttgatctaactctcagaaataagcatcaggaattttagagagaaggtacacaaactgtagagaggaatcctttggttgaaatgtcgattcctgtgacctgccctcaccaagcgcaggcgaaaaggatggggtggtttggatcttcgagtctgcagattccacaactcaagaaataggggagagagtctcgagagatggccagatgagggggagagccatggccggaggccctgcgcggctgagcagttgagaatgcgatcttagaggaggcgatggaggagtgctctggtgagagataatggggagcagaagactgactaactgattccaggttgaatggggattatatagggagcttattcgttgagagagatgtggagagagattagcaggtttgttatctaatgttgcggtactacttggagggaaaattgagtttggcgggaagtatttggaggcaaactacgcatgaaaaaactcaaggaatttccttattgaaaaaaaaaagatacatctcaatttttttacaaaattggttaattactacattagtaattttgtaccttactgataaaaattaaggaaattccttatgtgattaacgtgatcccctaatgactgtgtccctctgctagctctcccttcatttttattcagcagaataatattattttaaaagggtatctatatcatataatatgaaactaatggttctttttttcctattctttttacccgattgttttttttttcatatcatataatacaaaactaaggggagccatgcattgtacggacaaatatgcttttagtttatcacatttcttaataacaccgagcctctaattagtaggtacggtccaacgtttattattggtcaaacttgatttatagggtccgatgctaggagaatttgtagtgttaacgtgtcgagtgcggctttctaaagatagaactaacagcgacgcgtcgctctcgggctctctactgttggtgttgccggtggctggctttctaaagacaaagtgtcacgccccgagctagtcccgactggaattagcccgtgacgctccaaattaacctgttaatcgataccagtcccaggaaatagtgccggtatcacaggaagatagaatatcacagcacagaggtctctttattatagagtaggagtacagtcatgttgggctgcggacagatcccgagctcacaactgcattacaaaaggaaacggaagccagggcttggaccaaacaacacaggcgcgacttgggaactaggccgaaaccctaaaactcatcgtaaccggcttgttcctggaagaactcctcatcagcaggatccgcttcatcttcttcagcaactgggggggttatttatatagagcaagggtgagtacaggagtactcagcaagccaggggaaataagtgtttaatgcaggcttcaaagaaaggccggtatttttgcaattgattttatttgaactcttttctgaaacaactaagtgagtgcttctcaaacgacacggttgagacagtgcgtcccgtccggtcggagtatgtgcaatgtatcagtctttacatcttaaaacaaggttggcacccggccaacagcttttcaacggccacccgggccaacaacttttcaaacggccacccgggccaacaacttttcaaacggccacccgggcctagctgatcccgtcagctacagatttttcaaacattgaacctcttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtctttaagtgcaagagcgggaaaccgtacacccggtacgtttcccggtccgcggttttgaaaaatcatttagttcgcaagcaccgacccaggtgtcgggttttccaagtcttttgtaaaactccagttttacccaagttgtttttcagattttaagtttgaaggcgaccgtcgatactcgcacagagtgcacgaatatcgaggcgcgactgggtggttacaaggggacatggtataacaattaacaaaggaaggatcaaatgcaacaaattaggtaggtctgccaatctgccttgcagacgggacaacagattatgtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaaaataaggccctattaatgacctctaagcgtgccattagatagatctcgagatttgggaaattttggaagttgaacggagtcaatcggatttacagttgggaagatattgaatttctaagattattggatttttggtctgaaggaaaaaggatttatttaaacccttttggaaaaagaaaaggaaggagggagggattatagacttttcctcggacggctagggcgcggcccaagggaaaaggagcggaccggccgacctaaatgggccggccggcccaaggcggcccaagtgcgcgcgcgcgggaggagaggagagagagggccggtggaccgggctcaccacgcgcggtcccgggtgggacccgcttgtcagcggctcggctcaccgtgcggagggagcacgcggcgcacgcgcgcgggcgggggagggacacggtgcacgcgcgcggtttgcggtggacgcgggtgcggcgggcccacgcacagcctcacggctcgcggtggaacgcgtgcacggggagggactgaccggggtcggcccgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacgggcaaaagcgagcacaccgggcggttgttcgtgatgaggggagacgagccaacggctcggattcgccggagggagcttgacggcggcgaatcgcagcggcgacaaccggcggggagggaagagggaaacggcgacgaggccacgaggggtcgattcccggcggtgagagcatctacgcggcttcgggaactcgatgctagcgtcggattggacggagctacgccgagcgaggctggcgacgagcgggtgctatggagctcgagcggcgacggcggcgagcacgcggcgagcgacgacaacggtcggggcggcgccggctaactacggggagtctactcgggctactaccgaaagctagggggaggagatggagcgaggaggaagaacggagggagacactaccgtgcgggacggggcgctgtgacgagaggccgacggcgcgggagtaatctctccggcctcgggccggggaagaggaaggagagggcgcggccgaagtccccttccgcgtccttgctcgtgccaactcctccgacacgcgcaacaacgaacggcgacggcgaacagagcacgggggcggcggcaatggcacggaggcgaaaacgagggagattggaggggaaggagctggggtttaaatgggcagcaatgtcggtttgggaaccaacttgcgcggtcaagggcgcgagctggcgctcggcggtcgcggccaaagcggcgacagggaggatgacgccggcgggggaaaaggggaaaaggaggggggggaaaggggcttgtccccttgcctcttcgggaaaaggaggagggagcgggggcgtcgcggcagagggaggagggaggctctgcctccgtcccttggaggctagtgcgggagtggcgggaccgaggcggtgacgacggcgatgacggcggggcggtttggagcggcgcgacgacacgggcgacaggcgcgggctggcgcggcacagggtgacggcagcggtgaccaggcggtcggccactcggcacgcgcgcgcgggaaacaacgggagggcgcggcggatggag

SEQ ID NO: 40078 - DNA, 929 bp, Oryza sativa
tgaggttggaactcctacatatgatgcatctcaaaatgagatgtttcagcttcgtgctacagtactgttcactattagtgactatcctgggattgggatctttgcgggatatagtgtcaatggtgaatttgcttgtattatgtgtcgtgaagaaacgtgctctaaacgtttgaaacatggacacaagtattgtttcatgggacatcgtcgatttcttcctctggaccatgaattacgatataatgaaaattcttttgatggaactgaagaacatagagtagaacctcttgcttattctgaaacatcagttttacaaaagatagagaaaattaatgattttgagaagtcaaaaacatggaaatgccgtagtggcttattttcgttgccttactgggacttgaatgtactccatcataatcttgatgtaatgcatattgagaagaatgtttgtgataacatatatgggacattgttaggactggaaggcaaatcaaaggataatttacaagcacgcttggacctacaagaaatgaatataaggccagatttgcatcccataagaaaagctaataataagtattatttgcctcctgcttcctatacaatgtctaaacgggagaaacatcaattttgcaaagttctccatgatattaaggttccagatggatatgcagaaaacatctcaaaatgtataaatgttagtcaagggaaaatttcaggtcttaaaagtcatgactgtcatattctaatgcaagaacttctcccagttgctttgcggggtgtgcttccttacaatgtcacttttgtcttatttgatctatgtggatattttagagaactgagttcaaaagtcctgtacattgatgtgcttgacaagttagaggaacaaattaaatgacattatgtcgtttggagatgatatttccacc

SEQ ID NO: 40079 - DNA, 8875 bp, Oryza sativa
  unsure (1)..(8875): unsure at all n locations
cattaactttttatcagatatggatgtgggacatgaagatctgtgtggactttttgacttcgttctgagagagctaccaaaaggaggctctagttcagaactagtacctgagattggtcttgtgcagctttctctgggtaactgatatgaagtgtagtctcttggtacagatgaactgaaaggaactattccagacggcaacccaaaatatggggctgaattatgtggaagtagattttgttcaaagttatgtatctccggatgtcgcttcaactgccaagatgataacattgaaacacattaatattaagatgcatatatagtagaataacaggcctaaattaacacatctaaagcatgtgtagtatagcaattagatttacacattacttaatattgttctggacacatcaattcgtgcacaattctctactactacctccgtcccaaaatgtagctatttctagcacagtactttgtcccaaaatgaagctatttttctacctaccttctcctctcaaccaatcacaaccattctttttcacctactttctcttttcaaccaatcacacaccttcttcaatcattctcacctactttcttaatacccgtgccaacctcaaaaatgcttacattttgggatggaggaagtacttaagaggagctggtaatgatgatggtatgtttgatgctcatcatctgtggatgaatctatgtagacatgggtgcgtcatttctgggatttttttaaagaaaaagtaaatgtattgtgtaacatgtcaatatctcaaattgacattcttttttttagttgcagatctgaaaataattatattgttatttttaggctataatatatttgaaaaccaatggaccaccccagcactgtgctagatagttgcctgggtaactaaactgaagcatatggtaaggagttaggagtgagtcagtgaatcctcttgtctaacaaaagtgtctgccgaatgctttatattttctaaacttcactatgactgttaaattgccaaactagtgaatggtataaaagaaaatgacataatacttgatggactcgatgtcataatcactagcataaaatgaaaacatataatgcgttaaaatgtcaatatagaatggcaaattaaacttgtagattgtgcagtgtctaaatgactgaagtttgtagacagagggtaatgcatttactctcagcactaaaaagtcccacttcttgccactccacttcgaataaatgaagattgagaaaggaatttcttaattttacatttttctgcgcatcctaaccaaacaaactctgtgatgcagacagatttgcaagatatacacaggtggcttaagataaatgatttgcctctactaatatgctaagattattgaccaagatagtttcgagcacattctagttcctactaaagttaccttcataagtacagttgatgatagtataagtagcagatacagacctcggttaagacatgaataccttcaacaccatcagcagcaagatgttcgtcaagcatattaaatcggctcagcagctggatccaatcctgtttaaggcgctgaagctctcttcttaccagcgcattttttgctttatctagctttgacacatttttcgcatgctttaattgttgtttcttcagcttaagtttctctttgagaagccttatatttgcaccttccgtaaccacatcaatgcgttgctgtccatgtttgccaaaagaagttgtatctttaactgcacataatttttcaagcttcctctgcaaattttcacttcgttctttctcttcttccagcttctgggatagatggtctatatggtttttctgatccactgcattctttctttcaacctcaattctaactcgtaaatcttcattcaacttcttctgctcctctaactttgcaaataaacactcagcacgactcttctcttctgtcaactttttcctctcggtttcaatcagatttttgttcttttccgctaacgacttctctgagttggcacatttcttttctctggcagctttctgcttctcttcttcagcccttttatttgcttcctctgttttcttcacctgagcaaccagcctttctctggcttcacttgcttcactcctcaatttttcacacgatgccctcagaccattggctgcttttctttctgtatcagaaagccgtttatactcttcagacttgtgtgtttccatattcagtaacctttgcagttctaaaaccttgcccttttcttcttcggcatttttcttctcggaattactcttcttcttttcttctactaaaacctgtttgagtcttctaatttcttcctccaactcagtgatgcgtataagttcattaccatctttgcaaacactttgtgattgttgcaaagcagagttctgtgccttcaattcaattatctctttctctagcatatctctggcatcagactcagagatcctagctgcttctgccgaatcacctcggagacgctcctcattgcacactgttcatcaacaaggtagagataagaaaacttattaatgcatgataaacataccagaagtttcaagacgcagatgtaaaatcatgaccaaaattccatatgcttcaatagtgacaggcttgcggcagtcttcaagttcttttagtcatgcatgaaatgtcacgataatatgcataagaagtgctacagagaaaataaacatactttcaaaggatcatcctctctgcgttaggcaccttctgttaaattcctgctagcatgctactaacatgctattaaattagaattcagagcattagatacttcagagaaaagtattttttttaataaggcaaatctacaatcctgaataagcataccatattatgctgtcgccaaaatattcatactgctgaattcatcccggcttaaatatgcaaaactgtgtttcaatatttgcgctgcccatttggtcgcagaccactccaggtgattttttttgttccaattagaatcacgatttcacaatgcaggagaaaccaacaaaagcagtgtggtagaaacaggtaggggaactctctagatgggagattaggtacctctgctgagctcggagcgctccttcagcagcttgtcattctcgccctgcaggagcttcaaaccctcgcgcagcgccgcgcggctcgcctccgacttctggtacttcctccagagctgcggggaaaagaaaaggcaatccaaatgcgcacgtcagatgccgtcccgccaaaaaggagacagtagagagattacaacgaattcgaggggctcgagcaggagggaccgggttaccttggcgcagcacgggttggggccacctatggcggcggccggggctgcagcgggcgcgggctcctgcgaggcgtcgggctccgacggctcggccgccatggcggcgagatttcggagggggagggggaggggaggaggggtttagggtttgtgtggtgcggtgtgatggggtgggctccgcctgccagtttccggagtgggggaaggcggtgcggtggtggtgactggtgggtgagaggagggaggaagcgagcagctgctttggctcgtgcgcggcacgtggccaccggggggggggggggggggggaaanncccnangcngttnaaggcctgaaattttttattttttagatttttttaaaaatatttacagaaataatctatcggctaaaaaaaatttaaaaaaaactctgccgccccagtggtgggccgcaagctggcgaggcagacggcgggtcgaccgcgccgtctaccaccgtcggccaaaattgcatttagccccttgccgtaattttggcaaggggctaaatgcaattttggcagcccataaagagcttggggctcgtactttttgcatttgggccccttgccgccccactagagggtggcaagggacccagatgcaaaaagtaccgccaaatgatttttctatattatgttaataataattaaagaagtatttattagtaaaacttgttaatattgttataaaaatgtattgaagttggttgtttcgcaattttatatgttaagtaaggtattattttgtaacttattcgacgtattagtactcggagaattgatataggcctatcgcagtctcggtcgtagaaacattatatggacttaaacaaggagaattatgtaacatgaagaaataatagtacaatttgaacatgatacaactatttccattgcggttacatagatgatattagattcaaactaggagggaggtagtgcaatagttgaacataacgacgatgtagtaatgggacaaggaagcatgacagtagaaatttcaatatgccaagttgtccaataaaagctaacccctacgtgaggatccctcttctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtgaagcgagcaaagttagtaaatgttgtgagaaaataaggattcatgtaatcaaaatattcttaccatgaaatcgtcgtcaagaatatttggacaaacaaataaccttcgacccaatgttgtaggctttatggaacgaagaacctgacaacgatcaccacacttgcatcttagacgggcttcccatggagggagtgccatagttagcactcgccagtcgcactgttgttcacgacattgtcgttcgtaagccgcttttctctgcaagtattgcacaatacttttggatgcgaaataccatcgaccttcttgtaaacaagtggttaggttgagaacgggattttctgtatcgacccactcgatgtatgcgcaagccgtagtgcgggtctgccgaatagagtagtgttacgaagaataaaatgattgcccatacggaatgaataagcatatgcagataataaaatacctcacggtcatagttagggcacctaaaaaagcgccttcctcgaatatcaggattccttgaagccattagttggcatcgattaccgcataggcagagaggacgctgacactaaggtggtagtaggtatacataagaatcgctacgctagttcggattctcaacgcccaggcgtctagccattgacgaaagccggtaggatttgtaatgaagcaagtggggaagagagtactgaatgtgactgagttctgaaagattgtgaggcctcgctcgttaaggcaacttatataggcaccaaaaatcgagtgatatccctgacatttgaatgtggcggggcatggtgggtacgcctgattggcgccgaaagttacattggtcgtatgcggcaaatggcgggcaaatactcgtatcgcacgcgaataaaggaggctgcatcggtgcggcagaaagtagtcatgcatgcgccgaaaggtatcgtgcatgcgccgaaaggtgtcgtgcacatataacaacaacgtattcattacacaagcatacagtactagcatgtgaagcaaataaacaaagagaagtctgctctactggccctgccccgcgccgcgttcacgcttggtcctccgggcctgtgctcacacgtggtcctgggagtaggtgaaatgatccggtggcacagcacgggtagcacgagtgtctggcggtggagtggcctgcgcctggtcctgcgtctgcaccggcggtgcgcctcccagctgtgaggggccgatgacgtcctctgtcgagcctgaagcgaagtcgaagtcagtgatgtcgaagagtaaggcggaagccaccaagtggtccgacgaggtcccaacatggtccaatggtggaccctgactcgacgtgccggctgcctgtgacgaagtcccggtgtactgctcgacttgcaagcgttcgataaaatgttaggcaccttaccttacgactaaatatgtagtacgcttgtcatctcggtacaaaaacactcacggtgaactgaagcagccacctcttcgtaggtccggtgttgcggtggtgtgccaacggctggagcgggagatgtggtgcgcgctgtactggtgcgaaacatgctgttagatcgtccttccagtccacacccgtggtcactggcccaacagcgtctcccgcgagcggtagccccaacaagtacgatacgtcctgtaggataggggctacttcaccgcacggcaagtgaaaagtgtgcgtctctggcctccatcggtcgaccaaagctgctaggagggaccggtccacattccagcgtctggccgggtccgcgtggccggcgacaacctccaccaaccgacacattggtaggaggccggcctcacgcaacctgcaagaacaaattaatatgtcattataaaaattattacagcgcaactaatttatagtaatacaccgttcgtacctctcgacaaaggagtcgtgaaccgtaagtagcttaccgcacgtccgtgcccggaatgtcccaagctgagccccctgcaccgcaataaggtgagacaggtgtcggtgatctatcgccgggtccaacaactcaggtgtatcctgacgtgccatctctgaaaaatatagtgtttcatgttagaacaattcaaaaggtagtaatgtagaacaaaagataacttgtaaaattatgaaatagtaataaaatcataagaattattatgtacaacaagagtacaggctatttaaatatagcaaacgttactaagggtacataacgatgacgtgcaatttaacatatatgtagagttcgataatataacataacataacataacattacatgccaagtccgacattacatcagcatacctaaagacattaggtgcctaagtctgacgttacatcacgagacctaaagacatgacatgccgaagtctgacattacacgacgaaacataaacacatcgatgataagttcgaaacaaattacaagcaaagccacatgccaacatagaacacaagaactacaccacgtagccagatgtggcacgacgacgcctaggacgtggtcgagttgaggtagtgccttcacccgtagggcgagctccatctgctgcttatcctgatagtcctgcctccgccgcacttggtttctccttgtctttaggacacactacgtcagaactgacattctgtaacactattttgtaacacattcggagatgtgttactggggaatgctatagcaacgaaaccttatgtgttgaaaaaaaggttgtaacacatttccaatatgttacagttggtatacatatagtaacaccaattcattgttactaccacctatagtaactctgtgttgcgctatgtaattaaaacagatttagttttggataatatattggtgccttggtttattataggtttatttaacatagtgatgtaacattatctaatcacataaaaagtactagggttggataatatattggtgccatgggtttatttaacatagtgatttaacattatctaatcgcataaaaagtacttgggttgctttctaaaacaactaacgtgcctaacagaggagttgaactcctaacctcctgtgtaaatacacaagaatcgcaccagactagccaactgggcaagcaaacatttgtgtcattagttgtaaattattgtacttgtttttttttgcattaatcaaaatttaagaaatttaattttatacacacatgcgtacactttatttttaggaattgtggtttgatcaatgaaccaagcattcattgggttgaccaatgcccattttatatataaaaaaaggatggctggactcaagttataaaagtaccacaagcacagtgagaaagcatgcagaatttatagatgaggctgtgggcttggttcataactccttggatttattttttaatttagcgagtgagtctgatccatgacatgtgtataaaaatatttaatcacaaaattgctacaatgtagctgaggtatttgcacggaatctttttgtcttacatcatgaacttagaaaaaaaatggaagaataatcatttcggcaatatgaaagaataatcatttcagtaatatggtaaaaaacaagatgctagagagatcacataacccagacatgattacaggactaatcaatatagcaatagaaaaggaaaagctcacacgaacaaatttaaaataatctatacagatagactacattgggaattattattgactactgaagactggcctaaactcatgtttgcttggactagaactgccatatgttgcttagtgacagctgcttgttcactttcgcttgccgaaagaaacagtaacaccccgatgccacctggccatgtaggaaaagaaaccaagttcatcagcaaagacatgacatttcttttgttgttaaagaagacatggagatagcgagctgatcaatagaatctagaaagacagataccttgccaatgtaactgcgtctgcatcaaaataatggacctgaaactaaacaatatagagcaaagaatggacatgaacatgcatgaacatgttttaatcaatcagaaataaatataaacacaacgattattgctatcttttaatagaaagaatagccaaggtaaccacaaattattcatccactacgcttgtaatcatatttctcacaagaacataatgtaagatcatacttaaccagtggacctaatagttgtaccgtacaccaaaaaggcagaaaagttaaattaaaagaccataaatattgttggatttagatgcattcagttggatagagttttcgatagttctaaaactggaagcacctttgctagggc

SEQ ID NO: 40080 - DNA, 727 bp, Oryza sativa
gttctaacccattgcttgtaattgtttgcattactggacattccaccaaggtgtgaaacatggaatggctcaatttatatgtcacctgcccattcatcctcaccaatgtcatatatatctctaggtttgttcttccttaccacagaccactcaggattcattggatcatcaacataataaacttgatctgcttgattggggaaaataaaaggctcatgctcaactttttctccagtatgtatgagatgtgagaagttaactagtgtgtaaccatacttatcttttttaactccttttccagaaacaacatcaacccattcacatttaaacagtactactgaaaattgtccagagtaatttagctcaataatatcgatgactctaccatagtatgttagatcacccaatattggatttgtgtcacttgatttagtataactggatgtttttgcacttaggacaactccgctattctgtgtcactccatccaaatgtttaggcctaaaccggaagccacgggtattgaaagcacgatatctttttgctggaccaatcggaccacgagccagccatctatgatcattcttgacactgcatatgccatttttcctctctagatccattatctgtgtacataggattacttagtcatgattttatttgttgatctaaatgataataacacgaaacttacatgagctctgaaccattcatggaatttttcatt

SEQ ID NO: 40081 - DNA, 1117 bp, Oryza sativa
gtgcttccacacaacttatagtatttcacaatgtgctgcctaaaatttactggattcatgacgatgtatggttattgatttggaaagccatggctgcataagtatatgttacctgttgttatttataacagtacaatagtatagcacagtactaacaatgccagtcatgcgacaactggcgctaagctgctaataggactgatgaagctctaacatgatatatcgcctttccccttttaagcatggtataatgataacaaaggaagagctatatgcccgtttaaatgaagagatggaagacatcaatcaggacattacggtatacgtttaactgtaactctggtttggtattaattgaatgttgagaataggcatcacaaatacctcttttacttatcctgtcttaccttcttgacagtatcttcctgaagtcagagatcccatggctactgctgttgatattggggagcattctgtgagtatccatcctaaatgcttctattttttaccaaaacctctcagtacaggagaaataaaaaaaatgtaaattctgtttctttgggttcataactgcaaagtaatgctagattatataaaagcttctccatacaaacttacgcgcatttcactgtgatgttttctacttttcaaatagtacaacgaagatagtgatgacgatgaggaggatgctgacaaagttgttgcgcagcccctgagtcactagaggtataatactgtactgtttacttgatggaaatgcatgcaatctgcgattctcaatgtagccttgcgaatttcttcttattactggcaatgacaacagatctttcagttcatatacatgcttattggaagctgaatgcctctcttgctgtgcatggaaatagttgatttattgatgagatggttatcgatacttgtcctacttgaaagcttgtcattcctttgtattatctgctttaccaataggatgatgaagatgatggtgatgatgctgaggatgctgaagggaaggtcagtcgtaattggagtgttctaaaaactaccggacaggctgaaaatccaaaggtaccttttcattattatcagttctgttctaatggaaaaagttcagcct

SEQ ID NO: 40082 - DNA, 727 bp, Oryza sativa
tgttaaattgttagcataatctttgtttggattgatacgtttgaacatggaattccttacttcttcatggattagaatattaccagtagagtagtctggctttgtttgtcttgtatgtttttccatagggaacatacctttgcccaagttggtggtatggtgctgtcctgtttgcatgttgggtgtgcttgtgggtgacatggtttggggtgtgtacattgccatttgccaatataaccaatatggcctgcttggagaaaccgagaaagaaaggcactttacaccataaccgccagctaattttaaggaatgaaatatgtgtaatcacacaaataattatgttaactttatcacttgaacaaagagaattgttgtgaccatatttcagtgcaagcctcctaaatgtgatcaaattctaatatctatagcttctcttttttagctcttttctgctaatacattctctgtcttgatacactgctatatttcttttagctcctttgattttttttattcctcctttttttttatgcaattcatttgttgtggtttgtgccactagccactgtaatgtctattttgttcactatgtaagcatactggtatatggagcaaacagttttcttgtgtcatgctccagtgctccatccattacaaaatactctcttaaaaatagatatgttttatgtattcacatccgatagctcctgtcggatcgggctgcagg

SEQ ID NO: 40083 - DNA, 2488 bp, Oryza sativa
gcagattttttttttcatactgtttttgccactaagccaaggatcatctcacgttcgtcattcatttgttttttagccctagcgacaaaagtgagatactcatagcaaaaacaaggtatcatcattgcttagtggcaaaaaaaacccttccctgtcatagatttgaggatctgacatactaacaagttaatgcaattatttaattctatggcaaatatgcatttcagggaacttacttctggaggtccatagccgctaggggcaatgaagacaactggatgcccacaaaactccacctgttcaactgggccgatcatgttggagaatgatatggtagtatgagagatcatacgatggaagatagcagctgctgcctgtttgattcacaagttgcaatgatattgggaacaaagaaatccacaggggatgttttttggcgcatggctcaaaatttggcgctgtaatgctctttctaggaaacaaggaagttaaccactgccaacaactgggactgtacacaatttctagtgaatatcacaatcttgtacacctacgattgtattttcttgataactaaattagcatggttagacagcaaatactaaatcaggtattcagttatacttggagtatcctgaaatctattgttttgtgaactaaaccagtgcttgtcaatagaaacaaagtgattatcgcattgcctgccaagataataatataaggatcaagttgctgatgaggcgatagtacaataaaggacaaatttaccttgagcccaaaaagtttgaggatcacttctgcagctaaatgagtgaataccacttctaatgagctcttcttcctatcaacaaccttctttgctttccgaacgtagtctagtggatctttgtgcacgcctatgaagaacgggaggattatgaaaccaagtgcatttccccatttcacttcatcctctctgccagaattgatcatatctacgtatgcctggccattgaaatgggaaagaaatcacaatagattttaccagtccaaaattgctaccactacaagtatagcaacaacaatgttcggtcctgtgagcttaaattgccaatcttgaatccaagtataattattacatgcaggcttgtggttggcctcaaattgacaaggaggatcgatctcaaacgtatatcctcgtcagtgtccatgtcacctgcaaaggagaacaagcagcgtgggagtaaagaactactgtatcagccaggccgcaatttaagagctactgtatcagccaggcagcagctgctggagcatgattttattggacgcaattggtcacctgacttccggtagtaatagcgcgacagtgcagagtacgtgatcccaaccagcacatcattgaccgtctgcgagagtgcaggcaaacataaagagaggaaataaatctccccagaacttttgctgagggttctgtcctttgctacattcaatttgcaagcaggtgaagtatagaaatggagggaaaatgatagacagaaaaaaattcgtgtttaatgattatgtatactaatattttatccattttaaaataaaaaatctgataatcgatatggcataatctaggaatacgaatctaaaaaaatctattatagagacggagagagtaggtcctatgtggaagatattattacttctacagaccgacagtttataagacagcaacactagaccaaactaacgaaaaaccattagtcttaaaaattttatactctcttttttcttttttcacttgttagcaggatactttgactacatgacttctaaaagagtatatgtaaaaaaatttgtattatcaaagcattttgcatgctaaatataactatactatttaagttcataaaaacatcgtaattttatttaaaaagatactggtcaaagataatatcatactagtcaatatagtggagtacttctaatcttagatcaaggctagaaagtgacaaaaaacgaaattccgtaaatcaattctaaaattttaattttaaagttttctgcaatttatatgccgctatatactcaaacaaacaggctctctaagaactaaagaaaacatcgcttacgcagttcatggcgttcttgacgagcttgacgtcatcaaggctaagcccccggtgcacgatgcgcttccgctggaactccccgtgcttcacccgcttgaacagcgtgtgcggatccttgaggaacatggtcgtggcgaagaagctcgcgacgtccaccacggtgtgccacgccagcgcgacgaacgaccagagccacgcggcgaacgccagcgcgcccgccgacgccggcggcctgggccgcgcgtagatcgcgccggcgcgcgtcggcagcggcggcatggcgggcagcctcgccgggtcggcggcgctgcgcgtgcacgccatgaggagcgtgagcagcgacatgccgtccccgagggagtggtgcacgcggatcgccgtggtgg

SEQ ID NO: 40084 - DNA, 3539 bp, Oryza sativa
cgacgatgaagaagtcctccacgagccgcgcggaggggctgacgggctccggcggcgtctccgccgcagcccccttgctgccgccgccgccgccgtcgccgacccggaacccattgccgccgttgctgctcgtcgtgcggacggtgagttgccgcttccgaagggcggtggctgcgcctgcacccgcgtccatctcgtgtgggccgcggcttaactgcgtcgcgctagctagagaaagtgtagtgtagtgagctggttttgcatgggcaatgcgcgcgtccaccgcctagctagaccgagaaacctgttccgatatataggccagaaatgagacgagcgttgtgttggtggtagtgcagggtattcatgtggggactgggcgcgcgtcatccgtccgtgaccagggccgacgattcaaccaggggaaaaaaaaacagggctcccgtgaggaagcggcatcttgtctccgccggaaatagagctctttgttgttgtagagtagagatatacaatatacattgcgtgatccagtctgtgtttagttcacaccaaaattgaaagtttggttgaaattagaacgatgtgacagaaaagttgaaagtttgtgtgtgtaggaaagttttgatgtgattgaaaagttggaaggttgaaaaaaatatttgtaactaaacaccggcccaattgatttcttttatgcatcaaattgtgaatatgtaatatttagttgttcgaattatatgctctataatgatagactatgggcatattccgattactgctaaaatataaatattttttagaatttgccgatgttaaaattagcaagttgactatattgctaaagtttaataggataagctaaatatattgttatcaaaattctttaggcgttattaatgtttggtaacaaacttcatcatccacgtgtttgtgttttttttaaatgatatggttcaatgtcacaaatctgaataggctctagaacttcattgaaataaggatggaaatatttttctcggcgagaaataaattttattatcttattaaagcaaaaccgtagtttcatcaccgatcgaaccgatggactggtgacagagggttgactaggagaactgtgtcatgagtcgtgaccgtacagccgccaactgccaacggaatgtgttaatgctactagctttcacgacaaatcgacgtgattaattatgcacgatgagctcgccggatgcgagcttgcgggtcggattcctaaatgtgatagcgatcttacattcaggcgatggtgtccaatggcagttggtcaaaacttgcctagatggttcgagatttcttattaatgacgtgatatatactcctcaggtttcattttaattgaagttttagacaataacacggtttacaaaatatatttttgaccttattttcctattataatatacacaataaataaatacatgtttacttttattatattgctttgaaagacaatctatacgttgttctagtttctttaaactaaatatttttaaagttattgatggtcaaatttataaaagtttgatcttccaaaacatcttattatagaaccagagggagtatagaaatgacttgaatgatgtaccactgtgccgtgtgccaggtgtactcgtatttgtgaacgtactaatgttaattaacgcgtacatcgtccatatatgctcaagtctctcagactgattatactgctaccaatcacctacatgatttaatatgtacacagttcatgccatggcaaacggagattttattatggccctctttatttaggcttaggtttattggcctagacttttaagttaacttattggcttatatgatttataagacaatggatttaatgtcctaagtttagtggttgagtcatacatctacctcacataagccaaaaaagcttctccaacctagcttttggcttaatagtgttaaagtggcttgtggcttcaaacaagccaaacggaaaagctgcttgttgtttaggtttagacttttcgacttataaattggcttataaatctaaactaaagggcttatgtagctccgcaggcgtgaggcttcttgtgtttccttaattaattgctagtgcatctttggagtgcaaatatctgccagcttcattgtgggacacgaaaaatccatgaacggcccaacgatatataattaattcgcaggcaaacacccgtgtgcctgcggtgtgattgtgttcctttcaactagaatcaacgacaattcgtgttactacgcgcaaacgaaatacggagttactaggtactccatctggttataaatattgaatattttaattttaaattctagccatctacaatttctcaattacagcttttaaaaatagggtataagaaaatcgacaaattttgctacaagacatcagaaatatgtataatttactgatagatattgtaaaaacgtgtcatggctaaaagacatcctagaaaattagtgatttgctgaaaatgacacttctgactcgattggagagagaagttcttcaaatagacaataatatatccccctagggtcacttgcttcaaacatggtgttggagtaaaaatttagaatttatggaactctaaatctgccactaccataaatacatcactagagcatatatcatatttcatcttcaattctttctcgggtaagatatctaccaacaaattacacaatttgaagtgtcctatagcaaaatttgtcataaaaaattgtcttgaaaaatactattctaatagcataaacctattattagtttttataaatttattctagtttaaaatttatgattagaatttttaaaaacttaatcaaatattgttctgaatattaaatatttgtgactagctagagtgagtacaaggagtacagtacaagagcaaatgtgttttacagagcatactatatgcttggcctccatgcatgcttatgtctcaacgtcctagaaggaggcctcgggatttgttggaaatttgtctcccgaaatctggagctctccaaaaccacttgagtttttttaattgaatttcaaatgaaatttatcaaaatttatgaaattcgtcatatcactggcctagcactagcatcttgacccttcaatgaaagtgtgaaccttaagagacttactccctccgtctcaaaaatactcaacctaggagaagatgcgaccctcatagtacaacgaatctagacaacttctctgtcacatcatctcctaggttaagttttttttgacagagggagtataaaataagcccaaaaaaagagtcaggggttaagaactctagtgaaaaagtttgtggaataaatagactttatttcctaaattttattaaaaatactatcctaaagtactactccctccggtttcaaaactgttagacattttgagatttacttggtcaccaaagacttattagcccttgcatgtatacatacattcccagggatggcaatgcttcgatccccacatgcacaaaattcaatggtggact

SEQ ID NO: 40085 - DNA, 828 bp, Oryza sativa
tactgctttaccaataggatgatgaagatgatggggatgatgctgaggatgctgaagggaaggtcagtcgtaattggagtgttctaaagactgccggacattctgaaaagccaaaggtaccttttcattattatcagttgtgttctaatggaaaaaagtgcagccttttggcactaacaaatgctgagcgtgtagcattcttgccagtcctattcatgagtcttgcctaatcatgtgcatatggtttagaaaattcatggaagtgtctaatgcatgcatagagtttgtaactgtatcaactcccactccaagcacgtaacgtaccctgtcgtaatggatacattcgtcagtgatcacaactcagtaactcacggaaaactcgaagaaagatcaactgtcactaaaagaagctattgcagattctgagaacttgactgattttcttatggactttgaagaagatgagtaatatctgggcatttactttactatgctacacgtacgttacacatggtaagcaaagtaaagcatagcagaccaccatttattcttattttttcagagaatatttaaccaaaagccagagcttgttctctggaaacttctgatcataaaacatctgatggtttcatttgactttagatttagttgctacagtgcatacaaatagataccacttaccagtagtattagatatttggatggtactccctccgtactcgtaaaggaagtcgtttaggacagcgacacggtctataaagcacaactttaacttcttgtttctataaaaatatttattgaaaagtgatatatgtatgcttttatgaa

SEQ ID NO: 40086 - DNA, 7345 bp, Oryza sativa
aatcttgtacacctacgaattgtattttcttgataactaaattagcatggttaggcagcaaatactaaatcaggtattcagttatacttggagtatcctgaattctcgattgttttttgaattaaaccagtgcttgtcaatagaaacaaagtgattatcgcattgcctgccaagttaataatataaggatcaagttcctgatgaggcgatggtacgataaaggacaaatttaccttgagcccaaaaagtttgaggatcacttctgcagctaaatgagtgaataccacttctaacgagctcttcttcctatcaacaaccttcttggctttacgaacgtagtctagtggatccttgtgcatgcctatgaagaacgggaggattatgaaaccaagtgcgtttccccatttcacttcatcctctctgccagaattgatcatatctacgtatgcctgtggccatagaaatgggaaagaaatcataatagattctaccagtccaaaattgctaccactacaaatatactagcaacaacaatgtttggtcctgtgagcttaaatggccaatcttgagcccaagtgtaattattacatgcaggcttgtggttggcctcaaattgacaaggaggatcgttctcaaacgtatatcctcgtcagtgtccgtgtcacctgcaaaggagaacaagcaacgtggtgcaaaggagaacaagcaacatgggagtaaagaactagtactactgtatcagccaggccgcaatttaaggtggtgtttgatccagagatttaaatttagtctctgtatttagacactaatttagagtattaaatatagactacttacaaaactaattacaaaaatgaaagctaattcgcgagacaaaatttttaagcctaattaatctataattagagaatatttactgtaacatcatataggttaatcatggattaattaggctcaatagattcgtctcgcgaattagtccaagattatggatgggttttattaatagtctacatttaatatttataattagtgttcaaacatccgatgtgatagggacttaaaaagttatcagccaatcagcagctgctgtatcagccaaaattggtcacctgacttccgttagtaatatcgtgacagtgcagagtacgtgatcccaaccagcacatcattgactgtctgcgagagtgcaggcaaacataaagagaatgaaataagggcagctaaaattgaaagtttaattgaaattagaatgatgtgatgaaaaagttgaaagtttgtgtgtagaaaaattttgatgtgatgaaaaaattagaaatttgaaaaattattttggaactaaacacaacgtaaatctattattttggaactaaacacaacgtaaatctccccagagcttttgctgagggctctgtcctttgctacagtcaacttgcaaacaggtgaagtatagaaatggagcgaaaatgatagacagaaaaaaaattcgtgtttaatgatatttgtatactaatattttatccattttaaaataaaaaatctaataaacaatatgacatacatattctaataatacaaatataaacaaatctatttcagagacggagagagcaggtcctatgtggaagatatttttactgctaaagacctacggagtacagtttataagacagcgacactcgaccaaactaacgaaaaaacattagtctcaaatttttacattccctttgttcttttttcacttgttagcaggatactttgaccacatgacttctaaaagagtatatgtaaaaagatttgtattaccaaagcattttagatgctaaatataactatactatttacgttcatcaaaacaacgtaattttctttaaaaagatactggtcaaagataatatcatactcctagtcaatatagtggagtacctaatcttagatcaaggctacactactagaaaaatagtttttacacaggcggccaaaaaggttttcgcaggcgggggagtcatccgcggctatcccatcgcctgtgaaaataggttattttcgcatgcgggtccatggcccgcctgcgaaaataaagcgagggaacaaaaaaaatccggcgctacccgccggcgccggcatcctcctccggccgatggctctccacctccgtccggtgccgttacccgagggcgaggggagcgccgcctttgccgccgctgctggccggctcccctcttccgtccagatctgggaggggagtggccggtgctgtctgcgccgccgccgccgtcggcgtctggggggaaggaagttggtgcccagagccgccgccgctcctcttggccgccgcctcctccttgcgcgcatcgaggcgccgacggccgccggctgctcctctccttgcgcgcgccgaccaggccatcggttcctctgacgtcgtcgcggcccccttcctctcgccgccgccaacctcccgccaccgccgccgccgcactcgtggccaccgccctcaccccgccctccggccgctggccaccgccctccgccgccgcctccaatggtagacgccgcgcgccctacaccgccgtcagcgccagggagaggaggagaggtgaggggtggggagaggtgcgggagagagctgagaggtgagggaaagaggacatagaaaaaatctagggtatgtagcctctatttgtattcgctatgtattttcgcaggcggaccatatttttgcaggcggaccacttatatggtccgcctgtgaaaggcgggcagtgggtttcaccccgatttgtatttttgtaggcatctatttggctccaatggtcatacccgtctggaaaaataaaagaccaatgttgctaaaaattactccctccatttcataatataaagcacaattacttttttttaaatgttccataatataaggtatgcatacatgtaggcaattaactatggccccttctccattaaattattattttttaaaatcatgcactctcatgttccctaattctattagattcatgcattgtatttattaggatgatccaaactacaagatgataataattatttcttggtcttttagttaggggtggttatgccttatattttggaatggatggaatatttttctagtagtgctagaaagtgaccaaaaacgaaattcttaaattttaattttaaagttttctgcaatttatatgccgctatactcaaacaaacaggctcgctaagaactaaagaaaacattgcttacgcagttcatggcgttcttgacgagcttgacgtcatcaaagctaagcccccggtgcacgatgcgcttccgctggaactccccgtgcttcacccgcttgaacagcgtgtgcgggtccttgaggaacatggtcgtggcgaagaagctcgcgacgtccaccacggtgtgccacgccagcgcgacgaacgaccagagccacgcagcgaacgccagcgcgcccgccgacgccggcggcctgggccgcgcgtagatcgcgccggtgcgcgtcggctgcggcggcatggcgggcagcctcgccgggtcggcggcgctgcgggtgcatgccatgaggagcgtgagcagcgacatgccgtccccgagggagtggtgcacgcggatcgccgtggtggccgccgcctccgacgtcgggaagtccagcacgtggaactcccacagcggccgcgactcgtccatgggcttggtggacagcgacgccacgtagtcctccaccgccttgtccgggtcggccgccaccgcgtccatgtccagctccgggtagatgatgtggtcgtccacgttcagcgtcgtccgcacccaccgcgggttgccgccgtcctcatccgtcacctgcacacgcgcgcacacacacactcgtgccgttcgtcagctcaagcaccagcggcgagctcatgggcgcgccgcgcgcggcaaggcaggtgcacggaccgacctggatgctgcggaagcgtgggtagcgcgcgaactgggcggcgatgccggcgcgggcgacggggtcgttcaccggcgtggcaatgccgatcaccacgacgatgaaaaagtcctccaggagccgcgcggaggggctgacgggctccggcggcgtcgccgccgccgcccccttgccgccgccgacccggaacccattgccgccgttgctgctcgtcgtgcggacggtgagttgccgcttccgcaggacggtgtcggtgtctgcacccgccgcgttcatctcgtgtgggccgcggcttaactgcgtcgcccgtcgcgcgctagctagctagagaaagtgtagtgtagtgagctgagctggttttgcatgggcatgcgcgcgtccaccgcctagctagaccgaaacacatgttccgatatataggccagaaatgagacgagtggtgtgttggtggtagtgcagggtattcatgtgggggactgggcgttatcggtccgtctcatttctggtggtagtgcagggtattcatgtgggtactgggtgttgaaaatactggacctggccgacggttcaaccagggggaaaaaaacagggctcccatgaggaagcggcatcttgtctccgccggaaatagagctctttgttattgtagagtagaaatatacaatataccttgcgtgctccaattgatttcttttatgcatcaaattgtgaatatgtaatatttagttgtttgaattataggctttataatgatagactatgggcatattcagattactgctaaaatataaatattttttagaatttgccaatgttaaaattagcaagtcgactatacactgctaaagtttgataggataagctaaatatgttgtaccaaaattcgttaggtattattaatatttggtaacaaacatcatgcatccacgtgtttgtgattttttttttaaaaaaaatgatatggttcaatgtcacaaatctgaataggctttagaacttcattaaaataaagatggaaatatctttttaggcgagaaataaattttcggagtattatctttaagcaaaaccgtagtttgatcgccgatcgaaccgacggactggtgaacagagggtttgactaggagtactgtgtcatgagtcgtgaccgtacagccgccaactgccaacagaatgtgttaatgctactagctttcacaacaaatcgacgtgattaattatgcacgatgagctcgccgtatgagagcttgcgggtcggattcctaaatgtgatagcgatcttacgtactccactactcaaagaaagtcctatagcacaattttcaagtcaaaccttgaaaaatataaattataaataactcttaagttgttgagtaaatagatttgtcttgaaaaatactttcataaaaatatacatatattactttttaataaatgtttttttatagaagcaagaagtcaaaagttatatctttttaataaatatttttttatagaatcaagaagtcaaagttatattttgaagaccgtgtcgctgttctaagggcaagtgctatggtagatgtgactatcacctctaaatttatctattttattcactcatgaattaagaggcaacacatacaatgtatcacctctaacacacaaataccaatatctctaatactctcacacacttcttgaaatttgtgtggaggttatctcttgatttaggggtggctcatcttctctctctccacttctctcctctacctcatcacccaatctaatgtggcatttttaggggcaacatatgagatattatagtacttgctctaaacgatttcctttaaaaaacggagaggagtacaggcttggcagttggtaaagcttgcgtggttcaagatttcttattaatgacgtgatatagagatgacttgaatgatgtaccactgtgccgtgtgccatgaacgtactaatgttaattaacgcgtacatcatccataaatgctcgagtctctcagactgatcttatactgctaccaatcacctacatgatttaatatgtacacagttcatgccatgtagctccgcaggcgtgaggcttattgtgtttccttaattaattgctagtgcatcttcggagtgcaaatagacttttatttcctaaactttattaaaaattggtatagtggcccgcgcagattgcgcggctagtatcgttacattcttttatacaatatcatatatatttttatattttattattaaaatatattaaaattatagcataacttttaattttgtaccaacttgaccaaactaaggctgtgttcgctacctccagatcccaaccggaatagtaacacacggaaaacggaacagtccattagcacgtgattaattaagtattagctatttttttaaaatgaattaatttgatttttttaaacaactttcgtatagaaactttttgcaaaacacacaccttttagcagtttgaaaagcgtgcgcgtggaaaacgaggaagaggggttgggaaaggagacatccgaacacaccttaacagatgtgtaatattcatattgtattttatatacatgatatttattaattatttaatattctaattttagttaattataaattgtattcctatataaactataaactcatattctaatatttcttatttttcaattccgaagtcatgttatttacaaattttattccaatatggactctaaaccgttatttcaatattccttagtttaaaatctctaatttcatttatttctaaattgtatttctatataaactctagactcctctttcaatatttcttattttttaattttaaattttagttatttccaaatctatctgttatatttttaaaacagctttgaaaggaggcaccacgttcgctgtgggggctagaaattcccacattaatcggagaaaaagaaaaggagagtccaagtagaaataaaaatttaaaaatagctgaaattcggaattaaaaataagaaatagtgaaagaagagtccatataagaaccgaatatgagattaatcaaaatttggaataaaaataaataaaatctaaaattagaaaagaaaaggagagtccaagtaggtatacaatttaaaaataactgaaattcggaattaaaaataaggaatattgaaagaacagtccacataggaacccaatacgagattaattaaaattaagaataaaaataaaaataaaatccaaaattagcaaaaaataaaaaatagtttaagtatgaatacaatttaaaattagctgaaattcggaattaaaaataggcaatattgaaagaagaatccatataagaacccaatataagattaattaaaattcagaataaaaaaata

SEQ ID NO: 40087 - DNA, 8092 bp, Oryza sativa
  unsure (1)..(8092): unsure at all n locations
aaccccattgataatcatatttaatttttaaaatctcaatgacaataaaaaggagaagcagcgggcggggtgtagaggagtatagttgcagagccaccaacgtttggtgggacgtctagaaaatataaaatgaattccaacaatagttatgttcgattattagaatcccaatgacaagaaagagtaggcgacggacgggccgtagaggagcgtagtggcatcgtttgatgggacttctaaaaaaatataaaaatgaaactcaacaagacagtaaactctaaaaactacaaggtccaatttttaaatgttcggaacttctaaaaagtaaaagaaaaaacaatgataatcatgttcgattttaaaatctcaatgacaataaagaagggaggcaacggacgagccgtagaggagtataatggcaaagctgctgacggtttggcgggacttatagaaagtaaaaatgaacccaaaggataattatgttcgatttttaaaatcccaatgacaataaagagaagagacagtggatgggccgtagaggagtataatggcaacatttgactgcgcatctagaaattataaaaatgaaacccaacgtgacaataaattctaaaaactataagatccaatttttaaaggttaccaggagaatgaatagaaatagtggtagattgagcaagcaaataaagaagagattgacagaagtaaagggtagcaactggtgtgactgttaanaactatataatagaaacacggggatgataaggtttggtctttcaaagtcttaagacaacgagatagctatttaataaattttaagtgaaatcataaaanaatatatgattttgtttaggtgctagccacgcaattgcgcgggccacccagctagttgtgttcatatatggactttagactctttttctagtatttcttttttttttcaattttgaactttagcttcatctaagttgtatttcatatggactctagattctttttctaatatttttttatttttaaatttctagttttagttttttctaagctgtatttctatatggactctaaattatacttttaatttttcttatttttaatttcgaaattcaattagatctaaattttatatgtttttctatatggactctaaacttatctttcaatattctttttttattttcgaatttcagttatttctaaattgtattcatatatggactctagactattttttttcaatattccttaattatttctaagctctatatggtctctctaacctcatcttttaatttttcttattttttgattccggattttagttagctccaaattgtattcgtatatggactctagtctcttcttccgatattccttattttctaattccgaatttaaactatttttaaattgtatttctatatagactttatttttctttttctctgattaatgtgagaatttctaggccgtgagagtgaacgtgaaggcccatttttctattcctttaataagttaataagttaatagatactatcctaaagtactgctccctccggtttcacaactgttgacattttgagatttacttggtcaccacagaattacttacccttgtatgtatacattccaaggatggcaatgcttcgaacccaacatgcacaaaattcaatggtggactcaatccactagactacattagaattaagtataatgtgcaaactaccgtatttaatatggcataatagagaataggcacccaaataaatcaatccttgtaaatgagatcatatctaaatcgctaagggcttattcggatcggagggtaaactcaggaaaaacataggatctgcattcctatggattcgggtactgtagcagcattcggatcaaaggaatcccctgtaggaaaatcagaggaaattcgaaggaaaatttccttggccatccattccacaggaaaacaaacaatccactccaacctctttttatttttcctgtgcatgggaacgaggcaatcaacaaactaatcttcacaagcttcactcctctgacacatgatgattttagttagtgggtaggttctttaaaaattcctatgtttttcctacgctctatccgaacgcatgtttatatagtattcctatgtttttcaattctctgttttacacgtgcattcctatcatattcctatgattttcctattcctgtgttttttcaatcctccattccgaataagccctaagatttttgaaactggagagtacttctcactccaactactgccaatttaaatctcttctccttactacttctcaaccaccctctctcttccaaacactgcttgtttaacgaggacgtacttccttcccaatttgtcttatacttttttttagataagggtatttttacccggcctctacatctaaccggatatatacggccattgaaatagggaacttagccccgcaaacaacccaatctaaaatttactccataggagatttgaactcaggaccttggggtactactcaggtcactataaccactaggctacatgccctttcgtatttgtcttataaatgttagaattgtttttataacagaggcagagcaagtatcaaccaaagatacttcagggtgagatatcagtttgagtatattttaagggcattaattgggatgaaacaagggcgcatttaggttgtgtttagttcacaccagaattggaagtttgattgaaattggaacgatgtgacggaaaagttgaaagtttatgtgtgtaggaaagttttgatgtgatggaaaagttggaagtttgaaaaaaagtttggaactaaacacggtgtcaaatgacagaatttttctgtgcatgtgagagattagactattatcgcacgtcgttaaaaacatggcaggaccgcacaagaaccatacaagtacccttttttttttaagataaagagagttttattgatcttaaacaattacatcaagatgatacaatttctctaagaccactctcggcctctgcatagttaggatgtacacagcctatcaatattataaaagaaaaggaaaaaaaagcgacacaactgctacaaccgtgccgcagcgacttacatctacgagtaatcttcatctcttatctccaccaaaacaacacttagactatcaaacggactccctttaaaacaacgcctccaatgaggaaatgacgtgcgcacgcgtcatcattgtaatgttccaatcaactaagatcagaccataggttttcacctagggaaattctgtgaactctagacaatgtcttcaagaaggaagaacatccattgccaagtacaaccaactaaggacagacttagggatttaaccccggagttaaagaattagtaacaagtaccgcctgaatgaagcccactagtattgttgcccccttattccgagacagaacctccataccccaaacttaacataatcacaaaaggccacgaacataattacctgcatccttctatagatatccttcgaagataatgtcgcgagaagccaaaaaggcacacacccaaaatccataggccatagctaaataccctacgaagataatgtcgtgagaagccaaaaaggcacacgcccaaaatccattgggtagatctaaaggatgagatatagataagcgatacctttaatcgaagtcaagctgacgatggtctatggtagatctgaacgccactgctttatgatgatgaaaacatcatcgcgagaagtagccactaaaatgatgagaagaaagttggcatccgcctccttcaattgtagcctgccatattaccttatcggtcccaaaatagatccctccaccaccatccacaacgaacagctagagggtcataggaacgaaagaatctacgaatcaggctgccgggttgtggcgacgagtgtactcttcacctcgaaaccccagaacacctttagcgatctgggaagcaagatgaagaaccacaaagagaagcgtttggggagacgaggcttgccgtcgacgagtcttggtggaaccacgcgacgaggtgaaggttgccatggagtctgaacccctaccggcaccaagcgcatggtgaggagagcttggcgatgtccacctccgcactcgatcttgagcacgacgtgcctgtcgccctgttcctgatgccgccaccgacaaattcttccagaatcgctgatcagcgcatgtctgcatgatgccccaccgccgccttcactgcgccccgcacggcagcgcgctcgggcggcggcgagacggcttcacttaggtggtgtttagatccagggacttaactttagtccctgtctttagacactaatttagagtattaaatataaactacttacaaaactaattacataaataaaagctaattcacgagacaaattttttaagcctaattaatctataattagagaatgtttactgtagcatcacataggctaatcatagattaattaggctcattagattcgtctcgcaaattagtccaagattatggatgggttttattaatagtctacgtttaatatttataattaattttcaaacatccgatgtgatagggacttaaaagttttcccatctaaacaggccttagccggatcgccgatccacgctctaatcacggatcggtgcgctcgcttctgaaacggctacctgaccgaataatgacaggccccgctgtaccatacaagtacagtacagcatggagtcagtcagaccgccatcctcccttgcgcctagttcggacgattgtaatgaacgaggatatcatttgaattttgactttactgaaaccggataaggcctttgaacataatcattggggctagcaatttaggtctacgtttctgattgaccgcctgatcccggcggtttcaccgtctttgacaaattttgaaaaaaaattcctgttttcgaaatccttcccgaaaattgatttcgagccatatagtagaccctgtttagttctaaagttttttttttaaacttctaactttccatcaaaacaaacattttatacacacataacttttcagtcacatcgtttcaatttcaatcaaacttccaaacttcagtctaaactaaacacagccgtaataccaaaagatcgtgaaaatcaatcagtttttgtcggtaaagtaaaccctcagcttttcttcgtcgttttgacgttttgactaggagctgtcaagtcttttttattttttgagaactaggagctgtcaagtctactccgtccatctcaaaacaagacaaaccatgggtttccgtatccaacgtttagccgtccatcttatttaaaaaaatatgaaaaaaattaaaaagacaagtcacgcataaagtattaatcatgttttatcatctaacaacaatgaaaataataattataaaaaaaattcatataagacaaacagtcaaacgttggatacggaaacctagggtttgttttttttaagacagtgggagtactcggcaagtcggcagtagccagtagtacgactagcaagtcatgagggtgtggttagatcaagggtctaaagtttaaacgtgtcacatcggctattatataggatatcgtatagggtgttcggacactaataaaaaactaattacagactccgtcagtaaaccatgaaacaaatttattaagtctaattaatccgtctgtttactatagcatcacattatcaaatcatggagcaattaggcttaaaagatttgtttcgtaaattagtcgcaatctatgtaattagttattttttagcctatatttaatactttatgcaggtgttcaaacattcgatgtgacagggtaaaaaattttggggtgagatctaaacaaggctagttaataaataaaaaagaaaactataaagcgaccatgaagggggtgtaggatcgtaaaagtaaacaattctatgcacgtcaaccatatcggcatgttcattagatctggctgcggctgcagcttctctgcagcaacagtagctatttactgacaaagcgaacatggatatacatcgatagaacaacttgatatatgaggattaattaatttcatagtgaagaatgttttggtgtcataggtgttgatggcctttgcctatattaggggatgctcttttttttttccgagaggggatgatcaagttagaatggagaaagttcatcttttagatttgttgataatttttttaacaaatatgtgaagctgacttgatgcttgatagaatcatcctactaaaagaataattagtgatgaatatgagcatccatgttaattctaatacttaaatccagtgaacatattccaccacaagaaatctaaccaaccagttaaattacacatacttttcttatttgagccaatttcatccgtaaaaatattacagtatatttttagtgagcttatacggaaagatgggaacagttgcgattttaattcatttactaaaaaaataaaatataccgatggtattacaacttaaaaaggatgtaatttagtagtttattcttacaggttgttcaacacgaatgttacaaaacatatagcgcatggcctgtactcattgctaagctggtagattgccctaacattatacgctcgtgagcaacaggggcatgacaaatttatgtgtcgagaccagcaatgaaaatgcaaatcaactcctatattctcagtgtgttgctgctggtgtgtttttcaatcaacacatctgcatagtggttagcactaaaaagaaggttcatcttatatcagatttactatcaatagtgctagtagtaattattgcacgtaccgttggtttatttgtagcttatgcgtgtatgaccgtgttagcgaagtgatcaacgtgacgcatgtacatggaacatgttttacgttattcgcatattcggaaaagatcatttacttgtttgagtattttgctagacaagtgacaaaaatataccccttccgtcccaaaatatttaacgccgttgacttttttaaacatgttttactgttcgtcttgattatttttttaaataagtaaaactatatatatacataaaaatatatttagtaatgaatcaaatgatatgaaaataattaataattacttaaatttttttgaataagacaaacgatcaaacatattaaaaaaatcaacggcgttaaatatttaaaaaagtcaccttgtaaaattgtgatacaatcggtatattttacttatttataaattattctataattctttttttaaataatgcaacacaattaatctctctactaatttagtcaagagattaagtgaagaatataatacgcagcaggattattttgccgtgtcaatccgaaaagcatagtttatcaatctgcttggagaaaaccatgcttaatttggatcaaacctaccgagatgttttagccacgtttacgaaggattgacgtggcccgctcctggacaaccttccacgcttcgcggacatggcgctcctcggtgagcgtgctcccgatggcgcacctgagcatgtacacgccacccaccatggcggagctcatgtacggccccgagctcgccgcgttcacctcctccaggagcctcctgttgagctcgtttgccgccttctcgcctccgacgccgacgccgacgccgagtctctccggcggcgaccggaggcggaagcacaccagcgcgaaccgcctcggcgccaccacctcgaacctcgcgtcgcccctcaccatggcctcgaacgccgcggccatggcgacgtgggagcggacgtgggagcggaggccctccacgccgtagcagcggagcacgagccacaccttgagcgcgcggaaccgccgcgtcagcgtggtgccccagtccttgtagtcgacgacgtcgtggccctccgccgccgcgtccctgaggatgtactcctgcttagtgcccagccctccaccagcgccgacggcgccgccacccacaccgcgcagcagtcgttgttggcgaggagccacttgtgggcgttcatgctgagcgagtcgacggcctcggcgccggcgatcac

SEQ ID NO: 40088 - DNA, 3999 bp, Oryza sativa
ccggcgatgcgcgcggccttgcggaacgcgaagtgggtctgatcggagcagtagacgacgaggtcgccgatcctcctcgcgccgatctccgccagcttccggtccctcgcggcgacgagcgcgcagaggacggcctcgcacgacgtgcccaggatcgtgccgccgcctccgccggcgaacagaaggctctccggcaggtgcagcgccctgccgagccagtccacgaccaccatctcgagctcggtggcggccggcgaggccgcccacgtgaaaggcacgacgttgatgccggccgcgagcgcctcgccgagggcgccgacggtgctgctcgacgccgggaagtgcgcgaagtggcgagggctctgccagtgcgtcacgccaggcaggatgaggtcgcggacatcccgcagcgccgccgcaaacgcctcgggctccgggcgggacggcgcgtcggcggggagctggcggcgcaggaagccgggagtgacgcttgggtggacggggtagtcgcccaggccggcgtagtagtcggcgatgaagtcgacgacctggtggccgagccgccggaactcgtcagcgtcgagcagtagcgcggtatctgacgccgccggcgtcgacgtcgtcgtctccacctccgggatggcaccattccgtggggcaccgccattgatggtgtggcagtgcgagggtggtgccatctgcgggaacgggcgtcggtacgtggcggaataggcggtattagctaccaaatttattgggctcgctagctaatgctctggtcaataatgttagcaatagctacaccagcgtcgatctacccgtataactgtatctctctatctatctctatacttaatgagcaatgtgtgccacattaattgggaaaaaaagtcagattatcgatttaggtcctattttttatccctctctcaaatagccaaatagccaaaaaaaaaatctaaaaggtgagctatttgagaactatttgaaaataacccatctaaaaaaatatcccacccaaggagtgctaatttaaactattttgggtggggcccactaaaaaaatgccttttatctctatctcttttcatgggaaggtatattaaaagccaaatagctctcaaaataaccctttgatccgaacaacttagggctattttttttggatggctattttcttgtgctaaaaaatagctctcaaaataactcgtgactagttctccaaacatgatcttagttgggtcacatacattgtattgccataaatgcacgttaattacttccttcgtcctagagtaccataatagaagatgcggtatctataacttagaacggtatctaaaattcattttttaattttttattatatttatactttgtagcaataaaattataaccattcttgataaaaaaaaaaagatcataaccatgtggaaatcaaatgccaattatgcgatgctatttttttttatcaaatgtgtctccaattatagcaatcagctgaaaaatatgtcaaaaaattatagcaaaaccgttaaaaaaaatgagattaaaagaagcttaggtataagtgtgacctactactacctccgtccagggttcacaattccgatgaaaaccgacgaatttgcggaaaaccgaggttttgacgtggctcaaaagtagaagccatttggaatttcgatgggtttcatccaaattaaaatttaaattgataaaaaaggaaaaaaatcaaatcaattcctataaatgatatgatattcatagaacctatatgggtataaattttccaaaaaaattagtgtattccgtgtattcttgaactttactgtagaaaagagaataataacaatatttttaaaaaaatgaatacactttcttggaccgaattccatgtattaggcctacttagtacatagcccagataatgatgtataatagagagaggatgtggtcttgcacctgatttcgctcggaatttcgcccaagccaaccggttttcgtgagcatatcgataaactcagggaatttgtattcaaattttggtttatgaaatttgttcgaaatctaccggcttttcaccggatttcgcgaaaaacgtcatactaccagagcccggaacggaatgtcatctcggaattgtaaaccctgcctctatcccagcaagtcacaaacaaaataaataattattcgataactttttttaataagacgaatgatcaaaggttacaaacaaaaactcaaggcggcaagtattttgggatggaggtagtaactaatagttcccattttttactattaatcatgaaaaatataatggctctaaaccgggtaaaacattgtcgacgttttaggtctcgactacggtatttgtatggtatgagaatcgtcggtaccaaggtatatgcgagattgaggtaaaagagacagagataaggattttatataggttcgggccccgtatgtgataggtaatagccctactcctgttggccgaagccggtgttgctcttattcatctgaatcacacaagtacaatatgtgagataacctatctatccaccgtcaacttggtggtatggataaccaacatgtagtcgacgacagggtaatcttcctcctcgagtattagcccatcgtaatcaaagatggcgctagatccctcttgttggcctccgcaggcaccataaggggtctgtttaggtttatccctgatgttaatgtctagtgacgtgtgttggcttgtgtattgtgtgtctatctattgttgtgtactctctccccctatggggtcttgtatttatacccatagatgtccctttgtccaagtagaactaggcagaccaatatggatacaatctgagttgtccttatcatttccatatagaactctacttatccttccttatccggaactccttctatatacgaggtatgatttcatataggacttagtatatggtgggcgtcgccgtgtttactcaactactattagatatgcggtatctataaccgtcacaaacatgatgtttgctaattcaaaattttgggataattaaatgtttgggaaaagtactactccactctaaaactcagaccccaaaaggagaacaataattggtagtactaattaattctcgagttttgaaatataactaaatcacgaagcatattaaggtagtttttcaaaagattattcaccagattattactgcagatattacacttgtttgttagattaacttaaatattttgagaaataaactttataaatagcatagaacaagtggcataataagcattaaggtggaagaatgtttttttagaagtcatatgtttagaaacatggagtaaataaatcaggacaatagtccggtcaaaaagctggaaacaacgagtccaacacaaatacaaccagagacttattagttgcaaattttataaatattaattaaaaattataatggagggcgcagtatagtgaactttttttccagagaaaggtattttttttacccggcctctatatccaaccggatatatgcagccattttaatttagtaacttagtctatcaaatagggaacttagccctcaaataacccaatctaaaattcgctcctaggaagatttgaactcataaccttacggtatagtgatctgtttgggggaagttattatctatagttagtttttatggtagaacccgttggacaggcttgagaggtagtggttttattttgtggaggatatcataacaccaaaatttgcaaatttgaagtctacgtgtaattttgtactctgtcactgaaaaatataaggcatgcatgtatttgaaaagttggtagttttaaatttgaaagttccttaatatgatgttaacttaatagtcattgattattacaaaagaaattaacaaccaaagtttaaagttgggactattttacacactaatatgtcttatatttctcgttggagagtaatcattaaatttataatt

SEQ ID NO: 40089 - DNA, 10684 bp, Oryza sativa
caatagtatgcactttttatagttgtatttattattttgcggagtaatatattatattttttagtaatatattatatattaatttatgttattacttttttaaaaaataatgactttttgggtggcacatataaccgagtgtacgctttgtcggctgaaaaaaataagtttcattcattggttatttccatatatgagcatgcattgtaccaccgcgactggtatgagacatgatcaactctgaaaacccatttttttatacatatggagtgccactagagtctggaccatgcaccgatgcacaggaccggaagcgggtagtggttatctgcctaggcatcgagcatgaattatactctctccatctaaatattactttttggttttttctttcaaaagtttaagatctatttgtaatatttatgagctaaattaaatcaaaatccaagaagttattttagtacttattggtttttatcacatggtaaatgagttaattatattttagttttggtgacaaaagaataaatagattttagacatttggatggagtaataaataaatgttctcctcctaactagacgatgaaaagcggtcgagtggagtggcattgagttgcatgcgcagagagccagatcaggagatcgagctagctacttcctctatcttataaggaatttaggtgaaattgacacatcataatactacgaatatggacatcaagcctctttcagtggcccgaaaggtctcgagaatagtatgtaaagtactccaataaaattacgggtgccatgcagtgtctccagcaggtgcaagtgcacaagataaaagagagaagtgaatagggtggcgcacgatcttgctagaatagcaatgagtactaggtctaatgctgagtggaggctatgtgccccagcacaaatcctaaacttattaaaccaagaatgcaaccctttattccgtcattaataaagctctctctttaatgtaaaaaaaaatgtaaagtactccaatggaatgcccagtccccgatcgaaatgtagttatcgcgtggttgtgcctgtgtcccgccggcagagcacgagcgacaccggaacgaaacgagaggcagcgcgtgtgaacagttgttcgtacgtgccgtcatgcgcaggtcatacctggcgtgatcacttcaacgttactttgggaggtttttgctaattaaccatcgttcggcgcccaaaaaggtttttaccaaagataatcgaattttactgagttatactgcggctacctagctacgcctcgttcggagtagaagtaaaacgcatggcccgcaggccatagccaggttgggcaaattatctatcgccaggtcaagtgcccaggtcatcactcctcaggtggtgcactggtgctcgatgcctcgatccaatgccagtacgggtatactgctcagtgcttgcctgtagttgagcatgcagccggccgctctgccaggctcattcaattgggtccggccggcgtgtcggctgacaagtctgcagcactgtacatctgggccagcttcaattcggtcaagagttgctgaactagatccgtcctgcgtttcggcctttaggcctgtcttgcacagacagaaaacccgtcccgatggcacaggatttatttggttatctccgactagatggcacagaacggcaacaacgatgtcagattagttttcgcacgacccgtttcacgagtgctggatctgttgcaagagtgaacgctataaatgtgctattgacgtactagaactagaagaactgcgtagtagcatactcataccattaccagtgacattctgggtcacccggagctaccccactcatcatttcatcaacaaatccgtaaatcttgatacggcacttgctcgattcaagaaatcaggagttcagcgcacaaggcacgtaggtttctatactgtagtcacgcactcccttttatccaataaaagaaaaagtcagtcgggaagtaactttgtagtctgatacacaaaaggttacaaggtcacatgaggcagcacggctcaaacttttctggaaagcagagcatgttttgtccataatttgatacagagctaacagcacagtgcgggcaactaaaagcaaaaaatgacactattaaatctaataatcgatggggcctcctcgtagaagagacaatcaacagatgcgttgtctgcatgaccgggcactccaacctcatgtgtagatgtatttcatggcatttcttcagggtgcttttgctgcagataacacattccattccaactctatgccaaacagcccaacataaacaggtgtatatacttacagatgcctgatgtccaccatgactcctagatacgtctcaatagcatcccatcatatcctggaagtaatggtgaaaatgagttcagtaaaacattccaatggagcaaactaacaatcacaaaattttgcactagcagaatataacaaggcctgtaaaaaataatgtatcgtcttcaccaagaaacaccccagtcgttctataatctggtaaaggacaccctgacacgcataagcatgaaatgcagtaggaaacgaaattatcaattgcaaacgtgcaccggcaatatctaggaacagatccttgcttgatgtcaataatgatgaagaaccttagtctgactggcatactaacaagatgaaggcattgctagccatgttcaaaatgaaggattttagaatagtcataatgaaggacttcagaatatcgaggcacaacagattagggttctgattttaggatatcgacccacaacatagttggcttctgacttcaagtcaccaagcactatctcgctaccccaatgagaacacaacctcctagcactcacaagtaatccccagtttagtcctacaaggtaacaattcaaaaatcttcgaatacttggtaaaagtgtcctgctcatgatatcaaggaaaatgaaagtaaaatggcatatcagaatatctggagaccacatgaacaatcctccatatgataaccctcctatatcttgttacttttttttctttttggcatcaaccatgccaagttgccaacagggttacagggcaacgtcaagcacatggtgtttactgcaaattaattaggaccagctcagtacataatccaggcaagcctgccttaacagaagtaaagctctgccctattgtgctgttctaacataagtatgtactagactactttacgaaaatgttttccatcctggtcaatccaaattgcctcatctcttatatcacaaactactgaaactactctgttcataaaccaaatagagtcaaaacaccagaaaacaattaaacttgacaagttaaatatagggaaccggtcagttggcctcaatgcctgaaaacagaataggagaattcataattagctattttgttggcacatttcatttgtagaatattaaatccccaatgttgtttccgttgatcaagaattcatgcatgttgcagttacatcatcgaggactggttaggctatacccatggatcaacaagccactactcatggttatatctataagacttcattgattaaaactaattggttatagtcatcattgatcatgtataataggacctcacaatacttttcacatcaaaaactgaatactggatatctttttgcaaaatttagtgccaactagaatataggttttcaagaattagagtatgattcaaagtaattggtcagaatgagcacaaaaaattaatacaacatgttgtttgatcagtcaaaggaatttaacagaatcacttgtatagcttgtaaaacagaattatgatcctttatctctgaaactaatccagaaacccataaatagagacataaacttaatataatgacaactgactctcacttcaaaattttctttagataaataaagtagccaactagtcatgcattagataaaacagagtagtttctggaatattgcgcatcacctatatgttggtagcaattctattccataatcacatcaagtggtttaagtggtaatttacctccccaaagtgtagagctctctgaagctgcctctctgatggtcagaatgagttcatttcaagactatatgtccgccgcttgagaagcacctgtgccgctgttcgatatggctcctcaaaggcatctaaaatccagctagctcctgtcgggccagcaacctcaattcctcccccttcccttagaacatcctcgcttggtctgattgctaccagtgtagcacccttaagcagttggcccccaggaagctcaatatgcggagcgtaccatagccgcatactaagtgctggcatgagtgtgcggtgcgagttcccagaagctgacacaggccgcacacgcagctcctgcagctgcctcttgtccatagtgaggacgccctgcccatcagcatccgtcaggtccaagctctcgagtgttgagtgatctgcgatgattggctgcagcaagtaatgccgtgccgaagcagcgatgagtgagctgatcgtccagacaacacggagcttaagccctccattcgtatagagtgactctgggatgttccctaattcatcgggctctctgctggaatcgggagaggcagccgagctgtctgcagcagttgggggcggcgcggccggtggtgggggtggcttcgacgttacagatgacgcgccgagtatgacacagctgccgagggtggaaccaaagtcagccttccacttgaggagcacgccgtcctcgatgccgagctcgccggtgggcagctcgatgtggaggcggcgcagctccttgaaggagcggaggacctcagacggcgaatggtgggagacgtccgcggcggcaggagccggtgcggcgggcggggcagcggagcgacgggagacggtcgccgcggccggggagaggatctgcccgagtgcctggatgggcctgacgatgccgccgagcaccaggcgcgcgagatgcgcgagcgcgccgcgcccccgcgcggcgggaggtcccccctccgccgccgcagcggcctgcgcggagcccgccgacgaggggggcgggtcgtcggatatgacgcagtcgacgcggacgaacaccgagtcgacgagggggacgagcgcgtggaaccgccgcgagacgagcgcgcatcgccccagcgccttcacgtcgccgatgcggccgaacacgtcgaggagcacctcgtcgggcagccgctcgaactggtcccccaacccctcctcctccccaccctcgtgcccttccatcctaaacaccggcaacagcagcagcggcggcggcagctcgcagatcgggatccggaggcttcggcgctgggcttggggggggggggggggggcgtggcgagtgtgtgagcctgagccagtcgcgagagagctggagaggggaatttttttggtggaatcgagcgagggtgaggaggagttagccacgcacgcacaccacacgcacggcacaccaccggcccaccgcacggcacggcggctgagcgtgaggcgaggtgggggtttggctttggctcgtgtggtgtggtgtggtgggcgtgggcgacgtgtccgcctcacccgctgtgggctcacggccttttttcccccccggtgcgcgcgtactacgggagcacggcacacggtgacacagggcaccgcgtctcgtgggacgatgcgaggtttccaccgggaggaaagatctactagtggctacgtcacgtcgccttcggccgaaaattccgacggcaactgctccgtccgtccgacccaccgcgaccaattggggttgggtgttggatccgtagccggtgttccgtcgtgggctgtgcgcgcttcacatcgtcgacgtcgagccgcgcgaggggagcaagcaacgggtgatctcgcttctgtcgctcgctgtgtgtgttgttttgtggtggcgtgcaaggaagtacaactcgcggcaaacctgataaagcgatggagaccggactggacggggtgtggtcggtagatccccacggagccgtctgatctccacaccgacggggcggatgtacctctctctctgtgagaaaacaatttgtctgatgcatctcatcctcaggtgcttggactttcttcgcctggattggtgggaggagggattcttactcttaacagcgaagacctgattaaattaatccatgttgttgtcggaaggaaccatcagcttaatcatcggaagcgactagtggccagcttgcgagcatctccacagttgacgctgcagctcatcgctcgagtcgacctggcaacgtgctgccgatctctgcatccgtgcaaagccgattcatgcgagggaacagccgtcaaaaatgcttaccgctgcggggtaccggattaggcatgatttgggcgcacgagatgtgtaatcatgcgtaaatgtaatcgatggaggcttcggcgtcaagcgacctatagtaaaatggagtggatcttctttcttttcccttgtttttttttcttttttggcttcaggggtcaatcgtgtgcgtcagctcgagtgtgattggagcatgcgtccagagaatgaatgaatgagtgaatacttgattagatttgcctttggctgtgttgtgtcatctgtgtgacgcaacgcaatggcgaccacgccagataacttcccggacttatcacacacgtctctagtaccctactacagtatttctcaattttgcgaaagaaaaaaggtagaataggtgccagctttaattttgccaaacaaaaaggtagcaccttccaagcctctagcttatttctcaattttgccaaccaaaaaggtagaacaacttctcaattttgccaaagaaaaaggttggccaatttctcaattttgccaatgaaaaaggtagaacaggtggtagcttcttagtttggccaccgtgctacgtgagcagctattgtgccggtcctcatttgtaattgtaccttgggttggatctctcagccgggaagaacaaaattggctcaggtattctgctgcttcagtgtgaagtgaagtggcacgtcaacatgacacacaccacctcactggggtcatgtatgtaacacaggaaaactgctgcttaggcaattcccaaattttccaggcttaacatactcaaacgtgaattgtgaaacccagagctgtggcagaatttgaacatctaggccctacatgacaactcaaaatgcccaaatcgacattgctataagtaaagagcaagagagtagaatacagcttggaattgaggtaagaaatttgcggggaaatagcctaaaaaaataaactgattttcaacaatatgatgtgtacaggagtaggcaaatttccccatagcttcatattcattccaagtatcaaagctcaaagtgaccgaagtagcgggcttgctttttctttatatatttggatattgtagacacatcaccttgaataattgtctggccatcttccatataaatagcaccatcagcatatctgagttcttccagtcgatgggtcacccacaatgctgaaacctccccaccagcacctacagatttccttaccgccttgataacacccatctacaatttgatgaaagaaagagtagaacgctcattttagtcacagtgtcattaccagagcggagtaatacatgctactaaagagtacatattagaaacagaaaaatatgaatcgagatttcaacaaggggtaaagttgtgtttagccatagcttttgaggtatgatggccactcaacaaatgtgaataaagaaaagaaaattgcatttgtagaagcaaagctacacaattgtttagttgtttaaataataaatcgatctggggtttttcagtgatgtggttaatcattgttctcctcagcataatatttagttacctcgtgatcaattactacctctgttttttaatatatgacgttgttgactttttgacaagcgtttgatcattagttttattgaaaatttttgtgcaaatatataacaaattaagtcattcttaaagaacatttgacgataaatcaagtcataataaaatataattacataattttttgaataagatgaatgttcaaacgtttctcaaaaaatcaacaacgtcgtatattaaaaagtggagggagtatttgagtacaactgattagaaacaagaacatgcattatatttatacctggtcgtattcatccaagaatgtggtcagctcatccagtagtagtactttggatgcttcagctaaagcaccggcaattgcaactctctgcttctgcccgccactcagagtttggattggcctctgtgttggatgaaggatgtttgtgaaccttgtgcagacaatagattataatccaaaaggagcatgtcagctgcctacttgagagtagcttaacattcccacagcatccagtgattgtgatactcttgacctaacctcatccaacgaaaggttgagcttaccaagaccaaatgcaacatctgattccactgtcggcatcacaacctgcattcaaagaacgtaacttaatatgtaccagaaagcttgatctaatttgacatgaatgtgtcattaagcaatcttcctccaatgcatcaagagtcaaaaaaataacattctatagttgctagtaatatgatgcaaatacagtctagcaatatcttaatgaacatttatatgttcaaatttagttcaggggaaactcagcaaacagcacaactgtatagttttcaaaggaactaaaatatcaacaccttatgtatccaattagctataaaattcttagtccaaagagtttactaagttctgagttaggaattactttcacacccaagtttgtgaatgaagattaatgaggaacacagaactagattcattaagacaatcatgtagcacaaaatttcttgcttggtgaaactaaatctattatgggcaacagttaagagtgaactcatcagattacagtacaatttacgaattagtatgtctatgtatgtcgtttcttttcaaagacttatataatgttgtcgaacttagtaggatagttaactaagctctcaaatactccctccatcccaatataagtgcaacctagtacagatgtgacatatcctagtacaaatgtctgtccagatttgtagtcgtgggatatatcacatttgtactaggttacacttatattgggatggagggagtatgagtattaccttaaaatacataaagctggatgagttatattggtcggtgaagtaaagcctaaatattgcagaagtacttataaagaaaaactggaccttggtactttaaccgatgaatagttattcaacagggttactaagactatggccaacatgcttatacagtccaaaacgaatatgcaagcaaggaacattggaaccgagacacttcaatttgctgcagagtatcaataaataccagatagaaaagaacaaagattttcatgaattccattttctaactagcataatacacgttatgtgaatgcaattttaacattgttgtattccatttgagaacggagtgaaatttcagataaacactaaagcagaatataagtgacaacctggtgatcgggattttggaagacatagctgcatggcctgttaatatacactgtaccagaagaaggatttaaaaatcctgccaaaacctagagaaaacattcggttaacatcccattaaggagctgtactaagaaattcagaccaattttgatagtccggtagcctaattaggcaagtaaatattgtacagcattataataaaatttatagaacttctcctctgtcttttttactttctcatccagtcatcctatatcattctattctgggtgagcatatcacaaaaagttgctaatctgattgtgccatctggtccattcatccaaatagtcaaatgtgcttgatgctccactcctgagattctatacaatgctcactcactggttagcccaagatacatactagtggttctcgaattaaaacatccatcggctcctgacggtatacgaaaatttcctggagcaagatatcaaagaatgtggtccatgggcacaatctaatactacaactaaacttttgcctactccatgagcaaaaacgctcagggcacgaacaaaatacacatgaaaagcacaaggacgacgccctcttcagttcaggggggtaaagaagatgaagaaccttgagaagggtggacttgccgcagccgttggggccgaggagcatccagagctgacccggagggacgcggagggagcagtccttgagcaccggcagcacccgcccccgccgagtcgtcaccgacaactcgacgccctggccctcgatggccggcgtgggtagggacgacgcgaggacacggaggcggtggcgagggcgggatacgagggcggctcggccggggtcgtgggggcagcggcagatggcggaggtgccgccggcgaaggcgtgcgccatctctgcgagagaagtgagagcggtagatggaggcttgtggccttgggggcccggttctccagaagaccagaaggctataaggccagatgcccacaagtccattggttgatgggccgatttggggctttgggggcacagagtgcggataccatcctgtgctcct

SEQ ID NO: 40090 - DNA, 3444 bp, Oryza sativa
aggtggtatcagagctttcgttgctcggtgaatttttatcttcctaaccagaaaatagccatacaaaaaaatcgtatcatttacctagccatattgtgccattgcattgttcttttcagtttttgctttgttgaattttgtgttgcattgtcacatcgtgttgctggtcttagcgtctagtttgtttagagtttcaagttctggtcacgttttgtaccacaatcgtcgctgccaccgtgtctctgttgttgtcgggacctacgaaaacggaatcggcccgctgccacggttttgtttttgtagttttcagaattttttatcggtcagttttggagttgcctttaggatttgcttgagtttctggtttgcccgtgaatagatcggcctgcgcttgttgccggtgtagagaggaggaagaagaatttccaaatctgtttttggaagtatgagagtttaatctggaaagaaatagtagatcagattgattgaaatcagtttccctttttctctcaccataaccggactcctaggtagtgccgcatccttcctttcctcacccaccaccaccccgggtccgcgaccaggccgagtccgagtgtctcctctcggtcacggtttcaatctataccgtgatcttgcatactgcttggtgaaaatttttcgagtatcggattgaaaatccttttgcaaaaacggaacctacaggacgagaggattccattattgtatagttctaattttgggttttaacttttacatttgagtccctataaattttgtatttatgtttgagtccctgtaatcttacattgaggtccttgaatctgtttttgtaaaataaaatcaaaaaaaaagaaagaaaaaaaaaaggcagaaaggtgcataaaaaaagaagaaaagaaaagccgcacccaaaaaaaaaagaaaaggaaacaaaaaacaagaaagaagaaagaaagaaaagagaaaatattgttatgtttgagctgaacttcatatatcagagttgggcatgagttgttcctagtgctatcttgtggtatcatttgtgtctaggctcgcgtctctagtacgttctagcctaggaccagcacggtgcttgactttgaacaattattcaattttgcattctctgatttgagcatttgctattcctttgctacatatttaagcctacccagagctccacagatttgattgcagccgtacaacaagtgttcgccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctagtagttaataggaacgcgcatatttttgtgtatgtttcttgttttctactaacaatggcagggatacgcaagataattggggatagctgtgctcaccatcgacatcttcgtcgagacatgaggagtgatcaacatgacctttatgaggtaagtgacgatgttctaggtaagatcaaatctgcactgccttatttcgagggaaactataatcctcatgcttacattaattgggagctagcggttgatagtgaatttcaaaagcatgtcttgtctgagaaacaaaaggttatgtgtgcctctagtgttttagttaaacatgcttctaatgattggaaacatctttgtaggcataacaaaataccacaatcttggaaagacctgaaatgatattttagagatgtttatgttcccatgtattatgctgatattctgctcaacaaactgcaatgtttaaaacaagataccaaaagtgttacttcatattatcatgatatgcatgcttgtttattacgttgtggcttagatgaatgtgaagaagctacagaattgaggtttttatgtggacttaacaaagaaattcaggacatgcttgcttgtgaaaagtatagatctctttctcatttgttacaatttgcttgcaatgctgaaagtaaaatagaggaggatatgaaaaagaaacacgctatgtctttgcctccaattactaactatttgtaggaagtgcgtaatcacgaaaaggaggagagagacatgaaagagccaccaattccattgttcacactcaagtttgagacacctccatcatctaaagaggacatccaaggtaaagtaaatggtactgaaattaatcaaggtgagtgcattattaacgaagtaaatttgttcacttttcatgcaaaagtagagcaaccgttagtggaaccaaatgctggaattcctttgtcacaagttgatttactcgctgttccttgtgataaagaagagttgtgtgataatgcttcacttatatccatgccacaactagtgaatgagcatgctattcctagtgtttctttgtgtgctgattttaagcatgctgttcacattgctaatgaagttgaggaacgtaaattgctatcttctttaaatactttgggctatgttcagtttgatgatttttgtgagctcgataatttgaaggagaaattatttgctaagtctgatttgccacgtccaactaatgctatttttcatatctttggcaaatataatgatagaggaatatatttggtgcatagagttttcatttgttcggatttagagaaacatgttattgctaatcacactacttcgagtttctctagttttgattggatgaaacaggttattttgaatggactatgtgaagaacaccatatggaaaaaccgaggacggttttccgtgaagaaggggaggatgatgtgaccatgactactacggatacatccgttgctcacctcatggatggacaacaagatatcaagttcgagtcctccaagtgccaaaatccaattcggccacctgctacactgctaacttcaaacggccgccgaaactccatacgacctccgttttcggcccgtgagtacttgatggaaagctctcggagtcctctttccaatgcatcaagcctcattgccaaattccatctcagtcggcagcaactgaagaaacaaggtgctgcgacacctgtaatgggactatgggcttgtaacttcatttgggaccccggcccaggtggggcccatgtggggtgcaccccaagctagtggagcacgaccctaggcactcctaggtcgtcctcccacccctatatatagctagttaccccttcagggtttctagggttttgttagattaaagtttagccattgctacttgcttgcagcgcgcgtgtcggctaaaccgtccgtctgcttgttcttcggaaccccaacttatcatttgtattgaattcctatttgcaatatcagaatacttttatcttgttcttgcttggttcttcgatttgcttggaagaataagggtgatctgccccggcaagatcaacaacccacggagagg

SEQ ID NO: 40091 - DNA, 2385 bp, Oryza sativa
aactccactccagactcaactcctggagcaatatttaggagttagagctgtaccaaacaggcccttagtttacagttgtgccacttatatgtgggctccactttgttatgatccacatctcagtagtacaactacaaactgtacaaagttagaggagtcttttctctagtttgtgtatttgcggttcctcttacaagaaaaacacagccacagagaccatgtggtacattttccattcacaaaaaagaaagagaataaaccataaaaaaagaacgggctttttattacctgaaacaaatatgtgaaagatttccaatcatgtaatctctccgtctcaaaatataacaacttttagctcttatgatttgatgtgaccatggctactacggatacatccgttgctcacctcatggatggacaacaagatatcaagttcgagtcctccaagtctcaaaatccaattcggccacctactaccctgctgacttcaaacggccgccgaagctccatacgacctccgttttcggcccgtgagtacttgatggaaagctctcggagtcctctttccaatgcatcaagcctcattgccaaattccatctcagtcggcagcaactgaagaaacaaggtgctgcgacacctgtaatgggactatgggcttgtaacttcatttgggaccccggcccaggtggggcccatgtggggtgcgccccaagctggtggagcacgaccctaggcacccctaggtcatcctcccacccctatatatagctagttaccccttcagggtttctggggttttgttagaataaagtttagccattgctacttgcttgcagcgcgcgtgtcggctagaccgtccgtctgcttgttcttcggaaccccaacttatcatttgtattgaattcctatttgcaatatcagattacttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagtcttgagtgtcgagaggaactcagggttcatcatgatttgtcctaaaatataacaacttctctaccaacattctctttccaaccaatcacaacccttaaccgttcacttttcacacatatcttcactactcatccaatcataactttccaccattcacctctacctactttcttaataaccgtacccaactctataacttcttatattctggaacggagggagtataagaagaatgtaagatgttactctctcgattctaaaatatagtaacgtagaacaatggttttattcataatactattatatatctaatctaatcttaaattactatatatttgggactgagggggtattacatttttatggctcttatatcacctagtaaaactaaaatgagcggataacaataaggtaagtatagtttaactgattaggttttttttttttaaatctgtttaccctagttcaagttttaaacttgatatgagtgttcatatatatttatgtctaattaaattatcctgtttcggaggtgattaactagaacccgtgtagagcacattatttttcctataaaaagggaacagaatagtatcaggtacatttttgctagagcgatgttcaaaatttccaacgtttatgttgaaagtgcacgttcgtcgaaagtgcgaaattgtcatttgcaaaccgcaaaattcttcgacacggtgcaaagaagtccatatggcttacataagattatgtgacgacgccgttttgcaagtatagatcatatcgcacgcttgcttaagtcaatgtacatccttccattttgatgaagagagacgatgcattaacagttccaaatatagttcagttagttatcccctcagctgagaagcaaaggtcaactctttcctaattaaaagatcttctctcgatcggttctcgccattcatcccagatcggagattccgtggctatcatcccactgtaccactggctgcttattaatcggcaagagaggctcgcagcggctcaatgcacctggtccacccagcctagccacaaccggtccaatccaaactctctaaacacaggagtagcggcgtgtacatgcgccaactgcccacgcggccgctgtcaagttgttggccgccaactcttcgcctcgctcccgtgtgtagtacggtaaacggtgtactaccacttgccctgacgtacgtactacacgcgccccggtgagccggtccaatatatacacgtcgtactcccgagag

SEQ ID NO: 40092 - DNA, 20214 bp, Oryza sativa
cgcgctcatgtcgttcaacggcggggtgttcctcgtggccgttgccggccacgccgcggggttcctggcgttccgcgccggcctgtgcggcggccccgcgcaggtggaggaggaccgcaagaacgacccggcctgctgctagtagccgcctcgtcgacgttggtgtgtactgtgagcgatcgattcggttcggtggacgttggtttgatgcttgcatgtgtttgtgtaattgtgtatattgttcgcggtcggttggatgagttgtttggctggttttctttcgtctgtatcattgtatggctcaaaaacgtgacatgaaaaaggctcctgatggtccatctctcaagttgaaatctgaaaagttccggtgccgtgaaactgtaatcgtgcaatccgctatctatcacttgtttcattgatgattcaccctggctgtaatttcaattctaataaattgattatggtgcgcttatgtaaatgtccttgtctttaaaaagaaatgtaaatgtccttcaaacaattcttgttttgttttgcatctgtatgtgctagttggcacaaaactgttctgcattggtttgtttctaccttcctcttttgtgttgctgacccaaaattgctcctctgcatgcaccggagttcatgttgctgaatttctcatgccactgtattgtccattttttgctggtaaaaagcactgaactactgactggattggcaattccatgaatgatgattagctctaccgaaacagtatgctaccctgaaagtactgtcttactgcctctataagtttgctttgctccatcgatttgacgctctatgggttatccttcacgttctcccatcttctttcctgctgcaccatgggccaccgccagtggtaaattctctgagacgcaaaacagagcgcatatgcagcaaacatttcaaaaggttaccggtagatagattggtactccatccaaaagacagcacccttagtgctttaagtctttttgtttgctccgctcgcgtcaccacttttagtagtacaagaacacactttacttcctatgtagtactaccatctcctttttctccttttgaagatcttcatgtttctatggctgctgttgaaaagcacaggtgttcttccacatgtggaagaacaaaaatctctcaaagttgagctgctaaaaaaaaattaaatcaaaatatatcaaaccggagtctgtacaatactattacatactcgagtccagttgattcttaagctgcgtcagagattggctgtcaacctgctgctgtttaatttgttacattatccaccgctatattttagagataatgcactgctaaacaacccaaataatggttttttatgcacccaactgaacaaaagttaatcaatttcaccacataattgtactactaaatcgggctgaacacttcgcggaggggcaattataattggtcagttgtgtgtggttcagacttaaaatctggccacttgtaaattctacaatttcgtcttgacagtggaagcctccgaaggaaacctttttccgcccatgccgtacgatggattttcctcgttgacattctgcgcccaacgcacagcatggcatgtcgttctccataaacgtacacacaaaaaaaagcaccaaattggcttcaagataaggtcgtggaagcgtgctacgggggatgatttgtctggtggaatctaaggcctccataaatgatctgttaccagaatacctgccgtacataggatgattagagcaggtacaatagtagcctataagtcagctataaacatattttaaagtgataaagaaaaagagagaagagcagcgggctacatatctgtagccagctgcagcacgggctccaagatgtaatgcgtgtataacaggtgggaccaagtattaatagtatagtaagcaactattgtatgaattagctattatattggctatagatgatttagagctattagtgggctgctatattgaccttgctcttattccttcattcaattgatccatccataagaccatgattattatccatctcaagagggaaaatggccagtaagctgtaagcccaatcaagtccaagcccgatcatctgttgggcctaatttgatctcacttttttttttcatctctaatggtcctgtgacaatagccagattctgcaactcatgaaaacctcgaattgcgaggtcctcgatttgcgcacctgttcagttatactaatccatacttataaaggaaatcatttaggacaatgtttaagtcaaaccttagaaatataaatcatgaataactctcaaattgttgagtttgaaaatataaaaattatatatatagatttatcttgaaaaatactttcataaaagtttacatatagcacttttcaataaatatttttatagaaataagaagtcaaagttgtattttgtagaccgtgtcactgtcctaaacgacttccattacgaacatagagagagtactacgtaccagtacgtacctgtactacacgctcgccgccgcatatatctatacttgcacggcgtgtggatgacggatcaaaccaaacacacccgtgcacgcggagatcaggagcatctgcaatggcggacatgggaaggcacggcatggccatggccatggcgcctgcggcggctggcggcgcgggcaggaggaagcggtacatgcacatgacgttttactggggcaagaactcggagatcctcttcaccgggtggccgggcgccagcggcggcatgtacgcgctggcgctcgccgccgtcttcgctctggccgtgctcctcgagttcctcggctccccccgcgtgcaggagtcctcctccctcggcagcaggcggcggcgcgcgacggcggcggcggtgcacgcggtgcgcgtcgggctggcgtacctgctcatgctcgcgctcatgtcgttcaacgtcggcgtgctcctcgcggccgtcgccgggcacgcggcggggttcttggcgttcagggcgggcctgtgcggcggcgggtacaagaagggagagctcgcgcctgcggcgtgctgctagatgtggttgccatggcgcaagacaaaagcgaatatatttgttttcgaaaatttagataaggattttgagtgcggatctgctcttgaatctacgctaaaatctatatttgttatcctcacaatggaaaagaaaattcaatgttagggtagggatgtactcgatcacgtcgatcgtgaactgatagcccccgttgttggattcggtgtttgcatgtgtaccttcgatcctatttgaagaatccataaccctaactgttaaacccccaagcagtgcttctttcatatttcccattatctgcagaattaaaccacagtggtagcccaagaggccgagaggcccgagaaggcaaataagtggaggcccgtaataagtcgaatttctgatatgttgtcccgacgaactcatgacgacatgaaagctaactactggagtaattagttgcattgctgcaaggtactttggttagccaggcccacaatctgagtcacatgtcaccttcttttagctctttattaatacttttcatgcatttgtgtttgtacttttctttataatgaaatatataccggtcttagtttcaaagaaactatagctaattgttaatttgttatagaatttgtaagacgaatgacttcgcttgataaaatcgtagcttaactaaaaaaattacttattagaataccaccttaaagacataggttatctctatttatagatggtaagatctgcataaccattgttttcccaaacggtttactcaaaccaggaacataatctatgaaatcaatgatcgattattgtgtcgactgaatacctctaagaaggtcacaacaactacgatattgctatcgccattctaagcatctaaaactatatttttttactcggacagttcaccccaaggcattaaggtaacggagaggatgttagcaacattgcccatagacattgtcaatgttggtgctcccaatattgacggccttggtcccatatctacgacgatctgaactcaacctcctcccctacgtttagtggcatcatcaactttcctaagcacaatgacggcgatgatggtcgaacctgaattggaggggctagtgatgacgtgcatgggcaaatgttgtccagatccatatggtgccagtggcaaaggagacctgcagtggtagagatgatcacctagatgatgttggaagcctgacaggcaactcaggcgcaaaggagtcgcaacctcccccatctcctccctgccttcaacgcgctagacaaaaaggggtcgtgttgccttcggatcatcgatggccttatatatgtacatgtatttgtatgaattagaacttaaattttttaaaaccggtttacaattatcattatgttgaatgttgatccctttgtattttatatgttttaaacttttcggttttctcataattttggttcgtcatgataggaacatggcttttatatttattttaagctggtaccaagcatatgcaaaaccgtttgggtcacctaataccaatctccaacggtttcgttgataaatgttcatttggtactgcccaaaaccggtataattcagataagattttactgaaaatttggattttggtttgatgacatttaaacttggtttgtttatcgagcggttcttgaatctcgatttaagtcgagtactcgcgataactgagtaattacagcctcaaggctcacaggctcacagtcctcaccgtactagcactagtagatataagtttctcatatatctattatctatctatctatctatctatttctatctatctatctattatatactaaaagtccattaaacttcctacaaatactctcaagctgccacgtggcactactataaacgatcctagaccgccatgtggcaatgtctaatctcgccgtcgattccattagattagattagatgtattttatttaaaaagaaactaataccttactgttggcagggaaaaaaacataaatactccataagtacgtacgtactatatagaaaacaataaaacttaacttctcttcatcggttcgcttggaaaagagcggcttacttacgaatctacgatttgtgagggaggaaaaaaaacgtaccagcgtatttacgataaaataaataaagccaaaaaccacgtgacactgctacaaacgttcctagaccgccatgtggcaatatctaatctcgccgtcgattttcacttaaattggtggacccgataatttagaccattagattagattagatgtattttatttaaaaagaaactaatagcttactgttggcagggaaaaaacataaatactccatgagtacgtacgtactatgtagaaaacaataaagcttaacttctcttcatcggttcgcttggaaaagagcggcttacttacgaatctacgattcgtgagggaggaaaaaaacgtaccagcgtatttacgataaaaaaaataaagccaaaaaatatacgtatatagtaccatcgaaaaaatcaaaaatagaattttctacatataaaaataaaatatattattccacaaatatgcatcaactagacccgtcataaaaaatataaaatatcaaatctaaccgtcgattttcacttaaattggtggctcctataccgtcacatgccactctaataaatttataattctaaaataaatttaacaatcagttttcttttaatctggtggacccattattttttaccatttaatttataataaaaatagccaagccaatttatctcaaaaggcccacataacccacataggtgcatgtaagtacgtacgtacttcatgcatggtcccacgtccatcttatctcttttcttttctttttcgctcacaacaataaaaaccaaattaattattccaactcatagatattaactccagcctatatatatgcaaaaatatatgtacgtaccagtaatatattatattttttatatattatagatattatttagtacgttgggccacacatccctttttttcttttttcttttagactcacatgacataaaacccaaattaatattagtaattatatataaaagtctaatagactttctacaaacgctcctaaactgtcatggggcatcttcaaatgctcctaagccatcacgtggcactctaataaattaaaaaaaaatataaatcctgagaaaagaacatctaacatccactttcacttaaattgataggctaattattttaaccatcagatttaatctcatataaacaaagagatggaaagaaagaccacgtaccttccccacctctctcctcagtcgttacgttcgccctctccccacgtatgcccctctctctctccctcccctctatgtataattcatttttcctgtattagctaacggggggaatttgattaaaaattttttaacattcgtaacacctaaatcatatacctaaaaaataaacatctaaccttaaattttttttattaaaattagtggacataacacttcaagccattagattagatttaatttttctcatccttaaaaaaaagacgtccatcctcccctccgttttcttttaggaaatcctctacgtttttttccttccattctctctctatgaaagattttgcaacaataaattttaaataagtatacttctaaatacatattatttgcaacagtaaattttaaataatactaactttttaactttaaaattatacgttcaatttttgatctatttgtaccattgtgttatttatgattaaaatcacaattagaatttaagacacatgttgactatattttaacttgtaaaattatattcatttaagttttgttgagaccctttacatgttattcaaacatatatgaacaattattaaaagaaagtgacattatatattatttcatcatatatcacttcactggcatgcataactaaaacagatttatgaacttcaaaaagttctaaaaattctgaattatgagaaaaacaaaatatagattataccataatttgatgcatcacaaaacatgcataactaaataagatttacttaaaaaataatcagtcagatcctagctgtttgtccacctatatacattccgagcttaagatagaaatgacctattatgtaccaaattctacttgataaggaaatagaaattatatggaagtaaacataaagctaaattttctttctgtataacatgataatataacggtaatgttcaacttcggaacaagcaagcaaaagctgcatgtgtatttgtcctgtgtatctatatattatatatgaaaaatccattaaacttcctagaaaactctcaagccaccacgtgagactcctaccaatgctcctaagctgccacgtggcactataataaattagataaaaccttacaaattttgagaaaaaagaaaaaaaaatccaaccctcgattttcatttaattcggcagacccactatttttaaatcattagattagatttatttaaaatgcatctcattctcacatgtacaatacgtactactatccaccggattgagaaaaaaaatctcccgagcatgtacatactacgcatcgtccacccgtccctaataaacttatcaataactaataaacttatcaataatgttggattatttcttgagaaacaaagtgcgctcacaacgcacgcacactcacccctacgaacgcacacatgcacactctaccccctatgagtacctctgagagattgtgccgacatattttgagatgacaaagtcaccatgattgtctcgctgtcgatgggtacgttgtctaccactgaaagaatttatcaagtctgggatttgaagacaagtgggcaatttccaccacaaggaacctaaccagttaagctatgttcaattcaaaataatgttggatattaaaacaaccatgatttttaagctacacttttagaatactcctatgccttttaaaccagtgaaactattatttttaatcattagatctatcttatataagaaaaacaagcgtgtattcatggtacatcacatttcaaaaatattattgtgcaattgtattcacgttagattgcgtagaacctcttacccactctacatgaaatgtttatagatggattgtctctcaaactatatcaattatattaggctatataaaatttagtggagctttatgtcccaccaaattcatcctctaataaaccaggataatatatgtgcaataaaaaaaataaaaacacacttcttttgctttacacttacttttactttcgttgaaatattttcaaaagaaaataagtctaccttcttttcaaatgatgaagaagattataaataactaatattacttaaatatgatataatataaaactaataggttaaaaattataaaagtaactaatgctaacaaaaacaatttacggagaaattggggtagatgttctccggttaatatatcgcttttagtgtctcaaacttagcgtaagacgcatgcccatgcatttgcgcgggctaccttcctagttatctataaaaaaaaaggtagagaagtttctagcaagaatcctaatgctaaatcaaaatgagagaagaaatgaaacaagcatgacactactagtttataattaggtatactgacgtagtgacagagtaattctgatcaatgcgcatgcagatcacatacacaataccagttgcttatgatctattatttatatataaaaaaaacatatcaacggtttacgtaatgcgaagtcgagaacacgtttcttctggaccacgacttggagccactttgttcctcaggtaaactcagtgtccacgtgaaagtattgacaagttgtcaagcaggaacaaaagctgcagcgtacatacgagaacaacgaaccatttccccacttttcactatctccaagcgcatcagtcccgccggcccttttcgataaagttcaagtcgttttccatcgcattttgcacccatgaatgcgttaacccaacgaaaatatggctcgtggccgtacgtgagcgcatgacctgcgtgcgcacgcatgtcactgcccgatcgatcagtcacacactcacacggtcacaccgcgcgcggccccgggccacccgcgttgccatcgaccccgccgacctgcctgcgtgcggtctacctcgagggcgcgacgccaccccacccatccgtccgtctcgcttgccacgacgcgacgcgacacaacgatctaccgatgctgccggttgcctctcgctcggacgcgcgggcggagcggcgcgttggccatatatacaccgcgattggccgggcggggggtcaccaacccacccattctcctgtacacatgcggtgcgcggcagcgaccgattaagcaggaaaagcggggtaccgcacgcgcgagcggcgcgacacaataattgagccgtgccgtggcgcgcgctggcgctggcgccgctgtgtctgtcgctggtgtgatgtgagcggtgggtgctcgtggcctcgtggggtttatccgggtccgcgcgctacaaaagctgtagcggagattgtgatgtagtacgatctacttcagtactatcacaaaaacattatcgccatgtgttagctcaaaaaagggagatcagaccgtatcatcttgtcgagagcatatgtggaaagacagagtgtacatgcatagaagatgcgaaattcgtgttttttaaacgtgggtagacgatcgatttggtcagtgcagggatttcaggcgaataatggagtgtccaagctggtcgtgcatcgtatcgactgacgtgaaaaaaaaggggtgcagaaaaaagaaattcgcgtgcacatttgcatgtgtgtataaactaatgaaagtgtgttccatatggttagtatatttgctgtattttagtgtattataggttcatcaatctgctataatggtcgttttttatgccaagattctccgcaatgcgctcccatgcatgcctgatttcagcgctacagtcgacaatgctctctgccattgtttttctttttgttgggatatggtcattgctattaaggagtaataacgtatttgttcgtcgcaacgtggctcacgaaattgagacatcatacgtgcagtctgcatcgtgcatttttcctaccgtgggatccatttggacctgctcgagcaatctctgccacgaaaaatattctctgtcggaaaaaatccatgtcatcctaaactttgaagagaagtttgtttagtatcttaaactgtaaaactaggtatatatgaccctttaaaccttacaatattaataatattgttcatatagccagacggtattattttgttttctaagtgtcatagatgttgtaaaatttttactatatgacttgcacattggacatatatgttaacaatttaaagggttatgtagatggtgtattgcataatatgtagggttgtctagtttgaaggtttggggtgatggatagactttcattcgagaaaagcacagggcacgtgcggaacttttccttcttcattccacaacttgcaggctgcagctcgcaaagggtgactggcttcagttcactgccacacaatgttttctaccatgttgacttcaacggaagccttatattcttgtgctctcagcaaagctgttgaggtggatcaccaaagtggccggtgaacacaaagtccaagctagtattgaaaatgaactgtgcccagattccagaatagaaaaacgaagcagggatgcataatctgatgaacaagaaagctcgaagaatccatcaaaccctcaatgaacatcccggtcgcgcaccatcgctccattttttgctttgcctctggggctgtggaatcacaggcataggtagttttcagaaatcaagacatctgtctccgtcgtctcctgcgccgatgtaacgatgatgcaaccctctgggtagaaacggctcaagcgatctgataggattgtcgctatagcttggaaatcccgccctttaaattccgataatatgtaatggcacgccgcttgctgtgcccgatcctctatgtatgaacctttaatttgctcactttcaatggaaaatttaggtggagaatctctctcctccggtgattactccaaaaaaaaaaaaaaggcttcaagaatccacacattcatctgccattctggcgattgctatgtatacaaactaaaaacttcgaaataagttgcataacacgtattgcacattgccgttttctccggagcaaaggcgtacacaccaacacgcacaaacaaaacaaaagaggaaaattgcgatcagcaagaacgcagcgctatacacaaaaagaccaagaagcgcacggttcgttccatcaccaaatcatggcgcggttggtttcctctccggcgttgccgtcggcctcgtcgccggcgatctgatcgagcacgaggacgatcgccatggcgaacgccgcgtcgaacccggcgcccacccgcaggacgaacacgtccctgcccatgaccacccgcgccccctcgtccaccttcctcctgatctctgccaccaccgccgcctccccgcctgactcggccttgggcgccaccacgcggcagcaccgccgcgggaaggagccatcgacgcggaggagctcggcggcagcagcgtgggtagacgagaaggaggcggggagcggggcgaggagctcgacgacagcgccggccgcggcgccgccgaggatggaggagcggcgagcagagaagagaggcttctggccgtcggcgcgggcgccgaggtagccctcccagcgttggtgcagggacgggcggcggcggcgcacggtgatgagcgcctctccggcggggccgaggagcgcgagctcgccggcggaggcggctccccctccgtggccgcggccgtaggtgtcggcgcggaaggcgaggccgccggtgcggtggtcgtaggccgcgaagccgtcgccgggggagaagtgggaggtcttgcgcaccgtgagcacccgctcctccgcggagcagtactcctcgcccacgatcgccattgccgctgcgctagctagctgcttgcttgcttgcttgcgttgctctggctcgctcgcgtcgcgtgcttgtctgcgcggcgaggtttgcaggcttaagtagagagatggagtgaggagctcctgtatcgcttgatactgtaaattcgtatggaagccacttacgaaagtagtgtttcacgtgaaaacgtgaaatatccaatatatatatattaattagccctgattactttcacttcgaatgctttccaacagaaaaaaaaaaccggtgttgtctcatgcccatgcatacgtgaatgacgtgtatgcataatgcaggctagtttctccgtgccagctgttggcttggcttgagctttgagcgacgactcgctcgcgcgcttgccaagatatccaactaggcgtggccgtagagtatgggacacagagcacggaacggaacagcggcgaggtacgaggtgcatgccgtgcgtagcgatgcggtacagtgtacgtatgtacgtgcgccctgcggagaccatacccttcctccaccgactcgatcccataccgtcgagtgctcgcgacgaggtcgatcggctgccgctgactttagttttagacgaacggcaaggtcgatcaatacgttaacgggtgcgcgggggtgcatgcatcagcatcattgtgcgcgcgagcttagagatagtatagccaactactggctctaaaccatctatagctaatctaatagcctatttatataatagttagatataaaaatatactataccattaatactcggttccacatctcatatacacataatgtcttgaagtccgtattgcagccggctataaatttgtagcccgctttcttctctttcttctctttttttctcgatatgtggttatagcttactattgtacctgcttttagagcaagtttaatagtatagcccaccgctagctctaattcatttatagcctatctaataggcaattcatacaatagttgcttactatactattaacatatgatcccacctgttatacacacattgtgtcttatagttcgtgttgcagctagctacagatctgtagcccgctgctattttctcttatcttttatcttattaaaatatgtttatagctggttaatagtcttttattgtacctgctatagctccacaccgagtcaactatcaacgacatggacgtgattttatagctagcctggcctggtagaggtaggctcgatcgggtcgcccgtagcgggagtgagtgtgagttgcattgggtatggagtacagtactgtacttgtgcagtgtgtggtggtgcgtatatttaggtgatctagtggatgaagaacgaccgaaattgacgtgagtttttggcttatgtgtatggagattgaacttttgcgcgtcgaaagatgttgataggtggaatcgatgataagacgatgatgcgtatgctttgaacaaactcgatcgttctccttcggtagtagtgtcgcgctcgaattttataagagttccctagccagtttcccatagtactcataattctactctcctacaaaaaggaggtactagaattcaaggcaaaaactgattacacttcatagtaataatccaatccaatccaatatcgatgaaagcataagcatactccgtatatgacacgtgatgaatctcccaacgaagacgtgtactccctccgttttataatgtaagtcattctagcatttctcacattcatattgatgttaatgagaaatactagaatgacttagattgtgaaacggaggaaatgaatctagctagatatctcgctagattcattaacatcaatatgaatgtgagaaatgctagaatgacttaagattgtgaaacggaggaagtataaaagtcgtctcctgcatgaatgtctccagaagtcttctgcatggccaccggatacgtgtatcgtcgatccagatacacagtatggttccctgcttcggtgacactgacgcgcctatatcacgccaaagatctccgttttcaccctcacgcgcggtcccacgtcccaatcggtggctgaatcagcaacacccgatcacgtcacgtcacgtcctcatcaccggccggccgaggcttggctccctcccagccccatatcccaggggtccccatgccccccgcgcaagctcggaaatatcgcggcgaaaagccaccaaactctcggatccgtccgtcctggcgcgggcgtctctctccttcgggcaggttagattcgagctgacgcgagcgcgatacatcccccgcaccgcacgcacgcacgcagctcccccgcaccgcacgcacgcacgcagctcccccgcaccgcacgcacgcacgccctcttcggctacgcgccacgttcccgcgcgagcggtgagcgagacgctgccacgaggatacggctacgcgaagcaggcgtggtgcgatactgcgatcccctagggggcccgatgccgttctagttgcccggacattggggggcagttaggaatttagggcctacaactacaagtaaaacgaaggaaaaatctcgatttcaattgtcaaacgtgcctgtggcagctgattacgtggtggcatggaaagcaacacttatttgaaccttttctcgaactcatctgcaactctgcaaggctgttcctggtcactgtaacctcttctcattgtttcgttcatcaagacatcaacgttcaccagtgagcaaatcctagagacgggcggatctaccagagtagactacagcatggcatatgtacgggccgaagttttggattgtgtgggctgccgggctgggtcgagaggtcgaggtaagccaggagattgccctcttttatatggcccacgctccaagaaatccaggcatccaaccaagcttcagcacggcaggttacggcttaccaaccaatcgacctccatctcctgccgtggattttgttgtttctgcctgcaaagacccagcatgatacggttcattccttctctacaccacgagtatcatcggtgcaattggaaatagtatcatcatcagtgtaattggaaatggaaccgaaaggagtcatattcatctgtaatcttgtacagttctctatacccccaactccccaagtgattgtgttgtaatcatctaatgatggcctttctataaaagttggggatgtgctctcttacaaaaattaccaatagtttccggctccttcaggctaattttgtaaccctatagccatgattataggaaggatgcataaattgttcaagtgcatggttatatcgtaatgcacaactaatggtagagcatccaatcacaggaatattgaaaactcacgctagtaatcctacacatcaagccctccagtgacgatctactccccaggggcttagttaaactaaacagaacgaagaaacccccactaatgcaatatcgtgtgccgcatttgctttattgtagcatagctccaaatcttctgggttttctcaaacaggcaagaaacattcctagtatcgcctccccgatgtgatcttcagcaagatgttattaacatctgaaaagtataaaattggagtcagatcttcacaccacatgatgcaacagtaacgactaagtttatattgagacaactatttgtttaacagaagtgctacttttcttttgtgaaaatacagataaaattccataacagcctaatatagcatatgctgtacaatcaactgcagctttccctatcgataagaaacttgtacaaagcaaaaaaacacacaagattcaacagataatgtgacgaccttactcagactttggctcactgatcagtgtacccacactcttgaaccagcgtatgagattgcggtgatccttcacatacagccaagcttgtaggaaagggaagagtttctcatttataccacgggcctcgatgtaatgatggaatgcatcacgcacattctcatccaattctctgtcaatcaaagagaagataattattcatgatcagtaaaaagcagtacatcaacatccagggctaacatatgtgtttgtactgtatcgtccaggacaagcaccatacacagcggacttagtcttatacatgtaataaacatcaaatgaattattgatacccatccatgagagaaacaaacgaccacaatccaaatagctaagcaaactttcagttattgcaagatagtaaaaggcttttaaagatgtgcttggatcactggacttatattcggggttttaatattacttttagtactttttgtgcattgtgcactgcacaactgagccaaactgtgaggcatgtgcatacatatttaaggcacatgatatcagtaacttaaccaattatgcaacatgtaagattcatattactgggtaaatgtagccactgttacatagatcaaaacattttttggtcatggtacctaagcatctatgacgtatcactagccatttgataagtgttttaaaaggatttgttttatttagctctctcaacatgtaaacatctctgtaaattatggtgatcattatttgtatgcatatatggtaaccggtgtagtgactgagaaaattgatttaactgataggagaaactaaatacccataggagtacagagttttgagcatgctagtacatctgaaattttacatgtttcaaactcaattagcactagtaaggacaacgaaaatattcttcctttatacacattaaacaataggtaatccacagcttgagataaaatatttacgaacaccacctgaaaggctgaaagactactgttatacttcatagaccttaaaagttagtacacatcataaactcccacacctcaagtgaaagtattacagaacataaaacactgggcacctgaactgccaccatccttcatgattaggctaacgcaactatttttacaaaactatggtatgcaacagctaacaaaatatgccctaaagccccattctaaccactaaattagtattaagatcgcacctgctaggcattcactcattctagatcaattgctttctgatcaggttatactagcgccaccagtcagattacccaaagccccaaaaatttactaaaatgcttgcttacaaactgaaccaaacaagtaattcacagaatgagaacgaatttcgctgatttggaagaaaaactcactggaagatacggccctggtacccgtcaccgcccttcccagccaaacccgccgtcccagactcggcagtcttcggccggaggcagacggaatggatccccacggcgtcggggtacagcccgcacaggaactgcagcgacttgctgctccctggcctggagatgtcgacgtggaggaaaagctggctaatcgactcgctcaccccacccccgccgccgtcgtcgtcgtccgagtcgtagtcggcgccggggggcatgatgttggcgagcctggcgacggagattgagatctcctcgccggcatccccgtacccgcggcggagcacggggccggatgcctggtccagggcgcccttgacgatcgtgtagggcttgggcgggctgatcttgggcgggggcgtcatcttggagacctcgaggaagtgctccttgagggagcggaggatgatggagttcacggcggaggaggaggcggccgcggcggcggcggcggcggaggaggagtatggtgaggtggagagggcatggcgaaagaaggtagacgcggcggcgcggcggaacatcgtgagaagggaggagccgaagggtttaggaggaacgggaaacggtatggaagctgaggtttttaggttacccggggtttcagatcagtttttttttcctcttgaacctactctctccccgtccaaaaaaaatcaaactcgcacaagtatctggacatccctcctaggttatttttttctttaacggagatagtacagtataaacaccagatgcagagacaagcacttaccttaaaaacgtatatatacacatcctatccttacaagcatcttaaaagaccacgggcatatttgagattaacaaagtcaccgcgggcagatctctcactgaaacacacacgagagcatccccgaaagattgggtcggcatcgcttgagagttgagattgtcgaagtcaccacggtcccctcgttgaaatgtacatgcgcacaccttaaccttatgaggtgctccggaaaactgggtcgatatattttgagatcgacgaagttatcacaggccccttgctagagcacacacgatcacccccagaagactggaccgatatatgtattgatgaagtcatcatggatcaacattgttgatgggtacgttacctaccgctgaaagaataattagctgtaaatatgatcacacatgtcaagtatagtacttaacccaggtaagttagtcccaccataagaaactaacgagttaagttcgtattttatcatatcagttcattttggtaatatcaattgcagttgttgcacgaaaattagtactacttttgtcacggttaaaatttgcaggttacactacaatgaattcggaaaaatttaactagaacaaatacttcatatgaaaaataggtcaatttctttaaaattcccatgaaattcgtccaaatcgaataggctctaaaattatatagtgcgtttcagacggtgaactcaccacacacaacatgtcatttgttctacatggatttatagccgaccgtatgctttctagagttaacaaatacttcctccgtttcacaatgtaagactttctagcattccccacatttatatagatgttactgaatctaaacatatatacgtttctaggtttattaacgtatatatgaatatgagtaatgctagaaagtcttacaatataaaacggagggaatacaatataaaatgttcgccgattttatttagacggtacgaactagtcaatgtcacactaaaataagattttatgtgtagccattgcctatttacaaattgtaatatcagatagaaacccttcggtgtgttcagcaaatgggttatgacttatgattggtgggattgagaagaaaaatagataaatgtttaggattaaatgtgttgtaaagaatagatgactaagatacagtaatattacctttagagtgtctgatattattctcctgtcctatttaccaaacaatccctttgagtgtggttttcagtaaccctacctttttttggttaaagaaaaaaaaatgaaaactaaggctgtgtttttaactggatccaaagtttggattttgattgaaattgaagatgatgtgactgaaaagttgtgtatgtatgacaagttgatgtgatggaaaaggactgaagtttggattcaaattttggatctagacacagcctaagtagtaggagaaacgtggttggtcacgatgtgcatacgcctccggccttccacatccttccagaaacgagccggccggattgctctccaagccaaacacggcccagagaggcgagagcccccacaccgccaaacccgacccggaaatcaactgcacacgctccgatcccctctctccagatcgattcggaccccatgggttggcgttggcacgacgacggcgatgacggcggccgcggcctgggcgacatccccgacctcgccggcggcggcggaggcggagatggggagcgctgcgccacgcgccgggtggtgcagtctcggtgccacacggaggaggtggagcccggccgcttcgtccgcaagtgcgagaagaccgagcagctcctccgcgactgcgtcggcaggtatatacatatactccatggcctcgcgcttttccctgatctgttccttcttttcctgcgaggatcccctctttgcatattactgttcgttgttttagtgatgaattggtgataacatgtcatgcgcagttgtgttactattagtcccgtgtatgattgtgagctgtgtatagccgcctctctgtggacgattttcgtgagtctgtcctcgctgatttgatacaaacacgaattcattaagaatggggaatgtgccgtgatgatcgagacg

SEQ ID NO: 40093 - DNA, 2917 bp, Oryza sativa
tgaaaactcacatctcgttagcatccttcctttatttcttcacatgcctcatgttaaacttttaagtgcatgaaacccaaatttctgtatttcgtagctccttgtaaccaatgtacaacactatgattagtattctggatagattttgtacttcccaaagtattttggttgttgacaagctattacaataatctgatggataacctaccatacattatttctcctaaccgatcacaataatcttcttctaggccctctgaactggtggaatcaaaaactgaaaatactgaagaagacgtcacagatgaaatgaaaagcgggtcactatctcttggttttccgaccaatgagccctttgcatttcctggacttcgcagtgacatagaagctcttgagaaaggccttttcgggagcattggtagctttctggatgatgctgagaggatgaccaatgatttcttgaagtcttttggtgtcccttccatcaatgaaagggagtcgagctcatttgatggacaacctacaggcaggcacattggtggacaacctgcaggcaggcacattgaggaaggtactgcaaaggacactaaacagaacgactacgcagaattcagcagcaagattacagatgtgtaaggatctacagttagctgacgcacctttgggagcagcttgccaattttgtattttgaacatctccatggttgtaattggaaggggaaggatcagtttgactgttttataagcagagtcgtctgaagtctgaagtgttgcgcttataagaacaattgtgtatattactgttttagataagcctgtttgtgttcctcaacaatgagatcaattatggatggtttttttctctgcttaagtttggtcatggataatgcaatgcattgttgtttctgcgttctgctgctcttggcttcaactgaaatatttgggggccaaaggggcagagactctggcaccctgatgcgcgattgcccatgcccatcctagctaatccatttgtgcgttctttcaaaggagattggggagattgtgactcgttttccacgcgcacgcttcccaaactactaaacggtgtgtattttgcaaaaaatttctatatgaaagttgctttaaaaaatcatattagtctatttttaaaatttaaaatagttaatacttaattaattatgcgctaatgacatataagtctcttcaggatgggctggggcctggggataggaaattctccgatcccctgtttttctcaactttaccttcacgtggtcttcgaagcaatttcaagttgctatgatgcttctagatatctgaaatatggacctgcacagtgtcacggtgaacgctcctctgatatttcggtaaaactacgaaagctcgtagctacttcctctctcctaaaacaaatccactcttagcatcctatcccaagacaactttagttgtaaggataaaataaacaaagtgtcccttatttataggaaaataatattaatagatggataaagggtattaaaatatggtgagataatcccttatttctctatggtatatgagctgcagatgctagatgcctggtgaggtatgtacgctttcttattatgaaacatgtatatcatctcgatttttcgatgtttctatgccaataattcgaaacagaagatttctcctccgttcatttgaaagtctggtttcagacgtaagctaccaaaaggatgaaattttttaagataataccaaaaggatgaaatgcttggtaactcgggctaggtgcttagagtaaccagaacctgcacactactttatcctacgctttctatataagtacaaccactaactagtgaggataagacatcatcaaaataaacctaacctgggaatatagggtaggtttggtttgctacctatcaaagatttggtagtaccaaatgtttggcaaattttggtattatcattcttttttggtatccttggttgggtaaatatgtttggattactaccaatatgaagtcaaaactagaaattgagcacgcctattggcgcacttgttttaaaccccatgaatttgttttcgtgttattaaaaaatattatgtttgttgaaaaagcaacgtcctcaaattttgacatcttaaattattaaattgtaaatatcatattaatagatttttgatgaaaactcttctatatagttgtgttttaatttttatagtctagaaaacaatgataaaatatgtgtaatagagtctgttgatttttaaaatgatattattttaaatacacaggtaatataaattttgcaaagttttataagaattagttaaattttattgaaacttgagaaaaaaaaagtacattcgaataaaatttcaatcaacttttaatttaaaatttaggggcaattgtatttttaccctgttttaatgtctaacttccaatttgaccctgttattttaagtttgcttatttgaccctctttttaaaaaataaagatcaaacttgaccctattctgtgaaagcaacttaacggtgttaactcatgacaaaagtaccatttatacccttgcttgtttgacccttctttattgaaagtttttgtttatttatccaggtttaacaaattttgacctaggtttgataaatttaacataggtttcacaatttgtcttaaatttgatgaattttgacatatatttgatagctttttgaaaattttgacttagatatgatatatttttttacaaaattgacatacacttcacagatttgataaaattttgacaacataaatctcaaactatatattccaagaaaaacacaaacgccatgaggctaaccagatgtgtctcgagtccaagctgctcaatctaccgcatctgctacgcgccgccgtgagaatactcaccgtg

SEQ ID NO: 40094 - DNA, 7465 bp, Oryza sativa
aagtcctctctgcgtgccgccaccgcagcccccaccgagcgccgccttcgtagctcctatcgcgcgccgccgccacagccccgccgcgcagcgcctctgtagcccccacgcgcgccgccgagaaggcccggccggctggggtgaagtagactggtgagaaatttggggatataattgatttggtagtcaggggcattttagtcagttcagattataaaataatttttttcggtgcactaagtaaaccctaactgtacagtgaaaatagggccaaacggcagttccgatttctaaaagtagggtcaaataagtaaagttgaaaaagtacggtcatattagtagttagactttaaaatagggtcaaatgagcaattgtccttaaaaaaagtagcaaatcacattattacggaaatccttaaatttctgttttttctaaccacattatttagggtttctttctttttgtaaaattatagttgagttttctattaaatgataaaattgatcattgatattttttgtaaaggtgttctaaaggagctaccgtactcatcattttttctagtaccacatgaaaagttacaatcgtatagattttgtgccataaacacttactccctctgttccagaatataataagttttagagttgggcccggttattaagaaagtaggtagaagtgattggtggagggttgtgattggatgaataatggaggtaggtgggaaaagtgaatggtggaggattgtgatttgttgggaagaaaatgtcggttgagaagttattatattttgaaacaaatcctaagggttaaaagttgttatattttaggacggatgaagtatttaccatcacgcacacgggagggttacctttcatcttctttaaaagccaggtaatctctcaaatgaccaggcaatgtattgagttttctagagatttattataggtatatgtgcacaggagacatactttccaacacacatatactgcacctctttacctttaaatgaacacatggcagttttctaaagaagcctttactaaatactagccagtaaagtcgtgcgttcgcatgactatgccttcccacctattaaatgcaatatattgattataattatattgtaaataagttcttaaagaacatattttgtaggaactaggaagtttatctattataaacaatatttgtgatcataaataattaacatgcctagcatgtaaaatttgtcgtaaatattaatattagcatatgttctcaactttgtatattattagcaggtattatattttaattattagtccaagtaatttttaaacatttatattaaagcattaatttctgaacattcgaagaaccgtgttctgtattgttggaagggaacacaccacgcttggaaaaagcattagtttttttttctaacattctttttcgagcttaactccagatgctccccttttctgatcaaagtaaaatgactatgcttttattattcccatgttttcttccgatccttccattggaagtgtcatgaatcttctcctgccctctatatttctaaccaatcctttccaaatccaacggcacatcttaaaagcatacctggctcaaatcaaaatgcgaataaacattttacgttcattgtatgatgacgacgacgacgacgacgacgacgatgatttagtgtgcacgtggctcaataggaggctagatatttggcccttaaatcggttatagagatttaatattacagaggagaaaatttagattagtgccaaatttacttgaggcattaccgatttgtttgctacaatccaaacacctaacattactattcaagctgccaataaattggttggacacattttggtagtaatccaaaatagctaaattcaattgtcgctatatagttctgtattttcacccatctttacgtgacgctagacaagtcggcagcaacatcacacgagttattgtcaccacattcattcttacggttttatatgaattcctgtagtaaagcgtgaagtatcatcgggtttacttttattctgaagtgagaaaaaattgcccaaaaaagatagcaaccaagcaactcgacttagcaaaggggggggggggcatgtttggggcacgcattgcgcttgcaacaaaactttggctgctgctatgtctgctgctatgtctgggataatcagttggcacaaattgatgaattcgaaaaggaggccccatgagctgctaggatactatgttagattgtaggaaagagatcctatgagattttttcagtttaatttaatagttgtataaattatatgtagctattctataagaaaacatgataataataatagagtaaattgtaccagcggtccttaaacttgtaagcagatttcacctaggtacacgaacctgcaaagcgtgcatcgagatccctaaatgtagtttattgtatcatctcggtccaaagtcctgtttgaccgtggttttaccagtgttcacctagtcgctaaacgctagtcggacggccacctactgactagcgactaggctgattaggcggcgactagacggattaggcgaattagacatttttttctatttctttcacgcaaaaatactgattctagatattcggtactcggtaaatataggcatttaggcaaatagcataaatcatagttaagttcagaaatcatcaagtccatacaacgcactgacactgcacacgaagcattgggtttagtacaaatctatagggatagcgaacacatcagtatagccactgtacatgcacatcataattcataaatcataactttatagatctgaggggctggagctaggagagaggaagaaaaatttatctagaactggaagaacagagaaggtgaggtggtggaggggagcctgatcccctgatggcctgatctagggttggcgtaggctgcttgagtggttccgtgcttgactgcttcaatcggtgtgtttgccaccttccattgacagcaaggatgaaggatgagatggagagcaggagcagcagaggagggggaagaacgtggagcagcagaggaggagagggaagaacatagcggcgcggtggaagatcgatgggcacggcgacggagccgtcgctcgtggcggtgtgaaaaaagggggtaggcagggattgcgctctctctccaggctctcaaataaggcaacctaaatccccttctataccgagtcggtcccgcgtggcgcttctaaattttatcacgcccaaattttgatttctatcgcctagtcgccgcctagacgcactgtccctttgtctaattgcgctcaggcaccgtcctgtccaggccgcctagaaccgtctaggcggtaaatcgactaattcactgcctaaggtgtaaactggacaaattgtcgccgactagcgattaatcaccgtttagacaggctaggcggccgtttaggcgaacattgggttttacttacgtggcatgctacatggatggtgatgacatggcgaaattttccctcctttttttacctgctctgccttcactatgcatgtcgagtcgccggtcggctttgcccgtaggccaacgacggatggattcggcaggacaacggattctgcagcggcagtgttcggcatgagtggatccggcgtcagccagtcaacacgttgcgcggaccaagccgaaggcgctaaggcatgggggctcggttccaaatggaggtgctcctatctcctatcgtccctagtggatttgtagcctccgtccctcaaggagggaggatccgacgcaggtgacacaaggaaatgacatatcctatgttgttgttccgctaacatgaagggatgacagatatggcagcaccagggtcggacgggaccgacgttgctgtcagccacaagcgctccgatgtgaggctccacattgctctgcgtcgtgtcctcatccgtgccatccatgccgccacctaaaccgaatcgaagggaaagagatcttagccaagttggagcggcaacgctcgcagaggagggagtagaagcagcatcccaagaagaagtaacatgctagtagcatcaccatgatgcccgccagtgcaggcatccgccgacacccatctctccggtcgcgagctcctccattagctcaagcccgtcactcctcccagcttaaatcatgtcggatcaagccacaacctatccgaagtcatcatccccagccaccgctctgccgttgggccaaccccgttgctagcgcatctaccttcggtggtcggcgtcgtctctctcgctgcctccctctccctttgctgttgtcgtcaatgcggtcgttgctcatcatcacagccgccgttggtacatccagcagtgaaggaagaagagaagaagaatgggagaataagaacaggaaaaggaaaatttgttcgtgtcatcgttcacataggatgccacgtaggcaagccacagtcaaacgagactctggaccagaattaatacaataaaccaagtttatagatcttgatgccatggattagccctgcacaaaaattgcaatggtaactcatgtatactcttattttgcagtcgtcgctaaaacctatcttatgcaggcaaatgaagcccaacaacacttaatttaggaataacagcacttcataatcaattcgtagctagcacgcaaatgaagcccaacaacacttaatttaggaataacagcacttcataatcaattcgtagctagcactaccaagataggtgaaatgtggaaagacagcctactctgaataccgtactctaccacaacgttttctacttcattttgccatcagcaaaacacacactgcctacaagggcaaaacaaaatattgcttgcaaactatgcacgcacacggcgtttctgaattgtgtagactaatcacatgtgtgtttttagggtaacacatcaaactattcaccgactcttacaatcgtctactaataaaaaaaaataaaaccaagggaaccgaaaccaagatcgagatacaatttttttgaaacgctttctttcacaagtctgtgtgctaccatattcgcgacgaacccacctcagtttcacctcagtttcaaaccctagaaataaagccaggggaaccgaaacttgacccctggtcaagatacaattttttgaaacacctttttttcgcatgtctgtgtgctactatattcgccaaacccacctcagcttcaaaccctagaagtcatcaaaatggctgagatcttggatgatcaccccatggaccgaccttttaagctcactttgtttcaccatattggcaccctcccaaggagacaattttctcaaaatgtgtagtttaacgttacaaacgaaaacagattcccctttcgatttaaacctgaaatagatttcgatcatattatgtgggcatcaacagttatcccacaaaaccccatggtgaaacaaaaaccactgggatgatcagcccatgcccaatatacagctttcagaatctacctaaaaacaactaagaattccaacattaaagaaccctgtacacccaaccagatggaaaatttctttcaaccgaccacaccagactgtgcaacgccttcttgcgcagaccaaaataatgactatatgtctagaagaagacaatgaactttgccgggtgaggaataaattaaggtgctcttgatgatctcattagcttgtactacggcaggtgagagctctggatacatcacataaatgtgataatttaaccacctctagttgaaaatcttcacagccttatcgaaagaattgcggttctgtaatttattcaaattgttgtcagaaaatgcccactgttcacatgtcagttagtaggagtcataagcgtatacctgattggacaagcatgacctttttggggtgacgtctgagtgctcaagtcctaggcattgttcccatggtccataaacatctttctatattaaataaacaaggcagaaaaaaattatttgagaataatccgactcaactcttaaaagagaatttaacccacctggaatcggctcaatacgatatctgaatcttgaaagtattcaccagccaggcgattgtgagcaatataagcaaatttccactgatcaaagtagctcacgtcagatagtatccaatatatgatacagcagaaaaggtaattgaaaagatcactaaaggtttacactgtagcaccagcctcaccaacagtaaacaagcagtaataaagtaatacaaaatcgatcgtgtatgagatgaaaggttgaaataattaccttcgcaaactgctcatcagaaaccagaagtttcttctgaatacgcactttgatatctgataatgtctcaccatcacggataagaaagaagaaaggttctccgtagtaatcaatgtgctggaaagattgagacaaatgattcaataagagaaatcccaggtcgccgttgcttctctcaaatggcacgcaagaaaacaaacgtcacaaaaaacaaagaattggagcgagaatcagagatgcactctgaagaaaatacagaacatgctcaggcaaatggaacgatgcttcataatagaaccataaaccagcataggaattgagaggcactgatcattgaggtcagcttagtaagtgacgttacacctttaggcagcattcagttgtgtccattggaggactatatagtggcccattattacagataaaatgcaacgacctggttgtttacaatgaaatgaaatgacacaataaatgcttcagtcatctcttgacgagacaatgcctaagaaagtaccaaacagtttgagcttatccaggaagacagttaaaacgtggatagatatttccaacattgactgagcatgttcacgctcaacccttccaaggccaaagccatatttcccattacacgtttcccatgtaaacaagctaaagtacaacgactagtcagtccaccatgtaaagtagcaaacctcaataatttctactatgttcttaatcactgtgacaagtgggacagctaatactttagagatgactgtttcatcacgcttagatcaaagaaggctgaaatgggatttactctgaactatatccagaatcatgatgtcgtgaacattgacatgttcctcaaaactggtcttaaatatatgacaccattgactctaattcatttgattatccatcttttctagaaatatctgtgcaaatagataaacattcgaggcacacttaaattactttgatgacagatcaagcggtactcttcacatgacttaactaagtaattgaataaatattgctggacatagtttgaggacgaagtcaattgtgttgtatattaaaaaccagagggagtaccaaatgactacaagcagtattgaaacattaggttctaaatatataaatacctgttttctatgatgaagtgacag

SEQ ID NO: 40095 - DNA, 4554 bp, Oryza sativa
  unsure (1)..(4554): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggcctaaatgagcaccttttattaacaatatactttttacatacatacgtatgtaatagttagtggcacatctacattgcaaaagctataggaaaataatcaatgtcaatgtcaagttgcaatgtgaaggttttctgtcttatgtctcagcttatggcttttaacagggataaagttgctgcttgtgctaagcactttgttggtgatggtggaactcataatggaatcaatgagaacaacacgatcactgatgaacatgggcttctaggcattcacatgcccccatattatgactctattataaagggtgttgctactgttatggtttcctattcaagcttgaatggtgtcaaaatgcatgccaatcatgatctggttactggctacctgaaatccaaattgcattttagagttagtattaataataagcaacttatttaaaattcctcttatgtgataaaaaactgactcttcatgctctctgatcgcagggatttgtgatatcagattggctaggaatagacaggataacgtcaccacctgatgcaaattatacttactctgtgcaagctggaataaatgctggtattgatatggtatgtgaatttctttcaagaagattagttcatattttcatactagctacaataagcatggtttagtttaattttagtcaacattcatatcatgatactggaagtggaactggtcttactactttttttttgtggggggaagtcttaatacttattataccaatattaagctggaagtttatttcgttctttttattcagaaaaaaagaatacatcatttcatctccataacaggtcatggtgccattcaattacacccaatacattgatgatgtgacatctcttgttaagaagggtattatcaatatgagcagaattgatgatgctgtcaggcgtatccttcgagtcaaatttataatgggcctattcgagaaccctttagctgatcttagcttcgcagatcagcttggaaagaaggttgataactacaacatgctgtatactccacagagtaaatttcacaaaactacaaatactttggttaaattatcacaaaaccatagatttaaagtgatgtaacacagaactacatatttaacaataaatttatcacacaactataagtttaaggctaagtatcgcaaaactacagatttaataataaaattattatcacaaaactacaaattttggggtttaaatccttagcactaatgttatgttggacttataattgttttaaattttgtgattaaattatcattaaacctgtagttttgtgataactttgttactaaatctgtagttttgtgatattctaccttaaatttgtagttttgtgataaatttagtgttaaatctgtagttttgtgatgtatcaagttaaatctgtagttttctgataatttgatcaaagtatctgtagtttcgtgaaaattactctacacaattgacaagtttggaaatcatccaagtaaatgagtaactaatttaacaggagcacagagatttggctagagaagccgtcaggaaatcacttgttctattaaaaaacggcaactctcccaatcaacaattcctgcctctaccaaagaaagctagaagtatccttgtagctggaagccatgctagcaatttgggctaccaatgtggcgggtggtcaattgaatggatcggaggtagtggagatattactgtaggtatgtgttttttctatatatcatatattcttttcttttaaaacgaataaatctactatttcaggttcttatttgctaaattcaactatacttaagaaaagctattttgattttttttccttactgtaataattaaatgcatttattctgttcaggtacaacaattcttgaggccataaagtccactgtcgctgattcaacacatgttgtctactctgagaaccctgatgaaagcttcatgaaaaacaatgacttctcattcgctattgttgttgttggtgagcgaacatatgctgaaacaacaggtgatgacccagaactcaccatcctagaccctggtacagacacaatccgaacagtgtgttccacagctaagtgtgcagtggttatcatctctggtcggcctgttgtcattgaaccatatcttccaatgatggaagcgctcgtcgcagcttggcttcctggaacagaaggtcagggtgttgcggatgtactgtttggggactatggcttcaccgggaagctcccacgcacttggttcaagtctgttgaccagctgcccatgaatgttggtgacctacactatgatccactcttcccttttggttttggtttgacaataaattcatcgcagccagggtaagtaatttcatcaatcatccacactaatgcagctcaaaatctaatcctaaaaatctgaaaggcacactagttcgaatcaatgctttgtggtttgaccttcatattgtttcatgttttcaggttctctggtgctgacagactgagagataggaatggggggatgatatacgttgtgttgagtttggtactgtcagtaatactgatgcatgcttcgggcataggtatattttaactcgagttgccctttcctagtcgtagtatggttccacatcaagtgctccatgcctccatcgttatacgttgtatgtactagctctatggagattttttgattgcaaagatgcatttatccctaaagctaggtgggtcagtgggtgataagcagatttgttctttcacggttttaccaaattatgtgtggttataatagagcatttttatctagggaggacaaagtagatggattatgctctgcaaatactgatgggcctacagcacttctttactctccgtaccatgtgacactccacagaaagtaaaggaatattaaaatgtgggtaagaaattgatgggtttgaatcatactccctccgtttcctaatgtaagtcattctagcatttttcacatttatattgttattaatgaatctagacatatatatctatctagattcattaacatcaatatgaatgtagaaaaatgctagaatgacttacattgtgaatatatatctatctagaatagtttgttgcattatgatattcacattgcaaatgcccttaaacaccgtaataataagttaacaaccacaactaagacatggcctaggctcaccacccttggccatataggcgaaggggcaaaggaagggcccctctggctggccatgcagcacggccgtgcaccacaacgtcacaggcagccggccgcagcaatcctccatcctcacctccacctccagcgacacgcgctcgcgccgccgccgctggctctccatgcgctcgtacagctcgccgggtatccccaccccgtcgctggtcgccacgatcggcacggagccgaccgcctgccccggcacgcagaacccgcccgggaggtcggcgtgcgcgagctgcacgccagcgtacgacaccgccgcgctggcccggccggcgcagaacgcgcggcgcgtggcctcgttgtcgacgcggagggtgagttgaagacgggcgccgctgccgccgcgccggccctctcgagcccctcgatgccgggcaccttcacccagaagtcgggcttccggtagccgtacatgctgttccactgcccgtacgctatgagcgataagagagtcgcgatgaaggtcgctagtagaaagtatcgtagacatgggcgcctgtccaggcaattgccgtggtcgtcgtcatcttccgccatgtcggcgcccatgactctaaccgctaaaacgatgcggcgagaaattaacagtatcaggaccggacctggataggcacgtacacctgtacgttacttataaaagactggtcgtaactcgtaacggaaaaggtaagactggtcgtacccagacttcgggcctccggtagccgtactcccgcgcagcgtcgtcgtggccggcctcgtggatagcagcagggcagcacagttggccccagcaaacccagtgtccacaggaggcaagctcgcgaggagcgacgactaccacaggcgcttcttgttcgcgcggatcggcgccctcgacagcatggtacgtcgctgccgccgctgcttcgactggtcttgatcgccatgagcccatgagctgccatgcatgcatgctttaatactagctagttacgttcgacaagatctccaatggatcaaatataatagggtcgttgaatccaatcacaaaacggcaacactaccgaacgtgatcaccatgtcccacagagtcttataagtaacgtaccaaatccaggacaggtcctgact

SEQ ID NO: 40096 - DNA, 4469 bp, Oryza sativa
ggctacgagggcatcgacctgggcaggccggccgccacggtgtcgccggagttcagggtgacgctcgggacggcgaacggcgcgtgcgtggaccgcgcggccgtgaccgtgctgtactcgggcgtggcgctgggttgggcgcgcgcggagccgcgcgactgcgcggcggggcgcttggagagggacgtggaggtggtggcgcggggccagggagtggggctgtcggatcgcctccgcgcgcgcatggcgtcggaatggcggcgctcgtcgatcgggcgcgctggagctcgacgtcgacgtgaagatcttcgacgaggacacctacccggtgcacgctacctaccacatccctgacagggtgatgctgtgtaaggtgaggacggatgggcgagggtcggagtcgccgtcttgcccttggttttcgccgataactttagctttcgcatagaaattagtaggcacactgcaaactgattaattaatattagtagattgtatatttgtactactgttgtttgtgtacaaagtccatatattaagattggtagattgtgcatttgtactattttttttaacaaagtccgcatatgttttttttccataaaagaaagttacaaagcgagacgcttatatatgtgtgcacatttaccactatgaacaccttcaatcaccacatacatctggttcttgacaggtactgtatgtctttaatcactaaaaagataatttaaccataaatatgagtaacccatgtcagattttaaacctgaatttttaccattatctaaaaaagattttaaacttgaacttggattctcaagtggacatatttttaaaaatacacagtatgaatgcagacgttcataatgtggatatattcatcctatgaatgcacgcaagcacatttacccgtacagacgcacaccttacctatgtgagtatctcttaccatatatatcgaccatacattcatgcttattttacgtagtttaaatatgttgttggtaaaattccacaaaattgcgttgatgtatcggaatttcttctatcttttttttccctcgtacaactggaatactcggttgagtttttcttctttttgcgagatacttgctaatttgcaccatacaatcaccaaattatttcgatttatttatacacgtttgatgagtttggagaaagcgagcatcagaccgttgggcctcacctttttcttatgctggctcatcagccaaaattgaaattttcactattagggcccgtttagttcccaaaaagtttttccaaaaacatcacatcgaatctttagacacatacatggagtattaaatataaataaaaagaaaatctaattgcacagttataggggaaataacgagacgaatcttttgagcctaattagtctgtgattatccataagtgatacagtaacccacatgtgctaatgacggcttaattaggctcaaaagattcgtctcgcggtttcccgacgagttctgaaattagttttttcattcgtgtccgaaaacccctttcgacatccggtcaaacgtccgatgtgacacacaaaaattttcttttcccaactaaatacacccttaattttggagttgattttggggttttttcatcgaaatttatttttcagtatttgtttttaaattgttaagaacatgtatacaagttatatttataaattattttttgtttgcaaatatatcatttcatttattccctaaaagatgcgtgagatgtttgtgattgcgtgtgttcggcatgcacgccacgccacaccggtcacatgaaactagacaccagcccacatgagtgcatgacccaaatagtgttacagtgagaccgaaggacaacgccggattactactctcactagctgatgacgtgaaagttgaaactactcccttcgtccaaaaaaacacgatttcatcacacctcgaattcgaggtgaacctcgctacacacctcaccgcgccacggcgtgagctttcaacctcagctatatagaagtagtactccagtaattgacattgtgttgcttcctccgcaatcgcttcaaacagttgttgccacagacctactccctacgtctcataaaaaactaacttagtgttgtccagattcgttgtactattatgtatcacacgatcatctccaattctagattcttttttttttggacggaggaagtacggcggttgaaaccgatctttatcatttctctcctttcaaatcacccacgtggtcagtgtatgtgatgcggtgtcaaatcctattagagcaagtttaacagtatagccaactactagctccaactcatctatagccaatctaatagctcatttatacaatagttatatactacagtattaatacatgggcccatcatcatacacacattgcttcttggagtccgtgttacagctggctataaatctgtagcccgctgctcttctctctccttatttatctccttaaaatatgtctgcagctggcttatagcctgctattgtacctgctcttagagcaagtttaatagaatagcccactgctagctccaaatcatctatagccaatgtaatagtcaattcatacaataggtgcttaccatactattaatatatggtcctacctatcatacgcacgttacgtcttagagtccgtactgcagctggctacgatctgtagcccgctgctattgtacctactctaatgaaccacctccttttacgtgtttggagggagagttcactctccctaccgaggacagccttaaaacaaaagcaaaccaaacaaatttacctcacattaatccctggaatttctatttctactttaaatccagccatcacatcgatccgcactaagagcaagtttaatagtgtagctaactgttggctccaaatcatctatagctaatctaatagcccatttatacaatagttagctataaaaatatactataccattaatactcggttccacctctcatacacatataacgtcttggagtccgtgttacagccggctacaaatctgtaacccgctttcttctccctcttctctttttttctcaatatgtggttatagctggcttactgttgtactatacctttgctttgtgaattgtgaggtgcggccgcgccgatggaaacgtgtgtgtccgtctcgagcccctcgaggcctcgatgtcggggtaccttcacggcttcacccagaactcaggactttggttagtaaaacgccatggcacaagaaactctggacgccttggtaagttggtcccgactctgattggtacacacgttaacttgtagcacgtcttgaggtatatggttgcggtaatcatatatcgcaaggggaaggatttccatacatggatggaatcaaattgttgttcgatcgatcggaagttcggaactaatcacggaatcgaatataaaaccggctaaatagaccctaattttcttggactctactataaaatctccagtcgaacgtaaacctggtagcattgttgaacgtgctaattgcatgctaatcatggctcatggggaagacctcgacctccaagctgcggaggccgcggcgccataccatgctctccagggcgatctgcgcgaacacgacgaggcgtctggccgtcgttgctcccaagcttgcctcctgtggacacttggtttgctggggctaaccatgttcctttccacgttcgccttcttctccaccacgacgcggccggcggcgacgcccacgctgggcgggaggtactaccacgaccacgacgccttctccgtcagcatcgccggctacgagggcatcgacccgggcagcgcgggcgccgctgtctcgccggcgttcagggtgacgctcgggacggcgaacggcgcgtgcgtcgaccgcgcggccgtgaccgtgctgtactcgggcgtggctctcgggtgggcgcacgcggagccgcgcgactgcgcggcggggcggcgggagagggacgtggaggtggtggcgcggggccagggcgtggggctgtcggagcgcctccgcggccgcatggcctcggagtggcgttcgtcgggcgcgctggtgctcgacatcgacgtgaaggcgttcgacgaagtcacctcgccagcctacgctgccagacacgttcctgacagattaattatttgtaaagttacgttggatgagcaaggatccgactcgtcggcttgcccgtggtttgagttattgtaattggtttattttgttaccgtggtattgccgtattggcgatttggcggcatgggataatttcaaacgatcagtttgtatcggagtcgatgattgatttgatcagttccaaccgaattatggccttgattacgtttgtgcatagaagttcttgtcccttgcgaactactaccatgataaccatgaacaaacaaattaacgtgctcgatctactttttgcaata

SEQ ID NO: 40097 - DNA, 5784 bp, Oryza sativa
cagcgcggcggtgtcgtacgcaggcgtgcagctcggccacgtcgacctccccggcgggttctgcgtgccggggcaggtggtcagctccgtgccaatcgtggcgaccagcgacggactggggatacccagcgagctctacgagcgtatggagagccagcggcggcggcacgagcgggtgtcgttggaggtgcaggtgagattggatgattgctgcggtcaactacctgtgatgctgtggcgcacggctgtggtacatggccagccacaggggccattcctttgcaaggtctcccctatgttgaaggatggcgaacctcgtccaccaagattatattactaggttggtatagatgtaattgttactattatattgcagctgtatatatatgttccaaaagaaattgtcattaagtaccttgtctattatcagtctatatgctctaaaaaatttacgacacttttttttgcaattctcaaaaggactatctaaaaattattcgatagattttccctggaaaatcgctcatattttcaagccaccaaatagctattatacgtctcaggttaaaatgtatcaaattaaagtacatcacgggtgttaatcgcatgaaactatatatgacgcggaaaaataagtaactttcttcgttgtcaagtctgaccaagcggcaccctacgagctgggatcatgtataaatcctcgtagcatgtctccaacaatcggatcatcctttttatttgggtgaatatgcagtttagtatttcaacttttgcttagaggtcgaattagttcttgatgttttataatgtccaaatatgtccttaaaaattatgacacggaaaaataagtaattttcttcattgtcaagtctgaccaagcggcgccctacgagctgatcatgtataaatcctcgtagcatgtctccaacaatctgatcatcctttttatttgggtgaatatgcagtttagtccttcaacttttgcttagatgtcgaattagtccttgatgtttcataatgtccaaacatgtccttaaaaattatcacatgacttaacatagtccttggacccacttaaaacgccacgtgaaaatgccgcgtcattcatgcatgtaaagttaaacatttaaatgtcaattttaaccttacattttcttgaaaaaaaaagaaaataaaaacaaagggaaaaatacgaagatgcaatcataaaacaatgtggttaccaatgctatatctttttggcaatggtcaaaacccttttgttttctcaatagtttttctttatttcctgtgaaaacgtaagggtataatggacatttaaaaatttaatttgcatgcatagatgatgcggcatgtacacatgtcatttttagagggtccaaggactatagtaaatcacacaatgaattttagggatttgtttggacaatacgaaatgtcagggactaaatccttaatcgaaagttgaaggaccatgttggttattcaccctttttatttcgatggttaggattttaggccagaaattttctccatcaatttgatatgatggtgcattagtggactgtaactatagtgtagttatagtgtaactacaatgcaattacactatagttacattgtacctacagcatagctgcactgtaactacattgtaatatctatataagttagatataaagttgcatattatcattgttatggataccacatacctaatagtagttgactaagctcggcagggtccaccatgtactaagtcttatacggaatcatacctcgtatatagaaggagttccggataaggaagaacaaatagttctatatggaaatgacaaggactatccggattgtatcaatattggtctccctagtactacttggataatggggcatctatgggtataaatacaagaccccctagtgggagagagggcacgcaacagcaactgatcaacatagatcaatacaagccaacacacgccaagacaagccgccggatatcgacatcagagataagcctagacaaacctaatatggtgtctggggaggccaacaagagggatctagcgctatctctgatctggccgagtgtggattcgaggaggaagactaccctgtcgttgactacgagttggttatccatgccgcatgggttatcccaattattgtacttgtgtgattcagatgaataaatgagcaacactagcttcggccaacaggagtaggttaatacctgtcagattcacgaacttgtataaaaatccttgtctccatctcttttacttcaatctcgcacataccctggtaccaacgatctgcatactatgcaaaataccgtagtcgtgatatcaaacgtcgacacatatattattctaatacttatatacatgttatattatagttacaatggaattataatacaattatactatagttatatttaattttttttcctaaaaaacttgcagcagtttttagatagtccctttggaaatacataagaagttatataatgaacctttttaaaaaattcacatgctaacttaggatgagagtcggactcctaattacttcagaattctcgccaagccataagaaagcaacatacaagatgctggcatcatcccaataaaggttccgaattagataccaatactattaaattaaaaatttcatatactttttaggaaaaaaattctaacaataatacgattaaaataactttcatccgttgtgtcggtgacatgggaccgggagtatcatggctagaggcttgaggcagacacaatcgcccacgtggcctggcaccctcgggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccggtcagatcgtgggttaggtggcgacaggcggtctgacgcacgccttgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctaacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaggaaaaaagaagaaaaagaacgatcctagaacaatcgggggctggctcgcactttgtagcttcttcatacacagatccaccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccggtgaggagccccacgctccgtcacgttgcaatacacgacctgaataaaattatgaacgatattaacaactttccgtgaagtttattattaaaccatctgcacatataaatgatactccctccgtcccataatatagcaacctagtatcggatgtgacactttacagtacaatgaatctggtaggaaacatgtctaaattcgttgcactataaagtgtcatatccggtagtaggttgctatattatagaacgaagggagtatcatgtatcaataatttgtaacgaaattagtactccctctgtcccaaaacataagcaattctagcatagtgtcaagtcaaacatttttaactttgactattataatagaaaaaataaaaaacatcaatcatgtaaaatagatgttactagatttgtcattaaacaaactaacataatatacagctctttttatttaaaatattttatttttatatatattgttggttatagtaacattttgaaaactgtgtcaaaatctaaaaatactcgtagtatttttgaacggtgggagtaatgtttttctcggttgcaaacaactttcctagtaacctacgactcccaggttccaacaccacccatccaaaagaccgaaacctccccgcgtcccagtcacacgcgctttataaagcagggttagcacgcgccccttccggtttctttccccctctccgcatcctccacccgcgcttctccctaaatctccctaaaccctagaggagatcccctccccccgcgcggcgatcgccgcgatccggttctacccccgttcgccgggccgccgccgtggtagatgaccatggtgaccccgcgcgcacccgaggtaaagcctggcatctccccgcgactcgcacaccattgccctgctccgcgtttggtcagagtgctttgcggttcggtaggcgtagatggttgtgcgcttcgagatggtttctattagggtttgggtgtttttttttactgagatgcggtggagatttacaaaggtttgggttttggttgcatgtcctgttgtttgcagctcctgcagcaggaccaggatgaggagatgctggtgccagaccaggatgttgttgttgagggacctcagccgatggaaggtgagatttctctgtgtttttatatttttcctctgaatttaatctgatctgtttgtcaagctttgttattaattgggttatatttttttagggtgttaactcaggccattttttcatagtatgtttcatgggatgcgactagtctctagaaccactgcccaaaacattaattatgaatcgtgcattcacgctgtacttgcaaacttctggtatttagttttttcggtactcgcaaacaataggttttgtaagaattactgaactctactgggaggtcgccagggtcagtaggagtcctcgggcttgttctcccaaaaaataagtctagttaactattgaagaatgtgcggtttgtaagttaactattgaagaatgtgcggtttgtttccagatggttttagctctttgattataaggtgataaacatgtcctgtagtcctgtactattggttgatgctaaggaaaaaaaacaatgcagaattccagatgctggctaagaaacctggaacttgaaaagagtaatattccaatctactgaacatgctctgtttgttttttttctttcctggttgtgtgttggttgttttttgtggtggtactggtatacctgtcgttatcaggtcattgaaaaatgggcatatgctaattttcaccggtgcatgtgacactagagtcatgcaattgtttatcatgttacttttgttgtttaacatatttatttcatcttgcagactctggatcaacagttgagaacgagcaggtaccagaaacctctacgtccagatttacgtggaccattgaagatttttcgaatcacagaaagctgta

SEQ ID NO: 40098 - DNA, 1001 bp, Oryza sativa
cgggcttcaccttcagcttaaacgtgtctgcacagccaaaccaccacacattgtcacacattgtgacacgactaaattaaacaaaatcagtcactaattaatcaccttgggctgagcagttgtagagggggccagggaggccgttgagggtgtagggcgtcggagatgttgggcccgccgccggtctggagcgcctggctgatcaccgcctccgtgtcgttgttccaccactcgccgaacatgatgggcacctcctcatgcggcgccgggaacgggtacccgacgccggcagggggcaagatgaccatggggccatgcacggtggcgcgcagccaggagatgtgcgcgtgccaccacagcgtgccacgctgcccggtgatggtgaacctgtacacgtagcttcccccgggctggatcgggcactgcgtgatgtacgacggcccgtccgcccacccgctcagcagctgccggatcccgtgcctgcacgcacacgtacgtgagacacacacggtgaaaacactgggttttttggcgtcaaaacacggtggaaatcgcgaggcgtacgtaccagtggatgctcatgttgtagggggagtggttgacgaccgtgacctcgacgtggtcgccctcgcgggcgaacagcgtggggcccgggtactgcccgttcaccgtcacgatgctcttcgtgctgcacagccgcgtcacgctcgtcgtttgcacctgccatgcatgtcacggcaaattcgcgttggttttttttggcgaaacttgtgtatcgatgtgatacaccacaccgtggatatgcatgcacttacatcgaataggtactgccttgtgatggcttcagctcccattgcggacagcgtcatcagtgctgcgacgaggaggcagcaacgaagaacagaggaggctgccgccattgctaccttcactgacctctctgtctcgtatgttaatgaagctcgctcttagctagctcagcttgtgatggtatggccata

SEQ ID NO: 40099 - DNA, 792 bp, Oryza sativa
attcctgcagcccgactatatgttcacttcaaagactcgtgtactctgtattggagctttctttttggcctctaagttcaccaatgcatctgaacttttggggagattccttgacatactttttccaacaatcgaaactgcatttcctgccatacatcttttataatgtcttgcattattaatgatgcaataccagcaatcttgaaattgatgtaatatttcaaacttattattgtatgatttcccaggggaggcgcaagcaatgaaatggcccatgagattaagagttgttctctatctggctgaggctttagaatattgcaccagcaaggggcgtgctctgtaccatgatcttaatgcctacagagttctctttgatgatgtgagtatcatatagattgtttttgtaacgtgatcatctgtgtgttttgtaacatttctatgttgtttacatggcacaggactgtaaccctaggctttcatgttttggcctcatgaagaacagtcgagatggtaaaagctacagtaccaatctggcgtttactcctccagagtacatgagaactggttggtaccttcttacttttcaaacatcgtaaagcttaattagtctttctttgtgagtgttataatctgcacatgatctttctggtcgtctaataacgttgttgcataccctggtttgaatcttattatcctttaacctttaaagttagtagggtcaacttttctctggagcattccaatactacgtggtttgaaattatgttaaatttttgcagcattttcata

SEQ ID NO: 40100 - DNA, 1384 bp, Oryza sativa
aaatcccttatattatgggacggagggagtactagtttaggaataaagatgtttcctgtctctttcctattttcattctccacccataccataaggcttcttccgttttggttcaatgtcagttcatcggcagtgatgggatcgaaattcgatcgacaaagatcggctgctggtttcagagactgtacaacttataaccattggagcaaacaacgttaaacatactctgactaagggaaactattctaatccctcgaggggatgttcgctcgtttgctcaaaaaccatctaaacggttatgaaaaattctggaaaaatttgacaacattcatacaacacatatatacaacttcacaaaatcttaagtccaaactcaactcccacgtcgagatataaaaaagacaaattcagcgtatgaatagtaacgtactgtttatatctaaatttgtcttttttgtttctcgatgtgtagatcgaatttgaacatgaattttggtggactagtaggtatcattatactctacgttgtcaatttttttcagaatttttcacaactatttgcatcgaatttggaagaaaaagatatacgaagggatatcccctcgagggattagaatctactcccctctgactaaccatagatgtagatctttgttttaagggtggtattcttagtagttttctactttgtgtttcataattttgtaatccgcagctattcattctgcaaattctataataattggttgcagcttcttttaagtaaaaaaccagaataaattctcttatcatagaaaaaaaatataccataaggcttctgttggatgcaatgtttaaaaactccaccaaaatatttttgttctgcagaactgtccttttttttttgctggacaaagcctgtaggaccgtacctatctttagaaaatatgtattccttccatctttatttacttgtcaatgttaaccataatgtttcacctttaaccattaataacttttaaagattaagttattattagtgaaagttgtctggttgtatttatggaacacacatcgctaatgcaacatattttaagtatacatatgtttcatttttgcaaaaagggcgagtgatcaaagctaaaaagctagtaacttttttagggaaaaaagctagtagtaagtagtaactagtgacaagtatttgaaactagagtgggtataaaaggaaggaatactgtatgaattaccaaatatcacactgaattatttggcatgaaaaaaaacaaagcatgtttcaggcaaaatatttacattgtagtacttcatactgttcatacatgctactatctccgtcccagaacataagaaattttaggattaaacacaattattaagaaagtag

SEQ ID NO: 40101 - DNA, 1847 bp, Oryza sativa
ttgacatagaaagatataaataaacatgcagtattccataccaagaaaaaaaattacaggaccattatcatataagctaaaatcattgaaaacatgatagacagtagcaacttgatcataggggaagcaaaagaaacaatggtgcgtgctgagtttgacgtcccagagctgttatatttaactagaatttcttctctcttttttaactcttctcgtgtttttgctaaagcttcttggagtggcatgttgtacatatggctgtggactgtaatgtcacaagttttcttattcggcaccaggtagaagaatccaccctttaaacgacgatccttgtaacggctgagcttctcgttaatgatatctatcaagtgattcatactgcgtctatgtttcttatagaccgtccatgtaagcatggctaatcccttaagcatattatggtaaaccaccgctattcttttttgcactaacaaggatacttcacggtctaatgacgtcgttttagccatagtataaccttcactgcaaatccaggtaccacgctcatctcggagacataaccgaaaattctttttcccaaccttgaaaccagtcttccttcgtcctttcctaaaagattaaaaaaaatctctaagaaaaggaaagagactctagttgcatccatcactccatttaaaaagacatttgcatcttcatatacaagaaaatgacaaccactccagatttaatttttcaaaactttaaccaccaaatagctctcaaaagattatgtttataaaagtaaaaattacatgggtataattttcgttacaagtacttttacaatacaacaatgtgctgtaagttatcgatatattctaataaaaaatagtaatccaaggtacatgtaactattttgtacatattatgcaatctcaattattttgtacatattatgcaacttaattttccgcagcaacgtagcggggtattcattttgtttgctttcaagtacatcaaaatttgttttgtggagtgacaattgcaatcatattctgcatatatagtaatctatccgttttatattataaggcggttgacttttttttccctaatcaaactttgttaagtttgaccaagtttataaaaaaacagtaacatctaaaatatcaaattagttccatttaatctaacattgaatatattttaacaatatgtttgttttgggttgaaaatactataatattttttctataatcttgatcaaacttagagatatttgactggttaaaaaaaatcaaatggcttatgatataaaacagaaggaatatttttcaagtccaaaagaaaaattctactatactattgttatttattattagtatctttcaaacctaaaaaaagtgtgcaacacgaggaactggccattacgtaccttgaacatatatatgccttgaattaatacacgttatatgatttgtgccggcccccatcggtgcacttattcaacgaacaagagaaacgacatatttgtaaaaaaaaattgtgaacaaaatttttatatacatgttcttagcgatctaaaattattaaaggataaaaaataaacttcgataaaaaaacctctaaatttaacttcaaatttaaagttgttaattcaatttttgactgataagtataagcgaaaagatgataccatacatgtttttttgaaaaaaaagatgagatgagcatataattatagtacatacatacctgaagctgcggcaggtacaatcattgtccattggctagcagagtcgcgggtgctgcaaaattgtcgtctctgttaatcgcgcggatgccaatgattttcatggatcaaccga

SEQ ID NO: 40102 - DNA, 2008 bp, Oryza sativa
  unsure (1)..(2008): unsure at all n locations
cagtataggtgtatccgtgtatgtgtggaaaaaaaacgaaaaaaaaaacgaagtacttgagagcgtgccggtgaggcaatggactttgtatttatacctcagcgacacctttaccttcgagatggacccgatcggacggttacgatcagccgcaccccgcgtctcaccacccaaatacccaacacacaggctacgctataaacgcaggcaaaagcgaccgaaccaaaacccaaacgcgagccgagcctggtcgagacgcttctcaacgccacgccccctcacctaaccgggccgacgacccaagggcccaagcaccagccaccctctctctctctctctctctctctctctctctctcctctccgccgccgccaccccgccgcctccctcctccggcgaccgccgcgggcagagcgcgacaagagggagggaggagagctcgcccgaggtgggggcagggagcgcgaggagagggtgaggggaagatggtgagctcttcgtcgccggtggtgaacgtgtacccgctcgccaactacacgttcggcaccaaggagcccaagatggagaaggacacctccgtcgccgaccgcctcgcccgcatgaaggtcaagtaagtgtccccgcccccaaacccctccctgatctgacgctaggtttcttcttctccccggaaccctaaaccctagagctcagatcatgcccgcttttttccccccttcggtttgaacaggtccaaggtctgcttaaattagatagtactgaaacaggagtgtattaggcattttttttgtgaactatgcttgcttaagccgttacattttaactgggatttaagactaaacacttgtgttctgactgtttatgccaccctagtgttcagatggtcatcgtgggcacttattttgatccgtatgttgatatgggaaattgttttagttacatggcttataatggtgggtgattcgttgggtgttgacttgaattatagctaaaatgccacgaccatctatttatttgctcatgtatttttcctctcacgctgttgatctagctgccaagcactatgtcatgaatagttttacaagataatttacgtttgtcagaagaatacccggaatgtcaagccaaaatagtatgacactggaattttttttctgtttcttcagttgattgcgatgcattgttgtgttaattacatatatctactttgtttccgatgtaacttatgaacagctaggctccttcctcagtatattcctttctaagattatctgtccaataatgcaagttaattacaagttgcttctgtaatgacagctacatgaaagaaggaatgcggaccagtgttgaagcaatcctattggtgtgtttatactttcttcacattatttatgtacacaattttgtgtttgaaatatccaacagttgtcaaattttgtgtagttattactactagtccatataaactgcagtgtgtcaaacaaactgaaatctttgcttgcattgtcctaaataggtgcaagaacacaaccatccccacatactgctgttgcaaattggtaatacattttgcaagcttcctggtggacgtttgaagcctggagaaaatggtgtgttatgtatagctcttttttaaaccctgtcagtttcttcataaattgtaatataatgtatttagctgttggttctgctactggaatttgcagaaattgagggtctgaaaagaaagttatgcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggctgcaggaat

SEQ ID NO: 40103 - DNA, 8211 bp, Oryza sativa
gccccccccccccctcccctagatccggccggatctggagcggcgggatgggtggccggccggcggcgggatgggaggccgcccggtgagtcttttttttgattttttttatttgtggtttggatgtttttatctgtgattgaatgtatgaatctgtgatgtggtgactgagtatgtgactcgatgttgtcaatgaacctatgaatcaatattgtgaatatatttgtgatgttgtgaacgaatatgtgaatgaatttgtgatgaatctgtgaattgtgctgtggagttgtgatgtggatttggggttcaatttgacgatatgcataccactcgattcggaagaaaataaaaaaaaagcagaaaagaaaaaaagaaaaaaaaggaccagctagactgccgctaccctctctttaatcccggttggtgttaccaaccgggagtaactaaagatcgatttttagtcccggttttttcacccgggactaaagatagcgatctttagtcccggattggtagtcccgggttgaaaaccgggactacaagggggttacgaaccgggactaaaaagcacttctccactagtgagtgcaggcgccatgcatgcatatatgcatgacatggcatgccttcccaatggcacagcacagcacttatatatagcggtgtcggatgagatggaggcgcaccacactcattctcccacaagacaaacatagccttctctcttcctgtacccactcgccattacacagtgcgtcctcctccatccgtattgcactccccctagctatagctatattactcaccttctctctttaagcctgtctagtaggagtagctcgttagctacatataggacgtatagctaaggtttggttagcttggttaattgttagctggtgcgatcgatggccggcacggcggagtcgccggcgagctcgtgcgtgtcgtcggacgcggaggaggaggcggcggtggcgaagccgatggtggtggccgggtgcccgcagtgcctcatgtacgtgatgctctcggaggaggagcagcagcccaagtgcccacggtgcaagagccccgtgttgctgcacttcctccacggcgccgccgccggcgccggcgccgccgccagcagcaagccgccctccaagacctagctcctccatatccggttctcaatctctcccagatggtcggccgccgtccgtcgtcttaattctaacgcatccatgtattatgtttaatttttctctctcgatcgctagctagctgtagttccctttttctagtagtagctgttatgtttttttctgtcattcgatctgtgtgtctttagttaatctgcacctcctctgtagcttggtcgatcgatcaggttaattttgtcaaattagcactattagctagctagtagctagaccagaggatcaagcatgcatcatcccttcccaaatgatctcctactccgtggtgcagttgcatgctttaaccatcctattaatgaatctgccatcattctcaattgttttgcttgttacagtattagttagttgcatatgcatgtgttcttaacgatcgagcgatcgatatgatccatttccatggtttggtttatgtcttttttccttctactatacactgatgaagcaggtttccattaattggagaaggtggttaatttcatcgtctctcagttgattgatcgatcaatcgatctctgctgctgctgcgttacgtacgtactttggcttaattgtgttagctggatggaaaggatgcgtgatgaaaaatcaacctccagctagctttagctagtcaggggacgggaaaataaataccagtagtgatgaatcaaattaaagtagagtcgaacttatggtagatggatggggcgatcgatcgtatcatgaaaaacgtgtgcccgttttaattagagatcaagtggagagtagagtatatggacgcatggaatagcagctgatgaatatgaatgaattgaaaatgaacagagctataggccggcaatcattaggggcagttgagaggaggaattattcggggcttagcatgcacgtcagttcgtcatcaagaacacatttatacccaccgtccttctttcttcttttcttcaggatatttacgagttcctttttcttggcgtgatttctgtgtgcgatgccagaaaaaggccgaatcggtcagtctgagactgaacctggacgctgaccctgaactgcagaactgactgggccgatagattcgagaggatgaggcatgcatccacgtttattttcttccttttcgacgcgtccgtttctactgacaaaaaggagcgctgccatccgggctctgcccacgctgaaactatcaacagatcacgctgaaactatgaacagaccatcagatgctcccagggaagaagccagctaaaagctttggtttgtgcatggaggggagagccagcgatcgactttatcctgtcactgaatttgcctggaggatgacgttagaatgtggagggaagagataatacgttagtttttttttaaaaagaaggataatgtaaaggtgtccgcaaaataaaatgtaacagaaaatggattaaaaatgaaaaactaaaggattttgttttttagtttcttcaatagtggatcaaaaggattaaagaataaaaatactgaacgtaacgatgcagcggtggagtcagatattagagcatccccagcagctactctaaccgatcctccatccttcatttggcgtatagaaggggaaaaacggctccaacagatgcgctactaggcactccaaaagtgacggatgcgccaaattaggagagagagaagaggcaaaaatggagtgtctctcctctcacgcccttttgcaacagccgcctctctcgctccaatccggacttcagcgaccatctccctctggcgtgaccccacctccatcgccgtcgtccccagccggcgaaggagagctcccttgcccgtttttgcttttttttttcagcgaatcgtggagagaggcgtactagatctggaccgtcgtccgccgcgtggccgctgcttgccgctggcgtgcgcgtggtccctcgtccgccgccgtcgccctgtgcgtggcctccgcttcgccagctgccgcccctcgccagccgccgtcgcccggcgcccaccgccttcctcctccgccgcttgccgccgccacccctcgcccgcttctcctcgcttcctccccgcttctcctgcgccgcttctcgagagttcgagtgaacagtgaataagaagataagggacatgtgaaaaaataaaaaataatataaatggatggtagttgaagtatatactattaaaatataagaggatgagatatagagcatgtaatatgaatgatctgttggagttgagagaaatataaaggagaaatcttttttaaatgaccatctaaataggcatatggaggatcgaatatggatgagctgctggggatgctcttaaatgttatggctgagttgaggctcaactgaacaattgctggtttcctctaaaatttacgtggtgatttaagagacttaaacttgattttgaaggtcctagggagccacccccacattgttcatacggtatattagttttttttttgttagaactttcatatagtcatcgcttatttctctatcacgctccccttcctgcacctaggagatttcctatggtaaatcaccatattgatcttctgggtcgtcacactagtaaaacgtttttcactcccagaaggggaagtaaaccctgcacctgcacgcaccctcttgaaaaccgattatagaggaggaaggagacagtttaacaagtggagagatggcaaaacacaggagtttgtgtacatgggatgtttggtattcctttcgtttcatattacaactcatttgactttttttatatatttttttaagtttgacaaaattatcaaatttatagaaaaatattgtagtattttttaaaaaatattatcaaactatattcaatgttagatttaataaaaactaatttcatattttaggtattattaaatctttttataaatctatttaaacttgacaaagtttaattagaaaaaagacaaatgatttataatatatttataatatgaaacagagggagtttgtatgagatattggagccgttgatgtgcaagtccaaccctcaaataatcagtggggattgtctgcagtactacacatgcagtagcagccgctgatatatgggaccgagtccacctatcagccactgccactgtaaatgcagcattgtagagcatccatgtcccccctgtaatagcccaagtcgcctggcaccgacgaacgaaaaggaaagccgaaaaggatatatgaatgcagggctgagggaggggacagattcgggcgggccggccggtgcgtggattgcacgcacgcactccctccgcaagtggccgcacccacaaaatcgccctcctttttatccctcccgcccacgctctcacacccgccggcttctccttgtctctgctctccacacgcggagtggaggagggattaatcggaagcatatcaatcggcggccatgacgatcggcggcgcgtcctccagcgtcgtaggtacgcaacgcatgcgcccgaaccgatcattccttgcatatcttggatggatgctgggttttgattgattgattgatccatcatatcgcagtagtgccacgcaacttccggttgctggaggagctggagcgtggcgagaagggcatcggcgacggcaccgtcagctacggcatggacgacgacggcgacgacatcttcatgcgctcctggaccggcacaatcattggaccactcaacgtacgtacgctcgcaacccccccgctgtgtacatatatatttgcattgacatcctgctgcagattgatacttctcatcgatcgaccacgcatgtgctcactgctgcatttttcatcatctggttggttgcattttcatctgggttgttgattggttggttggttgcagtctgtgcacgaggggcgcatctaccagctgaagctcttctgcgacaaggactaccccgacaagccgcccaccgtgcgcttccactccaggatcaacatgccctgcgtcaaccctgacaccggactggttcgtatgctaaaaattccctccctttgttgtttaccaccaccacctgcccattgcacatgccaccacttcaattccctcatcttggtattattactcattctgccttctaatgaccaacgggtaaagcacacaggaatatatattctgccagcaaattgattgctgcccacctgaacatgctctgattttgcaagtttttgaaagaacttgcactgattgatgttatacatagtactgtttgatagtagttgcttccaattagattaacggtgtgcttagttcacgttaaaattgaaagtttggttgaaattggaacgatgtgacggaaaagttggaagtttgtgtgtgtaggaaagttttgatgtgatggaaaagttggaagtttgaaaaaaaaagtttggaactaaactcggcctaaattaaagttcagcagcaactgtaaatctgaaattctgatgaatgttgaagtaccacctataccatacctttgtttataacatacctgatcctctgcatacttgaaatgctgctgactgcggcagcaagatctatgaactgcgtcactgcatgcattcctgcatgtcatgattcctttgatacgcaggaaggaccgaaggatgtttgaatcatattgctgcctgcacgctagtgtctgaattttgccaggaaagatcttcagtttcaaacagatagacattctaatgctgaagtgatttcaataggttcattaggttgtaatgatgtgattgtttcactggaaggttactgaatttcacctgaaaacactgcaaaattatgcagaaattgataccatagacacatatagctagaaaggttcagaatgttagtaagttattactgctagtacttaccaattcaattacaatttaaacctgtgggttctgaattctgattacacacgccttaatgagatggtgagaattgattgtaatcatttcactttacttcatcaggtcgaaagcaagaagttccatatgctggcaaactggcagagggagtacaccatggagaatatcctgacgcagctgaagaaggagatggccgcgccgcacagccgcaagctggttcagcctccagaagggaccttcttctagtcataccgtgagatgttcgagggcatgttcctgttgctgctgctgctgctatatactcatataggattggattgctatctctgtccatggcacgcaccgttcgtaactatcacctgcccccaaatctgtcacctgaaaggtagtagtactagatgtgtatgtagtgcagtgttgttggtaattactgaatcgccttgctaatgcctaatggctgccctgcttgctatcatatgcatgccaatgtgaaggacaggtttggcttggtttgaacgctgagagagattgaataacacgagacctcctgtatctggcaccgtatagactcctatgatttatgcatgtgtgttaagactaacaagtattttatcccggtgccattttcttggcgacatgggcacctgcccacagcccattattagcgggctcgtcggcttcaattttgggtgggaaatggcatggggctttctgatttgggttggcacatgtctgaattcagaattccgcacgaggtagttgcaagcaggttcagcccattttagtactacggctgtgttcttactcatctcactcgtttttcgcgcgcatgctttttaaattgctaaacagtgtgtttttttaaaaggtttctatacaaaagttgtttaaaaaatcatactaatccattttttaaaacaattagctaatacttaattaattacgtgttaatgaaccgtttcatttttcgtgtacactgttcgggttgggaacaggtggagcgaacatagccgtacgtactaatataaaggcaactcatatgttagagcaagtttaatagtatagccaactactagctccaattcatctatagccaatctaatagctcattcatacaatagttatatactatactattaatacatggtcccacatggtatacacatactgtatcttggagtctgtgctacagctgactacaaatctgtagcccgctgctcttctctctcctcattatcttcttaaaatatatttgcagctggcttatagcctgcaattgtaccttctcttatagaaggaaaaaaaaagaactcaaaagctgtgatgtgggctggaagctcactgtcactgtaggtcgctttccggatgtggaaaaggaacagagcaaacgaacgagtcgagccgccgaaaccaataccggatgagccatcaatccatcatatgcaccggaccccaacgatacgagatgcgtaggcgcagtcaaagttggaccgagttacgtacactagcagtagccaggatatgattgtttgcttgatgtgagaaaaataaaataagtgcccatttgatttataggaaaaatgtaggaattttagaggattacaattctatggaaaaaaaatcctatgaagacctttgaaacaaaggattgaatcctatccaatcttttaaaattcctatggaatggataattctatgcacattttggaggaaagttagcaagagatctaacctcttggaacatttcctctgagtatatctctcttatgtgattcctgcgtttttactgtggtccaattaaacggtcattcctgtgttttttctctgttttgtaatcctctgttttacaattatattcatatcagaatcctgtgttttttctattcctcggtttttttcattcatacgattcaaagtgccataatcagaaataatgcaaggtaatccttccgatactgtctaccaaccacggaagacgcggatgcataagtgggagtagtgtagaaggaccggccaggaggaagaagactcaccaaacgcgaacgccgacgaccggctggctatttcgttgaacactagcacacgcaaggaacggaatatactcctccaagtgtttcgcatggacggtcaagtcaattccggaggcctgcagcggcatctgcccccccccccc

SEQ ID NO: 40104 - DNA, 6129 bp, Oryza sativa
  unsure (1)..(6129): unsure at all n locations
taggaaaaaacaaaaaaacgagtcggctcacctcacacgcacggcgcacgggccgggcagcgtgtggcccgcgacgaccgcgaccgcgaaagcagcaacctgcggatggagcagcggctagcgcttggcgtgagacagcggcgaggttcccttccctccctcgtcccagttgcggttttggttttccagcaaagcacagcacagctgcacgtacaggtacagggatgggggaagaaaaacgtgtactagatggccaccgccaaagtgagagcgacggtgcggtgcctgcacactagtgtacggcctaccggactaccggtggactaccgaacgcacgcatacgggagggaggagtcggggaccgggtcgttgctgctcctcggtcggtcagcctcagcctcatgagtgatgatgactagtctactggagtagtactagtggcctcgccaagctccattggttttgttttgcaacttcaccacgtcggcaattaccgcaacaagccgacctaacggagggggtgggaacatgtatgcaccgaacctggtgcatgtccacgttcagcgtactacctctcaacttggagcatctctgcttattagtgctctgttttggccggggtgcactgcacccaaataccaactagcaccaccagaaatgtgtcctccctatactttatactctaccagccgactagagtatactagcactactcctactttatccgtttcacaatatagacaatgctagaaagtcttacattataaaacatagggattatataattataaatgaaaaaaattactaataaaatattagtacagaattccgaatgcgtacgtacggtatcgcacatccgctgcagcagctgcggaattaaacaaaccgggaatgcgtccacctcccttgaactcaatccaaataaataataataaaaaagaaacccacaattccgggcagatgcctctgtgtctgcaacacggtcaatccacgcgcgcccctaaccccaatcattaaccccgtatgttaacgcacgccataaacgcagacgcacggccaccgtccgttcctctatgcgcacaaatctcaaagctccccacgccgctttcccctcacgctcctgccgccttccgcgaatggatgcgccggtggactcctataaaacgcaagctctcactcgccgcagtccaaacaggcaaacgcactcgcatctccaattcggtccgaatttttccaaattccaattgctcatcgcgcttcgaattcgttgccgagatccatccaatctttgagttaagacatgccgtcagagttcgtcgccgccaggaagaagccgccgccggagttgttgttcgccgccggtcggaagaagcagcagccgccgccgcctggcatggcgttcgtgccgtcggagttcgccgccgccggcgttggcaggaagaggcagcctgcgccgccggtggagatacgccgggtgtgggcgcacaacgtggaggaggaattccggatcatccgcaacgcgatcgatcacttcccgtacgtgtccatggacacggagtttcccggcgtgatccaccgcccgaccaagcaccccgccctgctcaccgccggcgaccggtacgacctcctccgccgcaacgtggacgcgctccacctcatccaggtgggcatcaccctcgccgcgtcccccaccgcggcgcccgcgctcgccttcgagatcaacctctccgacttcgaccagcgcgtccaccgccacgccgccgagtccgtccagctgctggcggagcacggcgtggacctcgccgcgcaccgcaggcacggcgtcagggcgagcgcgctggcgccgctgctcatgtcgtcgggcctcgtctgctcccacggcgccgtcaagtgggtcaccttccactccgcctacgacttcgcctacctggtcaagctcctcatggggcggaagctgccaggtccatggccgagttcctgaacctggtgcgcgtcttcttcggcgacgaggtgtacgacgtgaagcacatgatgcggcactgcggcggcgagctgtacggcgggctggagcgcgtggcggcggcgctgcaggtgaagcgcgcggcggggcggtgccaccaggccgcctccgacagcttgctcacctgggacgtcttccggcggatgcgggagctctacttcctcaagcatggcgtcgaggcctaccaaggcgtgctcttcggcctggagctcgacatggacatgcccagcaacaaaacaccctcgctgccgctggtggcagcgagatgatacgatctcctctcctccgctgtaaaatttgttgattcgtcgtctgcaagaaaggatttctttcggcagatgtacagtaataataagagggaaaaaaagatggtttaattgattggttaaattcggttgattttctcgtgtggtggtttaaactttcaccgttaaaaaattgggcggcttcccctgttgtttgtcatgatgaaacggctatagagaaaaacgcgtcgtatgaacaaaaaggcaaaaaaggccatgcgcaccgtgtgcagcgcagcgaatcgcgtcgcatgttgggagtcaaacgagcagcgcgtgtcattcggtcaaagtgcatactagtgtactatggtcgnnnnnnnnnnnnnnnnnnnnnnnnnnnnagtttttaactttttcatcgtatcaaaattttcctatataaaattttttaattttttcatcacatcgtttcaatttcaattaaatttttaattttagcgtgaactaaacacacctatgcatgaagaaggaaaaaaaaaaggctacagtagtcctgaacttatgatgaatgaaacggtgagattgactcgttttaaggtcagacgatgagtgtgagttcagggtgctagttcatgcgtggcatgctagtttcgttcagttagccgaccggtcaatgagagaaacagtcaaacaaatctgcattatactactagttttctagtccattttgtttcgtcgattacaccgtggctactagtttattcaggacaggtgcttgacagttgcgccggaaatgcaggggggataaggttttagattaatcctgaaatgaaggtgaaggatgaactgtcaggatgcacttatctccattcttttgcagactttctgcataattttccgcccctgtttaagaaaatgaaacatcattctcaaacattactgaaatccgaataagaggcgcatctatgattgaatcccaaacagtggcggatctaaaaagaaatagcagtgaggtctgagcaaactagatagaattacagttctctttccatctacatatggtaaaaaaattagtggggtcttcgtaggagactattcattagtggggtcttcgtgggggctctaatagtcttcatgccagtagtgagggctcgagaccccgccaccccatgctagatccgcccctgatcccaactgaatttgtgatcaagtacatacgggaaatgatgataaattttgtaaaaaaaaaaaaccttagtgtcgcactcgcacaggcggcttgggggcaaaaccctagccacccgcgccgcaacccccctcaccccccccccctcgtcaccttactgccaccgggaaggtggtggcggggaaagcaaccccgacgaagctactcctatgcatgggagacgaggtggcatgcgtcgggtacggagaccggcggccggagtggtttggcgcagcggatccatcccgctggaggctagatctggcctccccgcagccagatcaagagaggacgacccctgatggcggtggtccggtagaggtgcggggccacgcgaggaaaggcgtgcatgatgagaaggcgccgtgcgaggaaagcatggtcatggatggcacgacacggcgggcggagatggacggtgtaggtgatggctgcacgacacggccggcagcaaggaggggacaacgtaggcgacaacacggcggccaccgtgacctacgatcatgaggccggcgtttcagcgacggcgaaggccgtcgctgcatgtgtccaccagagtccagggctagcatggctggcagtggggcgctggagcggttgaggtcgagttggcagaggttgtgcaagtggcggagctcggggggcgacggtggcaagtgtggtagggaggtttgcaggcgaaaccctagcttgggactccccagcagcaacagtgacgtctaagacgccatgaccttccggaaggcgctgtctaggtcatgttccttgccttcgtctccttctctctgattggtctccgacggctcttggttgtcttcatcaagttgggcgagagaggagtggatctccttctctgttgctctcttcctccccttaacccctccacatgagaataaccgaaagcctttcaacattctactaggttgagtcagtgttagacggggtgtttgcaaccccccttgttggcctagtgacgatcgatcacgcttagcggcagttggtttggtgctagtgttttctctagtgtgtggtgtgaggagctgcgaactctcggtggcgttgtgtttgttttctttgtttcttttctgattacaatcttttagggttataattttataattttttttttgctatatcaatatgaactttatattatctggtgtgagtcgtaaaaaaaatttgaaaatgatgacaacaatgaaatcatacacgatgacaaagtttgaatggcaaggtttgtggactgaccaggcgctgaaaggctgaactagtttgttcaaacttttcagaggatcgatcatcgatgtgcttgtgtaaaaagaagtgaagtcaccagatgatcgtaccctatttctgtctcaggtgaaagtccttctttgcctcgagccaactagagtactgtaataaagaaaaaggttcgtcaaggaggagtagccctgttttcgtcatattatggacatgtcatttcacatcaatcagactacctcgacaaaatcagaagaacctctttcgaattctgcacctctgctgacattttctttgcttcatgtgtagtgctattgaaagctcgcagcaattgtgaaattcttaattaccgtgcgcataatgcagttgaataaaaatttctgttcagaatgttaattactctaggcatcaccatacgattatggagtttttgcttaaggtatcgttctgaaatacaatacagaatggaggataaggcaagagacgaacttggaacctccaaaaaaacaattgtactcaactctaaaaatgaactacttttcgggaatacgcaaaaggattgcgctttcgtattaagaagaaatgaactacttagtcattgtttttctcatgcacgaaaacagttaggtgtttgttaggttgatgacaaggatatgcttgcagagacgcctacattctcagaaaagtattaagctgaaacaattgtaccagatgatgatgtctcattatctgaatgctagcatcatgtgggttgtttgtactacatgtaagagacaaactaacgatgcccaactccacaatctaaagttagttggtgcctggacctgctttctgcgttaggctgcatctcatcacagtgcaagcaaagcaagcacatgcatttgtttatcgcggacacgcacgagaatcataagaaaatcaccggctttgttgcgcgatgtctcccaactgatgacctcatcgaacattttcagtttcatggtcaccttccttttgaattgtatacagctcaaaatgctttattttttttgttgaagttctcaaaatgctgttttgggccacataactgaaacaggcttcaattcagtacttattcagggccaagaacatgctgatgaatgggcaatgtgcaaatcttatcccatttttttatgtttgtggctagtgtagacattagattctcgaacatattccttagggactgtcaaattttattccatcggatcaacatttaatagctgaagcacgctcatgtccaagcacatctctgactagaaaaggttcaggttttacagttctaaaaaaagctcaggcagctgatgattagctaaacaatcattgttggtccaatggacggatagaagggatggattaaacagggctgcaggaat

SEQ ID NO: 40105 - DNA, 1160 bp, Oryza sativa
acagtatatactgtggaggagggacatgtttttgcattatttcatctgatcatttgtctttccacccttgaaagttgtactaatttatcttgctaacaaacagtaagtgttcatcattgatccaggaaagaaagcacagtacctaaggcaccctcactggtccttgcctctctgcagctgctacaaccaaccaggagatatatgaacaggcaatgtattactgtgtccagacctattgccacttatgatgagaaacaaaaaactgcgtttcttcatgttccataacagtggatctgttagctagtaagaagcttatggcccttgcaacagtacacgttgttctcctgtattaccctgcctccaaaatttactgcaaacctgtcaagcacatttttaaaaactgctgtacatttctatcaacttcctagttctgaatcaaggtcatctcgtttgtattggagtttcaaaaggaaggaacaaaacttcctttgcttctcgattctctgtaaatgagcttgaattgcagttagcctgaaagtgtgaggtggagaaacaagaacccatcaacgtgaagcatgtgtttgaggcgatgacaagacacttatcctgtccattgcagctggtgttgattccgcgatggaaagctgctgcaaagcatctggtgatgtgtttttgggtaatctaactgccagtaatactatttgcaaacagtccatactgcatgcatatgcaggctttcagccacaggcatcttctctgcagcgtactacagtgtgcaagtaggcaatggcatcaaccagctttaacactgactcactggtactacgaaccaacacacacaatgctactcagcaacaaaagccagtagcttcagctaatcgcagcacaacacctcagtaatttttgctgcaataaacagtcgtttctgtgtctttgggaagcagctgcatgccttgatagttgttgctcaacttaacataatgctaaaactgaaagcagagaggagcatgcatggagttcctggtggtacatcagtcgacacgtcgcattcagcggtgaaacgccatgatttctcttttgtcactaactgcatgttttgctaagcaaatttatgccattcagacatcaatttatgccagctttttttttctttggtgtta

SEQ ID NO: 40106 - DNA, 873 bp, Oryza sativa
tctcagcaacccatggactatgcactcaaagaaactagtccatttcttggtggcggacaggttgttggaggccgggttatacgtgccgagaagcatgccagtacatatgacctagtggagcgaatgcagtatctttttgtacgtgtggttaaggcacgggacttgcctgacatggatgtcactggaagcctagatccttatgttgaagtgagagttggcaactacaggggtataactaggcactttgagaagcagaagaatccagagtggaatgcggtctttgctttttccagagaccgtatgcaggcaactatccttgaagttgttgtcaaagacaaggatttgctaaaagatgactttgttggtctggtgcgatttgatctgaatgatgttccgatgcgtgtgccccctgacagtccattggccccagaatggtaccgcctcgttcataaaactggggataagtcaagaggcgagctgatgcttgcagtttggatcggcacccaagccgatgaggcatttcctgacgcatggcattcagatgctgcaacacttgaggatccatctgctgtaacacacatgaagtctaaagtttaccatgctccaagactctggtacctgcgagtcaatataattgaggcccaagatattgccataactgataagacacgctatccagatgttttgtaagggcacaagtggggcatcagcacgggaggacaaaacctgttcaagctagaaatttcaacccattctggaatgaggatctaatgtttgtggctgctgaaccttttgaggatcaccttattctttcccttgaagatcgtgtagctcctaacaaagacgaggtgcttggccgtgtaattataccgt

SEQ ID NO: 40107 - DNA, 1771 bp, Oryza sativa
cgcccgggacggccgatcttatcctgcatccaatccgccgctcgctccctcgctcgcttatccacacaatactcccgcgcgcaacagtcaacacacacacgcgacgcgatggatggagataacacaactgtagtagtaacggatactgccacccttgacactgttgactttttaacacatgtttgaccgttcgtcttattaaaacatttataaaatatgtaaaactatatgtgtacgtaaaagtatatttagcagtgaatcaaatgatatgaaaagaataaataattacttaaattttttgaataagacgaatggttaaacacgtactaaaattttaacggtgtcaaatattttaaaacggagggagtagcaggagaaggctgcatgcctggcttcagtacctcaccgcaacggagccagagacgtcctgaaatctaggagtaatggcggcgtgactatcgctcgattcttcaattggctttccttggcatgcagggcacatatctgtgactgatgtgtggcccatgagactataagagcaagtttaattgtagagagtactgctagcttcaaatcatttattgtcaatctaatagttaattcatacaataattaactataaatatatactatatcattaataattggtcccacatgttatacatacaacatgtttgggagtttgtatcgcagctagttataaatctgtagtccgtttatcttctctttcctctcttatcttctccacataagcttgtagccgacttagggtgagtttgaggagaaggggattgagaagattgggaagatacgtaaaacgaggtaagccattagcgcatgattaattgagtattaactattttaaattttaaaaatggattaatatggttttttaaagcaactttcctatagaaatttttttaaaaaaatgcaccgtttagtagtttgggaagcgtgcgcgcggaatacgatgggctttctcacccaatcccccaggaacgaacgcacccttatagtctaatagagcaagtttaatattatagccaactattggctctaaatcatttaaagttaatttagtagccaattcatataatagttacctattttttggtctcatatgtgctgtagctggctataaatctgtagcccgctgctcttctatcttcatgctcttactgtacctgctctaacactgctcctcacctacggctggatccattccattccatcggtggatcggttgacaagttgatcattggattggacagcagccattattcacagaaaggatcgatggatgtgcataagatgcagcagcatgatacagagtgagagtggctcaccccccgacgggtgggcccggcgcaagcggggacgcaacttggacgtgtcgtgctctcgacggacgcctcgctagacatcgaccgccgcccgcgtcgacgtgattgcccccaagtggccgctgcgcgcacactcgagtcgatcgctggttggttgcacactcgctgcaaacgccagtaccactcctactactactctccgcggtagaaagagacgttgctttgcaatttggaatattattatcgctggcgggaggtagcaacatttctcgcttgtttgtgacctgtgagccatcgacactagctacgatcgcccgacgacccaagcagctagcttcccatcggtcaattcgttagatatcccatggtcctcttatactccatcgatccgtcgtaaaatatatggttaattagatccataccactat

SEQ ID NO: 40108 - DNA, 2673 bp, Oryza sativa
tcacccttttatttgcttgcttgatctaccacggcttctatacatcctccttgaaaaattttaaaattaaatctagtagtttttagagttcattatctcgttaggtttcgttcctatgattttagaaatcccgtcaaacgccattactatactactctataatcggtccactgcttcatcttttattgtcattgggatttaaaaaattgaacataattatcattgagtttaattatttttttactttgtagaagttttgccaaaccgtcagcgacttcgccactactcctctacagctcgcccgttgctacccctctttgttgttactgagagtttaaaaagcaaacatgattatcattgtgtgattttatttactttctaaatgtcccaccaacagccatgaccgtgctgttcaatggtctgcccgtcgtctcccctctcaaccatcattggaattctatttgggttttttttatagtccaccgctaccaccccatttctttacggggttattgcttctcccttctctattggttattgcttctcctttctctattgtaatttgtcatcgtttgtgttctaaatggattgttttttttaatgaaaattccatatttttcattccgatattttgttatttacaaattatattcctacttaaactcttatattttttattttttatttttgatttttaattaatctcgtgatgtattctatatggtttcttctctcaataatatttatttttatttcgaatttttagttatataaaaattgtacttttagttgaactcttatttttatttttctaatttagggatttaatttatttttattttgaattttaattaatgtcatatcgtgttttattttgaagtagatccgtgaatatcaaatattacatacaataagtaggctataattacatggacacactttttattttgcaaataccatatgtgaaactttcgaagactccgacctccgttgtactccccctatattttaatgtatgacgccgttgactttttgaccaacgtttgaccattcgttttattcaaattttttgtgcaaatattaaaatatttatgtcatgcttaaagaacatttgatgacgaatcaagtcacaataaaataaataataattacataaatgtttggaataagacgaatggttaaacgttggataaaaaatcaacggtgtcatacattaaaatatgaaatatgaaggtagtatgtgaaagcctgatatgtcaattggttagatttcttgtggtgaaacatgcatcttcaaattcattatattttaattgtaaaaaaaaatctttagagatggttactcttaaaattatcagattttttttgtcacggctaaaatgtaatgaatcttaatatgaattttcgcatatatgtgtagtactattagaaataactgtttatttttttctaattttttatgacatttgctagttggtgtgtgtgagaaacctatatgcatatttttcacttagacacaggagcggagctaggtaggatagggggtgcccaggaacccggttaagaaatttttttaagctatagttcatctattttcaccatatatgcacctccctcaatccaaatttaggcacttatatcagtctaaagtagagtaaaataagtgagtggcagctctcttcatttcgttctagctccgctcctgcttagacatactatctcgatataacaattcaaccaagtcttacgtgaactatgaaccgcccaacacaaaggttcatgagatatccgccgttggtggtcaggtgaggtgaggtgaggtgaagctttgggaagcatcaaccttgaaaaccaagaaaaggtcgtgggcgacagggcgagcgccataaatatctgaaaacatcttgtggagagctgacaggtgggacccgaggggaggtcccgatcggactgtagcgtgggggcggggatcgagtgggcgggtagcgacaggccaccgcccacccagcccatccgcgcgcgtggacgcaaaatggagtggcgcgcgccgaacgaaacggaagccgcagccagcaaattgcaaaggaaggcaaatcacaagcaaatccacccccgcgccgcgccgctcgcgctcggctccgccttttttccctttcgacgtcgttgggccaaggaaacggaaccaaatcttatcgcctccttgtgtgggcgccatccgtccctccgtccgctgcccatctctctctcacgctcgccgtcctcttgtgccttcttggcttgggtttgcctgcgcctgcgcgcgcttggcctagttgcatcgtctgcgttgcggctgctgcgatagcatgtaggccaaccgcgtcatcttatctctctctctctctctctccccccatcatttcatctgatctagtatctcatctcctcctcccctccttttccttctcccccaaccaactcactcttcatcttcaacaccttgctgttcgtcctcgtctcgtcgtgctgattgttcaagaacaggagaaagaaaggaagaagcagtttgattgatctgtttctgttggggggagctcggtgatccatgcatggatggcaaagaactcctctcaccgtccgaactgtcatactatgcgcaccagcagcatcagcatcagcatcatcagcatcagc

SEQ ID NO: 40109 - DNA, 5497 bp, Oryza sativa
cgccgtccgcgacgcccatggagccggtcaagaggaagcgaggccgcccgcgcaagtacggcccggacgggaccatgaaggtgtccaccgccgccgccgcgcagcaccagcagcagatgctgagcgcgccgccgaggatggggtccgtgtccggcgccgacatggttggcggcggctcagggatggacgactcggcgcagaagaagcggcgcgggcggccgccggggacagggaagaagcagcagctctcatcaccggttaagctttcaggtaagtgaatcaagtgacagtctttatatatgtagagagagggaaagcctctgctttgctctgcactgctctgccacgttgatatttatttaatctttagtggtagatttcctttttgtttgttttgtttactcaaatattgaattctgtcatccatgtgtactttacttagaaaagataaaaaaatatatcatgtgttgttatctttttcagaaaagaaaaacagtatagtattctgtgacttcctaattaattaacttagagaattgcataggcattcctcctacccaaaattgtcctgcaactctataataccaaaaaactttcagactaggaactgtcatgaccttgatgatcgtgtttgtgcttgtgcagggggcaatgcgttcagtggctcagctggaacgagcttcacccctcacatcatcacggcatctccttcagaggtaaataaaaatactcatagctcattcaccgttactacaattttttcatcagcagaaaatgcagagctgcatgcaaactgagaggggaggtaaaactgaactgagctgacaggcgacattgatcattgtcaggacgttgcagggaagatcgtggcgttcgccaaccattcgtccagggcggtgtgcgtgctctcggccaccggctccgtctcccgggtggtcctccgccacccggccgacggcgccatgtcaagggttcacgcctcctcccactacaagaaccctgccatctacgaggtataacaactaattggttggtgcaatgcaatcttggtaagtttaattcagagttgcatgtgacaggagtggatttgatgtttgtgtgtgcattgtggcaggggctgtacgagatcttgagcatgtcggggtgttacaacctgatgaacgaggggcagagcgacgggctgagcgtgacgctgtgcagccccgagaggcatatcattggaggcgttctcggcggagcattggtagctgccagcaccgttcaggtaaccaacccaatgttttaaatagcgggctaagacatttagcggttagcttctcaagcagctatagcagctaaattgtatatgagagcaaatagctataacccttctcaaacagctatagcgggagatttaaaaccctgaaccaacctcatcttttctttttctcctctcctagatggctagatcatcttcatcatcaagattatagtagcattgtctggttgcaaatgtactcactccattaaggccttctttggaagggatgattacatgattcctacaaaattcctcttttccaatcaaagggattctgagttttgatcagaaatgggattcaattctagcattgatcttggtctaacctggggtactcattggcacttgcaggtggtacttgggagtttcgtgcagggagggtcgaagcccaagtcgaagaaggccgggaaacagcagcagcaacaggcggcggcggcggccttcagctcggactcgctgaccggaggagggcaggacgcgtcgccgagctccggccataaccaaaatctaacgccgccgccccctgtaacaacgacgggagggtggcctagctccgggatatttgacacgagaagttccaacattgatatcaactcatctagaggctagcttcatctctcaatttgtcgactcttccatatgtgctccagaaatttgtttttctgattcccaaagaattacccccaaaattgtactcctctctgtaatagcctgttcagtttttgagccgttaattcttatagattattattattcactaggcaacgttgcattcatgcatgcatgcatgctcagagttgtgtaatcccaacaggataatcttgcttttctttcagcgacatgtgctactgcccaacctgtacattcagatttccttcactacctttatattctttctcactacacagatacagagcatcatcattgtaggttcctcttcacagaaattgcaaacagattgtagtagcagcaacaacaggacgatgcatcatctttcatggagtgagctctaagcccctagcaggttcttgatgtcattctgcagaaacaaccattgactgatgagtaatcatgcctgtgaagctatataataaaatgaaaacgaacactgttttgtttcatcacctcaatgctcaatggggagctggttggtgcataacggttcaccacatgaccctctttgtcaaccagaaatttggtgaagttccatttgatgcgttctccgaagaggccacctctctctgacttcaagaacttgtacagtggagcagcattgccgccattcacatcaacctgtttgacaactcgggcgcgttgattttagaccgaaacaacaaataattggatatggttttggaagctagcactggaagaaaagattgccattggttggacctgccaaggataggatactctgctttgaagcgggtacaagcaaactccacaacctgctcattgctgcctggctcggtggctcctgtcctgcaaattgattgcatgggaacgccaatatctccaatcctaattgcacaagaaaaaggggaaatacaaagcaattgaggtcattgtagactgtcaacggacagcgttatgctctcataaattacaattgaggtgtcaaggggaaactgaaagatttgatgcaatttaactggacggcagaggaaacgataagagagtgaatactttcttcagagtaaaagcaataacagcagtacggtattatacagctgcccagtgcccacagataaaagtctaaaaatgttattaaaaaaaccgatactgaaaaatgagcactggtcaagattcaagaaatttgcagcgatttctccaaaagtacttcataaaggtattcgcgtgacttcagagccgagttgcaacaaacgtactgtcatataggtaaacaactagtacctgtctccttgtatttcccatataactgaccaagttcagtgtagttgtaattcgtcagaccactgcagagatatcatcagatcaggtgggaaagtacaaactctcattagacaatttcgaatgaaaatgtaaagaccaataccatcgagatgcagcattcacaataagaacaacttttcccttgtatctgctgagttccacatcactccccctcgcatcctgcagaattattccacagaccgttatttaaacacgacgaaatgaaatcaaagttggatgaatgggaatagagaccctgtcattgaaaaactccatctcttgttcttgtattatcaattttcaaatagcccgattgcattggttcacagacacttcaacgtggcttcttcaaaatttcccataaaacctctcaacatgcttgataaaaaataagaataaataattctagagaaatggaaggagggacaggcgctcaacagaccttcacagtgaattcatggatggagccagcgagctttgaagatgactcagctgctcccatatttgctttcagcaacactgaagtgctctcctggacaagccactggaagaaggattggagaagaatgcaaagagacaatgaaggaacaaaaagaagtgtgacaactggcaactagcaccacgagatttatttctgcattttatcagacatttcgtttgagaattctccccttttttccagtccaaatgttttccacagatgctaatgccaaccacaaaatatgtaaaacatgataattgaatgggccatttctaaagcacatgtatctctatataacgctactatacaagtagacaaaatattgtgtccatcaacgctacaacacagaagccattcctatcaccagtttctgggcattctcaaagtatacagcggaaatcacaatataatcataatggagagtcggagatatcatacagtgtgtaaagctatcaatcaatgctgaatgttcagctgttcaacaacaggtacaaattgaacgcttagcacagctttctaattagccacaaaatatcatcaccctttctacctatccgatcaatcaacaaaaattaggcagaaaaaatatcttgtatgatgatcagtagtcaccctttccagagaatggttcatgacaacatatatgcaggcatacaacagaaaccaagcaagcaagattttaaagtactatatattgggcaactagatatttaaaatgaccagtacaactccaaaatctgatagttcacaagaagccttaaacacattattccctgcattcagaagctaatacgatatacaggctctcaagtactaagaacacacagttacaataacaacaaaacgaagccagactacagtaatcggcatggagtactccatccaatttatcacaatgataaggccaccagatggcagctattttatagcatgctgtcggtccttgctggcagtcgtctgaagaaattcactggcgttgaaggcaacctatatctgaacctcgggtgcctcatgacatagaaccctgccaatgctgcaagaacttggagtggtgtaacatacaggactattgctgctatgagacaaaagaggacaaatattgctgtggcccgaggatccctccagctaagcagtgcttgaaccctctccccttgagttgctatatcacctaccacagtctgtattcttccagcaacactcctcagcctatcatacctcatcctaataacatcaggactcctgcttgttgggaatgtatcgaactcttcgtcaagttcatctgggtggacagcctccgcatgagagatcttagtgttcatgtgtggaggatagcaaggtcggtaacgatagttccaaacccctataagaaacatgtataagaacactgttgggagtatgagctctggaaagcacaccaacattataaataggatgtgaaccagcacagtggtaatggggttcctccatgaacacacaccattaaaccacttgctaactgcaaacaagcctgagaagactgacatgagcctgaagaagttggctttgcttcgtctcatgctccacaagtgagaatcaacatctgacatgtactcaacaacttcctttctcagaggtggttccatccggctaagtcgggcagacacaatctggacagcttgatggcgcagcatgtcaacctgacggaccggtattgggcgtacatagtgcatctttggtagcaaaggtcgagagtacaggtacatcatgtttactgggctgcagga

SEQ ID NO: 40110 - DNA, 7074 bp, Oryza sativa
agacccagttcccctttcacacgtgagaacatcccacgcttctccagtggataatgcatgacaaccgcatcagggaatggcacgaatgaggttccagcaattctgaccttgccaaggaaggaccttgaaccatcaatggatctgttgatgttgtagacgtacgcttcaagcgcaagctcaggaagattagacggatccgaaacgttgaagtagaagcgctcattccacactgggttcagatccttgtccttgatagccgtgcggaaccgctggccatcaaacgtaagctcgacacaggcacttgctgaaccttgcccatccttgggcatcaggtcatgagcacttgcaacctccacacccaacttatatgccgccattgcctccgaaaatgatgttatttgctacaccactctgtacaaaacagaaacatctgttagcaccattgattagaagcaggacttatgaacctgatgatgcagtcatagaacatctgtagcatcaacaagggaaaaacaacaatttttcataacagatgcaggtgaacaaaaaataaaaatcaaacttgatttacacataaaaaaactacaaatcttttccattcgacaaaagcgcaaaaagaaacgcttctagtagtatgatgggcgaaggagatactgtagcatgtcaacatcaaatggagaaatccacaaactaatactagatccccagggaccataagctcgcagtaagtgctaatgctactcgctgacagcgatggttctggagatcaaaccgacggcgacgcatacataaactactagtacaatttcgtattactacagtctacagggagatgctagtatatgcataccgattcaaaccgagatggaggcagattgaagaagctcgccgcccctcaaaaccttctcgccggccgtgcgccgaggcgcgaggaggggaggaggcgctcaacactgtttggctagcgcctactgggccttgtccccaaccgggcgcggcgagctatagcaccgccagattggagaagacggttgaagagagacccagatccgggcgaaacccgggaccaaatggtgaaatccgggcggctggctggctgcttcactccggtgctgccatggcgtcgacgaggaaggaggtgcagggtgggtcgggggaggagaggggagggaggcgtttctcttccctctctgggggttttgggtgggagagaaagcgaacgcgtcgcggagaagagacgagaatggcacacaactgatacacctacactcttgtttgtttcagaaagcgagtaaaagaagcaatgaaggaattgatggaagagttcggtttcgaaaaaaaattcaaagggaagaagctgtagaaggggccaaaaatgtatatttttttaaaaaaaagaacaatcctaggagcggagaggagcgcggcggtggaggtggaggcgaggcgcacgtgggacgtcacatgccgacgcgcgccggggccgggccgaggcaccgacggaaacgcaaaaccaaacgaggtcaaagtcgcaccactcgcaacgtcacgactcacgcgtccatccatcacgattcgcgaggagcagccggctgctgccgccagcagcgacggccgcgccgcgctgccggttttgcggtgcggtgcgcgcggatcgatgggccgaaacgctagccaggcaggccgcgcgctcggtgcggttgcggttgcggaggcgcaacgcgcccgcagattgatgggccgatggtcgcgctggattctccgggccggtaatcgctacaagtacatgcgggccggtgggcctatggtgttggcatgtccgagaattattattgcggatcgcgtagcagccaggggttggtcgtcccgttcccgtacgtacgtccgcctcaccacactggttccggttcgtgtctttaaccgatgaccgccgtcacgcgccgcgcggctggactgaatagtaggagtcgcctcgccgaccgggggtcatgtatgtatcagtatctttgccttttccctctcctaggggccaaattcaaccacttgtggtctctcttctcagaggcaggatgacccggccttggcctgacagaaaacaaataagggctcaaaagcaacagcacattaagcttagtataaagaaactagtactgttacgtatcctgtcttcaaatatgatggtatttcagggtgcccacgatataactggtgcaattaatttcaaccatgcgagagaggttaactatctccatcatgtctgggctcgccatggccgcaaatatggcacttttactttgcagtttccacgcacctgctgtaacttctctaactagctaggtcaaaaatcacgttgcttattgcccaagacaccatccctgataataacactcggggacaagaagatcttccattattctgggcgtgtttagttccaaagtttttttttcaaacttctaactttccatcacctcaaatcttttatacacacacaacttcagtcacattgtcttcaattttaactaaattttaaactttaggccaatctaaacacagcctctatcacatccggtggttaatttgatacagtttgattgaagcgccgtggcctcacggtaacgcgcgagaaccagcaagttaacaaccgatcgagacgcgtacgtgcacagccgggatactactattttgcgagcaagcgagcattcatgcatgtatggtactcaactcaaatagcaacgcccccgcaacagtacaaatcaacgccacgcacgtcgccatatcctaacagaagagaatcatagctgcagccgggggccagcacgaagatatatatccggtgcacacacgcacggttttttgcgatgcgatgtcgtcacctatcccatcaaaggggttcaattcaacaacctaccaaccaacctagagtggctacgaatcgagattgcatatgctgcatagagcgcgcgaaggaatgagaggctgcacgcaggtcgcaggtgcatctggtggaggggcagcctgcatatatgaccgggcgactagcgagccagattgcaggccgggccccggcaaatcacgaccgcacgggcgtcggctcgatcgtaatcgcggacatcgtcttacgcgcgcaagtggcgtgagttcagatgttcaattcaccgagtcatttggctgaataatatttactccagtctccaccagcagcttgaacgcacgcacgcacgcgtgaccgcctgagcgcggaagtgtcgacatgcacactatgtacacctcctactctctcggctacttgcgcgacagcgtccacggcccgccgctccgcaaacttggggcttatttggattgctacgatgccaatttttttttggtagtgtcacttgttaccaatataagccaacattcgaattctggttaagattgttctaaattaatgtgaaatctaatatgggcattactaataaatctatctattatattattaaaacagctttaaaaggaggctccacgttcactgtgggggctagaaattcccacattaatcagagaaaaagagaaaaatattagccattggattaaaatagatctagattaatggttgtgatttaatatgagtctacatattttatggaaacaaaagactcggaaacagcatcaataaaccaaaccggaaccaaccagactccagtctgatttttggaagcttggaagctcaggaaccaagccggaatataaaatccaaaattagcaaaagaaaaaaaaaagaagaagagttcaagtaggaatacaatttaaaattagctgaaattcagaattaaaaataaacactgttaagattaattaaaatttagaataaaaaataaaataatatccaaaattagaaaaaataaaagagagttcaagtaggaatataattttgaaacaactaaaattgaaaataaaaaataaaaatattaaaagaacacgatacgatattatttattttttaaaaaaaaataaattcttaaattagaaaaagaagaaaaataatatttcaattaggaatacaatttataaataactgaaaaatgtgataaaaataaagactatcgaaagaaaaaaccatctaaaacacatgacgagataatttaagtaacaagcctataaaagagtagagtggtggcggttgatacgacatataaaaactgttaataaaacaccaaatagaacactaatgatgattaaaaggaagaacgacaggcaggccagcaaacgagcaaggcgattgtcgggacttctagaaagcaaaaaagataaaccccattgataatcatattcgatttttaaaatatcaatgacaataaaaaggagaagcagcgggcggggtgtataggagtatagttgcaaagccgctgacggttaacgggacttatagaaaataaaaaatggattccaacgatagttatgttcgacttttagaatcacaatgacaataaagagtaggcggcggatgagccgtagaggagaatagtggcatcgtttaacgagacttctagaaattataaaaaatgaaacccaacaacacagtaaactctaaaaactataaggttcaatttttaaaggttcggaacttccaaaaagtaaaaaaaaattataatcatgttcgattttaaaatatcaatgataataaagaagggaggcagcgggcaagccgtagagaaatacaaggcaaagccgctgacggtttggcgggacttctagaaagtaaaaatgaatccaaacggtaattatgttcgatttttaaaatctcaatgacaataaagagaagatacagtggacgggccatagaggagtataatagcaacgtttgacgaaacgtctagaaattataaaaatgaatccaacgtgacaataaactctaaaaagtacaagatccaaactttaaaggttccaaggagaatgaatagaaatagtgataaatcttgcaagcaaataaagaaggagatgacataggggtagcaactggtgtgacttttaaaaaactatataattagaaacacgtagatgataaggtttggtctttcaaacttggtctttcaaactcttaagacaataagatagctatttaataaaatttaagtaaaattatataaaaaatatatgattttgtttaggtgatagccgcgcaatcgctagttgatttcaatccaaaccaaacatagagagcgactcgcatcagccgctctatgatgcgtgtttccccggttcccgcctgtccaagcgcgccctcgcctcgcctcgcctcgcctcgatcgcacagtcgctcgctcgtacgcggcgccgcttgcttgcctggttggtctttccatttcgatcgaaacattggctggccggctgcccgggctcgacacgtcttatcaccgttacgtcccccgctactatacaactgcgcttaaatcacagccgctactaatcaattgtttcaatgatagttgtatttaaagaagtagtataagtactaactgagctgagttgatatggacgtcgagcttgttggcaccttacaatttggcaccttacaatttctgttaatttgtctccttatttatagtttataattattatagttctaacggacaagtgagagagagagagagagagagagagagagaggaatatcctcgatcgagtatattctagtagatctctctagtcatacacggtcacggtgtcgatagcttttgcttctagtattacgctctgggttaccgtcggtggaaacggacgcggattaatcaatcagtttgagcgtttccacacgcactttgagccacaaataaccggccgggtcgacgtttggctgaccaccggctgctgctgcatactgagcacgatcgactcgtcctgttttcttagctttatatccaaaagaaaaggaatttagaactgcatcagctgcgcgcactcgtgacgcttgcaatgcccagttggatgggcatataaaaatgctggcttttcccccttgaacaccgtgagagataacataaaccgcacaagacaagaatcccggacacgtaagaaaggaaacactccaacttaattattttccagccttttgcgttctcttcggtgccaaacagtagcaagtgattctctgcctcccagcgaggcctaaaaaaagacagtagtttcgttgaagaaacaacaaaaaagactcggcgcagtggtggacagggagaatatcatatcacagaaaaatgtttaatcaaaaggattttgtgtcgtattaggatcaaaatgtttaatctatgcgtccacgtgcaacagttgtggggtccagcaggaagacactcgtcgctacgacacgaaccctcgaaaaaaaaagaaataaagaaagaaaaaggcctcccatcgtcaacacgcacacacctggtgcaatgcaaggaggcaaagcaaaggccaaacatccaaatttgattttggttgtgagctgagctccagtaaacctcactatcagagcacagcaataatccgtggctgacgaagcagaggcccaaacgcgaagcagaggagggcctttcggttttccgcgcctatataaaccccacacggccaaacggtttgagaggcgccaaacacacgacacgttctccccacacacacaaaccaacgcgacgcacgagagatttgtacgtgaagcacctgcagcgggcgacccaatggagaccccgactctgaccacgctgctcaaggcggcggtggccacgttcccctcgcgccgcgccctcgccgtcccgggcaaggtcgacctgtcgcacgcggcgctcgacgcgctcgtcgacgccgcggccgcgcgcctcgccgccgatgcgggcgtgctccccggccacgtcgtcgcgctcgccttccccaacaccgtcgaggtaaagcaccagtcacagaagctgttgatatcacggtgacgatcatcgagctgctgatgctgatctggttcttgtgtgtttttgcagctggtgatcatgttcttggcggtgatccgagcgcgcgcggtggcggcgccgctgaacccggcgtacacgcaggaggagttcgagttctacc

SEQ ID NO: 40111 - DNA, 2794 bp, Oryza sativa
ttcctgcagcccgcccaagggcgtgccgctcacgcagcgcaacctggcggcgtccgtccagaacatccgcgccgtgtaccgcctcaccgaggcggacgcgacggtgatcgtgctcccgctcttccacgtccacggcctcctctgcggcctcctcgcctccctggcgtccggcgcgtccgtgacgctcccggcggcggggcgcttctcggcgtccaccttctgggccgacatgcgcggcgccggcgcgacgtggtacacggcggtgccgacgatccaccagatcatcatcgaccggcacacctcgaagccggaggcggagtacccggcgctgcggttcatccgcagctgcagcgcgtcgctggcgccggcgatcatggagaagctggaggcggcgttcggggcgccggtggtggaggcgtacgcgatgacggaggcgtcgcacctgatgacgtcgaacccgctgccggaggacggggcgaggaaggccgggtcggtggggcgcgcggtgggtcaggagatggcgatcctggacgaggaagggcggcgggtggaggccgggaagagcggcgaggtgtgcgtgcgcggcgccaacgtgacgagcgggtacaaggggaacccggaggcgaacgaggcggcgttccggttcgggtggttccacaccggcgacatcggcgtcgtggacgaggaggggtacctgcggctggtggggcggatcaaggagctgatcaaccgcggcggcgagaagatatcgccgatcgaggtggactcggtgctgctcgggcacccggccatcgcgcaggccgtggcgttcggggtgcccgacgccaagtacggggaggagatcaactgcgcggtgatcccccgggagggcgtgtcgctcggggaagaggaggtgctggcctactgccggaggaacctggccgcgttcaaggtgcccaagaaggtgtacatcgccgacgagcttcccaagacggccaccggcaagatccagcgccgcatcgtcgcgcagcacttcgtcgtgccggtgctgcccaccaaggcgtaataaaagtctctacctcccgaccaacccatcgcatgccatcgtcctactgtatctatcaagttcgtgtcttgatttgattttttctggttacttcggctacaaccagtagcttcgtttagggttgggtttcccgtgctaacgagtagtaaaatttcggtttcccgtcctttcgtacgtgttgaattgttgttattacttctcaccggccaaactgattgtacgtgttggtcatattatcgtcgtcgtttttccacccgtgagcgcgtgcccacagcacagcacagtggtcgtccaacttttaccagtcgatcgagtcgagaggaaaagaaaagagaaaaagaaggcgcgggttcgtggcatattctagaacgcaggtggatactggatacataccaccggttgctgcgttcgtcagcagaggtcaggcacctctcgctcgctgatttggtggttcagttgttggggacaacgacgtgcatttccacgtcaatggaccttatcgcggagtcgtttctggttttttgcaacaaaaaatcgtcagggatgacgtgccgcggcgccgctgccactcgcccactgtgccggccagtggcgacggcgacgtttcctcaaagtcacaaactgatcgatcaatcgatcaacgatccaacgatcacccttgctttccggatttgagaaacgacggaggaaggtagggccccaccaacgtggtgtcccacagtagggaagtgacgtttggtgggtcagtgggtgccggcgcccacaaaacacccatctctcggcgtctccgcagcgcaatcgacaatcgagaactgatggaggagcgctcctacgtatccctgtagcgaatcccagccacagcccacgcaagcccacaaggccacagggaaggaggtggccgaaaatctcgatagagctcgacccgtgcagcctccaaaaccacgggaaaaatacgcgatcaaaaccacgagaaatccgcgatcgcccggcgctcggcgaagctggggtctcccttggcttcccctccacgacccctggaaccggacgcgtgcgcgtccctgcgccttgccccaacctgtgattcgcgtagttgcctggaattctcaatccatctctgtggatgttatcaggattgcagcatgccaagttggaggaaacgcagcacagaaacctgacataatattcggatagaaaaatgatgccgattccaacaatccaagacaattccaaactccgtgcagcacgcagcatacactacggagtaggagcctagaacgaaaactgtcggatgcgatatcatttgtacgtgtcagtcgagaaattccatatttaccaatttaatttttcgagtggtaatcgcaatacgatgataagagaactaggaaaacagtttcaatattcatacgcggtgatgatcagaaacgatcgaaaaccgtacagagccaattgggaatttccatgccggttttcatcctaataggttgcaccacaaacttacacatgtatgccagcagaggcgaacaaaggaatttcgttagaccggtgaggcattgaagaaacacctgctgtgcaataccggcaatcaactgtaaatcatacagcattatgagtcaaaaacagtcaatacagtatcacgaccaaactgaactagtgcctgcctgctcgtgcgtctcagctcctctatattccgagcatgcaatggccatgatcagataaatattagtgtgtgatgtgacggacgaatttaca

SEQ ID NO: 40112 - DNA, 6679 bp, Oryza sativa
cagggtcccgtttgatgcgtattcaaacactagcatcctggagaatgggtcactttctctgcaatagcccagaaattttgctatgttctcatgattcaaccttgccaggtcaataacctaaaatttacacccattaatattgtgggacaacatactgttctcacagcagaattttgctaagctttaccttgttttggtaaaatagttcatgttggctagtccaatgaccttcaaaggcacataatgatatgacagaaacctcaggtccatccttcatggttcctttgtacactactgtctcaggagatgaaccaataatgttgctaaaatcctcacaagctacttcaagctcttggcgacttaactttggcaggcttttcagcatatcagaatctggtgagagcattaagatattaacagcactattcaaatcatatcaattaattaaccgataacagcactaaccgatcagcactgttatctcatcactccaactttttgatctgttccacgaggatattcttatcgatggctttagcttgcaacttctggaagcagtaattgcaccagtgatcacaaatacaagcagaagaataccagttgaaatttctaaaatgagaagccatgttggttgtggtgatctttcatgtttatggtcagaggtgggatgcttgaatccctttacgccacctcgctggccagccggagaaccacctaagacaaaatgagtggattcagccaatatcagtacatggtgttatcgactagttacccaacaatactcaaatagtaaagaaatgcaatcaatttaattggtgtgcaaaatttcagtgtggtgttttgcgtcaggtccccacatcaggaattgcttaaagtttagcttaaattcaatattggcctctttgctttaagttttgtcactttttttttaaaaaaataaagacggaaaaatgaagcacatcaattgtcttatcatgttgaccatgcaaagatcaagtgggctatcttggccttctattgattgctaaataaagcagtgaaactgtaaaggtagagggctatactgaatgcagataaaaggggatacttctgcttatcatgacacggataaattttgcaagtgtaggcctgtaggatatcaatcacaacaccacttgcaggtacatcgtgaaattccaatagaaggatatcactttaatgcatgctgaagtaatcctgttaatgttttttttttggtgggtggggggaggggggcgtaatcctgttaatgctagaaggaaaaatacatacttatacaaatttggaaagcccgctgccggacagagtactcatcctgtaagcagttcccttggaaacttgacctgcagacaagccatgtaaatggatggaccttaaagcagtagcaaacacactgtatggtactaccttggaagatacttcaagcacggtgggatttttccaacaagaaagttgtatgagaaatctccaacatttaatcgaggagaagggcatagcccattgtgagccgtggatctggtggagtaaaataaaatcgattcagataattaacaaaaagataataaaacatggtcaaatataagttttttgcaggctcactgccagatgtcatcaagagagaatataataaagaagctgcatgcacaaagttactaaggctcccatcggatggcctaataagccaaagaaaaagccaaattttaaattttcaaacttaattttgagattgattttgagttattttcaacgtagttttttttttcagcattggcttttaagtcaccaagaacacacatataaaagttttacctacaaatttaattttattccgttttggcttattagggaaaaagccaaacgatggggccttaagtaaccaccacttgatacctagtcttatcctttttactgtcaccaaaatttactgccaaattaactagtatgtaagaacgaatgttttttaagagggacacacaaatacaatcgccatgatatcatagctgcggtgttcagttcatgaataaaatggtttgactatggcatggatatccagaaatatagacatagaatacaagagcacaggaacctgaagggaattaagtgacatttttatggtttaatatatatagaaaatgcatctacagtcttgatcatcaaataaaaatggagtaaggagaagtcaccaacccactattggccgtaggagaaaaaccagaaccattgcttccaggaattgatccttgcagtctatttctgtccaacctcagctgaacaagattctgtagcttgcccagctctgaaggtatattcccagtcaacccattggaatgaaagtttctacagcagatgaatgaaagcagccttagtttcaatagcaaagaagcaccagagacaggaaaaccctgaatatataagcaaatcaattggcatcttacattacgcttacgctgctcaatccagccagctcaggaggtataggaccagtaagcctattaacacccaaatccaagaccctaaggttcctcagtgaacctagctgtttcggaattgtcccaaaaagatgttgcgatccaaatacctgcccaaaaaggagaccttcagaaaccttgaagctaattcatcataaccagttgaaaaaacaataaaacagaacatacagctcttgcaagaagctcagctgtccaagttcaggcgcgataaatcccttcagcgacgagtttgacagcttcctgcaaggtgcggaatcatcgagtcatgacacatgagaagaaattccatcccagaaggattttgactgatcacgcaagtacgggttttagttggcgtttcattgcaaacaaaatctactgactacatatctaaatggcacatcatactccattatttccagctgtttgcacatgcaatatgcgtctatgtcaaacatatacagcattgtacagctccaacgataagctagtggcagtgcttatagtatcaaacaagtcttcacctacaaaattgtagtacctgctaatgtaaacattaataaatcaccataacaaactcttttccctccccactttatgtacacagtaatgttgaacaggatttgatattaccggctagtaagtaccacagtagtaactagtaaagcagtaggtgaaacattagtgagatctagctgagtgcaggtgcaaggggggggggggggtttcttacagggagatcacggagccctgcggcgaggagcagatcaccccgtgccagtcgcaggcgttcccgtccgcatcgctccagtccgcgagcgccgaccgggggtcctcgatgattgcgcgcttgaacgcgatgagcgccgagactagcacaaggcgtagcaaagcgcgtgtgagcagaacgccacatttctcatggaggaacagaacgagagtgtacgagacacagcaaaaccgttggtcacagatcagaaatgcaccatagaaatggaggtggaattcgagttttaggcacgaaatttcgcggataaatctcgaaatttgcatcgcctccaccgagtaacaggtggaaatttcgaagaagatagatcagaaccaaaaatctgaacagccatttcaaactcggtaaaaaaatgtaaaaaaaaaacccgtaaaacgtctcccagaaatggaattcacaggcagtgcataattagaaaaaacaccacgaattcaaacaaaactccctaaaatccgaccaaaaaaaacaggaaagaaaaacaccaagtcagtggaagaacacacatacacggcgcaaccgcgcaagcgacaacactcaccgtcactgcccaacgcattcgccgagcactgcaacaccaccaccaccaccccgcactgcaacgcgaggaggagccggaggacggaggaagcaccgccccaacaatgcctcatctccgaacgccgccgcagctgcagcaccgcctccgaatcactcactcgagcactacactcccccctctctcagagatcgcacgtcctcgcgcgaattcacggcgccatggctaccgctccgattcctcgctgctgctccggcctcagcaccacatggagatggagatggaggtgggttggttgtttggggagtgtgagcagttgagtaaaagagagagccgagcactggaagaagaagaagaagatgcagagagagagagagagagagagagagagagggagacgagggcgtagagagagaaagaggaggaagcgaggagaatgttgggctaatttagtgcgagcaattaaaatggcaagggtggggggaggcggtggccgattagttatcacgcgcactattaatttgtcaattaagtaccactcaattaattaacaaattacccccaccacttactgagtattagcattagtgttagagattaagcatctcaaaagaaaatttaggggttagggagcatcttcctttctattttaagactagccactggttatagaatgtcattagcagcatttttttgatctgctcttgtgctgtttgcagtgtctcttaactctctttgcctatatattttttaacttctttaggagaagcttattttggggttcttcagaaatgggtgtggtgtttctgaccgttcaacgctgtgtcctccctttgttttttcatgtggtccctccattttctctgcgttcttggattctctcttaattacagtgcggtgacttagcaagatataataaaaaaggtcatgttatttttacagcatatggtgtgataactaggctacaacagatttaatattgggtaacacaaaaacaataccgttagctgaaatactgttaagaacttaagatggtttatattgctagaatgctgctgctacatggtacatcttggacgtgtgtttaagtcatgctctttttagtttattcactaaattactaaacatagtatttactctacgctttgaaaattcattttcttaaaaaaacttagataacttattttaattttttttacaaaaaataatttatcgctataatagaacatataatccgctgtaataataccgagccttagattttttgtaaacagaggaaggataaggatgagacgtagctgctgcagtaatagcggtggagggagtgaagacagctcggcagtttcagtaattagtttgtcttgactcttgtcctcttgcacttggacttatatactccatgttcttcatgtctcttcttctaattcgaatgcatggtcgtgttgcagaaaagaaaaatctcagttcagaaattattggttgacaatggcatcgatcagccgctgaaagagaattggaaacaaattaagtaacagtggcttttttttttgtttggtagtcacctgcaaatttgggtccaggttgttgcctactatcacaccatggtcctgctgcttgcatggcagccatggttaatctcatgagacaccacaatttttggtaggatcgatcgaatccaattccaattctgcatatatggtttgcaaatcaagggacccactcttaacgttaatctcaacgtatcagaaatgggtgaaacgaaaggagccttacagctaataatgttcacgtgcaattcaagattcagacagcttccaaagaagagaaaagattcaggctgtgtttagatctaaaatttagatccaaacttcagttcttttccatcacatcaacctgtcatatacacacaacttttcagtcacatcatcttcaatttcaaccaaaatctaaactttgcgctgaactaaacacagcctcagtcacactcttgattataacatcgtagttcagacagttcagtttgttgtagcacactgcacacgcaaccctcttcagaggccataacgtagcaaagctgtaactgcagaaatgagatagtagtaagatgcactgaatattcagagtgagcatatcatattatcatatcatcctttctgccagccaagatcgtgtaaaaataggagctgagattgcaaatcctttttgccacttggtggcttgggagtccagcaacaggcaacagatcaaggagagaagaaaaacatcgcattcagcaaggccaagaagcgtacacgacatgcatggtacgaggagagcaaacagacacctcaattttatgaagatgtgtctacagacggggctgcatcgcatggcaatcgaacgtgacagcatgagagaaaggacactgtcaaaaccactatgtttaggcaggcagtgtatagtagtatagaatggcacaggaggtgaagggtaaagttttcattgaactcggtcaattacatccaaatgatacaattgttcttataacgcttccaggtctctgcatagtatgcacacagtcgattgtgtggaccagcaatggtgactgcaggcaatcaacttcttgcaccgaaagagagctagcagcgaaatgagaaaacggaggcattgattcaaggtcatcaactatagaacagttctttctttggtgcatttaaatatggagggacaagtagattataggagtattgttgcagcgtcaaggaagaaagacctgccccaattgttgctaggacctactactgtacttcaaaattcttctttctttctttctttttttctttcggtctgtatgattctctagtcaatttattatactgcattgtactaata

SEQ ID NO: 40113 - DNA, 7875 bp, Oryza sativa
aaagcagtttgtagttaatgagaaaggaaagagtgagatgataaacaaaggagagaaggaaaggaaggtttggttctttgtcattgtcaatatgttagttaattacaaccatttcttcagacatagctccgggtttcaagagttttagtcagtcattaagtcatacctatattctacatgacaaaatgaaatttggtgattcataagcgaaaattcggaaacatgtttgcactccattcagcaaacgcctaaaggctaaagtcaatctatataacatatatacttgcaaaatttccaattgacacttgtcaagtagacgatccacttaaaagtttaattgggccggcacgagtaaggccacccttttcatttctctcacacctcagagaaaagcaagaactgaatatatgttagtttaacttatcctagtttcgactatacagaagatagtggtgtgaattgaagcttaagcaagtacattacttgaggagctcctaagcaagtgggtctttgaggaatccagcaacaacaaactcctctacaatctgtctcaccgcactataccactacacccacaatgccactgccattgccaaatactctctttacttacaagtgaaggttttcaacataacaaacaaacaaacaaaaaagaaatctcaagatcttcttcttctctttgtaacttgatcattagagcgagttctaggaaattcaggccagatgaactgatgaacttactggctgacaacgccattactagtagatgtttggactttgtacccagaagtaaaagaccttgctgctgtactgctctcacttgtgtcctggttttgttagctgttggtgcaggcttagatgagtgcaggacggtgaggactcactggactaaagacaaaagcgagagagggccattacccattgaatgctccttagatcatacactagcacagatgtaaagttgccaggccatatatgtatgtctacatctgcacattttccccaatcatttcggcattttgctctccatttcttcagtgcagagatcatctttttttttcagtacagaaagaaatttacacttgatcttgtgaattttaatacactcggttgatcaatcccagcctctgtttttcgccgtgatgattctctaccctaacacgcgttttcttctctctttttttttctctcctgtttaggttggtccaagcttcgcttttatgaaaagagatttgttcgttggatgctccagatcagagcagttcagctgcgctggtcagctcttaatatcccaggccactctgctctctgcactgcagcagctacgaattcaggccagtagatagtactccgtgcaactgcctgccgtgtactacgtgcaggcagctaatgcctgactgcttagcgactctaatcattggatccattcagaaaacacgcagaaaaaggagacggggagatcatccgttccaatcatgcgtgttggcctttgcgatggcagcgtcacgagattcacgacggcgagcgatgagtcgctgactccggcggcaacgacgatctggaaggtgattgggctagagtgggaaattatgtaggtttccgacgggaactgaactatatatctgacgaaattcatgtggaattctagtgttttaacataactacaaatgtgaaacatcatctgaataatggctagaaatgttttaaaaaaatgacatacagtaaaaggaaaggttgggccgttgataggcaaactgtaatttagtagtatcaacctaacatccattgataggcaaactgtaatttagtagtatcaacctaacatccagcatttcagattttcagtgggtctccgtaccaaaatgagaccttgtctaagtctaaatgagactttaatttacccccttacaaatttgagcaagacagcatgagttatccatatcttaacctaataacgccaaaagttttgtaggtttgttacagtgacagcttgtacagtagttcagagctgcatcggctgaagagcatacattttctgaacaaattcagagttaacacacctcaacactaaaactagcactgaaaacatcattctgggggaactcaaagagccatttgggggttaatctcaccgtgaaaccgtgaatgaatcgagggatgcaggcttagcactccaccggctaaaaaatggagccttcctgagaagctcaagtgtctgctggtattcatgagccatatcctgcaaagaacatcagccaccttccagtagtcagtcattgacttctcatattcatcagacactagaatcgtttgacaaaagggttagttcatcatacgctactaagctactgtattttccaatataagatgaaataccttgatttgacggtaggacatttcctcgcgatggaactttttgactaatggatgttcaatcaacacaaaggcttctagcaaccttctcctacagttaaaaaacagaatataaatataccataacagttttgcatcaggatgcttggaatgggaaaggatgcaccctcttacttgcagagcaatgactcagtggatggtgagcatgctgcctttgaagatgtaccctgttttctcccagttgttcctaagacaacttcatgaaaaccggatttgttccagcatatcgagtacctagtaaaatataaattgcaaagctaggtgctcttactaaaaacatgtacatactacatgaggtaaactaaaaaaaaagggtctaagtttataaagacaacaaaccatatactacccgcatgtcaaaggttgcaaatctccagaagtctgttgaaactcttttggagggataggtgcctcataaaatagtggctgtaggaaagaaaacggatccactgtcatgagaagttagcagatgatttgtatatcagtacacaacattgccactccgaccttgttcaatttaaaaggcaacagcagtttgctggatagagaggacagtcgagcatcgagaactttcttgatattattttcaacagaaaacccatcagaagcaccagtaggtgattgtccaatagtaatggtggacaggtacaagggctcaagaatgtgagacagtaatgcacctgtgaaagaacagaggtaaggggttatagagttgatccattgacccgtgaaacgggaatatcgtaactagaaaaataaagaagcaatataattgtggagaaatactagcatgtccactatatattacttcagcagatctgcagcatatattgccatgaacagcaaatgatgaatagcatgaaaatgctgccacataggatgcaatcaacaaacttataacattgaattgaaaatgatcgtggacaacaaaccttgaattccaacaacactccagcgagttattttgtcaaaacaactcattgataatgtagtgtcaccacgcccaggcttcctttgaacaaacccaacatctgtcacacaaggcagtctaccaattaaaatggacacagaaaaataacactaagacaatgaaatgaattagacttttaacatgcgggcaaagtaggcacatcttgaaaaaaacaattaaaccgagatgaaagatccatcagtttcccagactgtattatatacccatggagtctagatttagtgtaatccccattaaaactctccagttccaagtctagaaaattggtgtgcattggtcaccaacgccaacttgtttagcacctgggagctagttccactcccacactttcatgataccattttttccaacagaaaggaaaaacaacaagtactggaaaatcagccaaataagaaacttcgacatatctactgagttacagtacgatgtcacagctaaagacatgaatcaactgctactccagatacatgagtaggcgtctcattgaaaaacttaagtagaaattaaatgttaccaggacaaataaagcatttctaacaagccatcaactgattaatacaatttgtcaaacgtaaggctaatagtaaaagaaaattagcagctataaacatgaatttactgttctgctcaatgccaagaaagaggcataccatcgcatccattaacactatccagctgttccctgagcaactctgagggagatggtggaacaggcatgactccacctgcaaaattcaccaaaccaaggaatccattgaactctaaatgtgtagaactttgccatttcaattgatcaaacaatcggctaagcctaaaaaaaaatgcgaaccggcgaacagcaaaccgaatatacatggaatctgggtgatgtagagatgaaggtggtacccatccctcaacttccacttctcaccggaagcaaccaaccaatcggaagcgccgctccggccgatctcggtgtagatgaggcggaggagcgcgcggcgtgcgacgacctcggcatgcgcgtcgtggacgaggtctccgtggtggttgaggcgagcggcgccgagacacttggttccggtggccagcgagagaacagtgagattccgggggtcctgctgcggagtggagaggaggaaggcggcgaggacggtggactcccgcccctgcggcttgcccttctttgggagagagttgtagtgttggagaacagtcgaggaggtggattccgcccaggagacgtcgtcccatggcgacggcggcggcgccggcggcgaggaggcggcggaggaggggagcatcgaggacggggaaggcgtcaatgcattttacgctttgcagctgcagttacgtagccttacgcccattgtgcggtacaatgagatgaaggggaaaggaatatatcggcccactaaaattacgatcctaattcggcccaccaagatgttgttaagatttggtcgcgatccaaatttgccccatgaaaatttcgttaaaaaaagtcatcctcgaaagtcacaacaaaaacaaaggattcttacatatatattttccaatagaataaagactaatgatcaagcattgtctccactattaatagcgtaacagtaacaataatttcaatcaaaaatagcttgtttgtatcaacgactataccaatgttctattggtaaataatctaaaaaatatttgttcgaatactggtaaacgcgccacatagctagcctctagatctttgattagaaaataactcaccatccgaatgacatgtgcactaacacaaggaggctaggagaagctagcaagcaatgatgcaacacaaggatgcaagcaacaagggccaaaaatttgactgcacagtgcaagtgaaagcaacgtacacaatcctatgttcctaattaaacatctcgtactttgttaaatttcataatctctgcaaagtaccgatcactgtcaaaacggccggcctcctccatttgccggcctccgccggcgacgcacgctcctcgcaacgtcaaatgcatggccgcgtataaatatccattccatcgttaccgtctccggcagcggattgcaccattggttaaccagtaattaaggaggcgagatgaggcaggcgaggccctactcggcgatgttcgccggcggcgtgtcggcgcggactgggccgcacgcgctgccgctggctcgcatcaagaagatcatgaagcggtcggcgggggacagcagcgtcgtcgacggcggcggcggcggcggcggcggggcgaggatgatctccggggaggcgccggtggtgttctccaaggcgtgcgagctgttcatcgccgagctgacgcgccgcgcctgggccgccacgctcgagggcaagcgccggactgtgcacaaggaggacgtcgccgccgccgtgcagaacaccgatctcttcgacttcctcgtcgacgtcgtcacggcagacctcggcgacgatcatacggactataagtaaatcgatatgatttattacacatttacagtaagctagctatgtttgccgaatattgcaacacaaatctgtgtcaaagtccacttgtccatgggccatgtccaactgtgtcattttcaaacaccgacagccggtacatcgaccttgtccatggcccttgaaacaggaacaaatccatagaggtcgccgtccggaatcacacaaggtccttcgagcttcgacgatcaccgatgcattgcatcgaagacgtacgtagaagaagaacaacacaacgagtagggtatggaaccgtgcgggcagagcacgaagagtttgaatcgaacaagaagacgatggccataagctccgaggcccgacggcccggtccacggcacggttatttgaagcacaagcacagcacgattggtgtcggacccgtgccagcccgacccgacagttgggccgtgcctagggcgatgccttggcacggtgagccggtccgacacggcatggtcaaagaaaaatagtcgagggatctaaattagacttaattcattcatataagatatggcccaaagagaagagggataaaatagacttattctaaccatatgaaacacagcccaaagagatgagaacggaaaaatagacttattctatgaagaagcacgatgggctgttgtgcttttgggccgcgggccgagtcctattgtgccatgcctgaagggggacaaaatagacttattctaaccataaggcacaacccaaagagatgaggatggaaaaatagacttaatttataaagaagcacgatgggcggttgtgccttcgggccgcgggccgagtcctattatgccatgactgggccgtgggtgcagcccgtgggtaggcccaacctggcccggcgcgtaggttgagccgtgtcgacccgactaaccttggctcaggcccagttgtgcctgggccatgtcggactgggtggcccatctgggcatctatattgagggccatggtaacgagggcttgttcattttaatgccgattttagtaaattttggcattgctaaattttaatagtgtttggatgtatttagttcgatgcatctctaaaatttgatatcgtttttataagagaaaaaaattccagaattaccaaaattggtagaatgatattggtaagataatgcttagtttgttaccctattaaattttggctgagttgaaagtggtgatgaagtgaacaggttcgaggacaggttggaaaccgtctggccattagggcatgtacaacggtttttattagtggtctttctttattgctatgcaagtaaaatttgatgacatggaagaaagagaaatatggttgttatgcatgacaatggctcagagtcgactcttaacatttattagagtaatttttgttgcatggtggcgaaagaaaggaaagaagagtaagaaaaaatattttgatacattagtgattagagaccatattgtctccaactgttgtaggatgctagtctctagataatgtagagctcatacctgactctacctttgtacatagccttaatctcacccgtgagttccgcaaccttgccacgcgcacaagactcctacgaggagttcctccttatcacgtggttgtctctatgtatggtcatctgcaacgctgacaccatccacccatccctcagcgaaaaagagagagagagagagaagaggatagagaaagggacgatggcgcggactggaaaattctatgtatactcatagacaacaaaaacaaaaattaactcaaaattctatgtatactggagaaatataaaaaagacaattttctgcgtgtatataacttgggggtaattttgattcatatccctcaaccacagaccgggtatacgaaatctattaattgccaataccggttcattttgcaccccaagcagtttccaaagttgtcttaggttgcttagtggggtccatatgtcggtgacatgggaaa

SEQ ID NO: 40114 - DNA, 1572 bp, Oryza sativa
gtagcatactgtacttcgtatacagggcagcgtatacgtacgtacgtgcctttataagggggctcttccccaaggtagatctctcgtctctcctcttgcatcttcttccacaccgtctctgtctcctgcgccgcgccgctcaccaccgctccaccgccatggcctcccatagcaagcgtgacaggaactgagaatgcagagttttgaaaagaaattgttcagttgaagttaagttctgagaagaagaggagataaggagatggacggcccatattacacgataccggttcacaggagaagttaatgaagatccaagggatcacactgatcgaagtagtagctgtagctgtccgttgccgtactgtgctacgtcattttttgtgtgtgcttgtaatggcgtaagaatataagccgcttctgaatctgaaggatgtatcgaacaattcaaaccctaattttatctactcattcttgcggcgcacagttctttcctttcccttttatcttttccagatatgatcccaataggtagctacatggctaaatttctctgaatttctgttgaatcagggctcaaatcggccgggtcttgacaatctggtatcagagcaaggcgattcttggccagcttctggatctgggtggtgctaagccggtgagggttggagggacaagtaccctctgtaaaattccgcagccaggctaaggagctcaatccagaagcagagttgtgagaagagcaatgaaggttggggagggcttcggtttctctctgtaaaatcccccacttgttgctgctcaaagatggcgaggggaagaaatttggaacctgtgttggaggaggcggatccggcatgggctggagatgtaggggagttgaggcaagctgtggcagaactccaggagaagtttgaggaggagaacaaggcgatccatgagcagattcaaaatcaagctatgcaggctcaagttcatcgagatgagataatgcaatccatgaagatgattcaggagatgttgagttctacggccagttgctctcggaaggaagctaaggtgaagcagaggtggtaaagatgccgggggctactcagtcctcaacacaaaatcctcaaagaagtgaaggtatgatgatgtttccatccactccagggagggtggacttaaggggagtcacttgtcccatgactcaacccgatctatttactactgctcacactactagtattggtagccacataccccaagttcccacttttactgcccctgagatcaatacatcagtgttcttcccaactcataccactccacctcatactagttttggaactcagtactaccatccaaatgctcacatgatgaattatcacaattccccatactttttcccacagtatgctcctttccaaccaccttgggtctacacacaaccagggccttacacttaggtagataatccaccacatgggcaacatgataatgtgacacatgagcaacaaaggcacagaggtaggaatcaatatgcagaggaggtgaagaaaggacccaagaagtttaattttgggctgcagg

SEQ ID NO: 40115 - DNA, 1337 bp, Oryza sativa
ttttttacatggtacttcacattattttgttcattagggcctggaatatagctggtgcattagtaagcctgaatggcatgaccacaaattcaaagtgccccacatgtgtactgagggcctgttcactttgatgcaaaaaaaaacttaccaaattttagcaatgcttggtaacttgccaaaattttggcaggatttcttatatagttaccaaaatttggcagcaaactaatgtagccatttttttagcaactttaccaaaacttggtaaggttgaaaatgtcatcaaagtgaacaggccctgaatgcagttttgggtatgtcatttaccttcatcctgatttggtgataccccgacctcaaatcaatcttagagaaatacttggccccctggagctcatcaagtaagtcctcaattactggaattgggtacttattttttatagtgttagagttcaattgtctgtaatcaatgcacatcctccaagacccatcgttcttcttcactaaaatggctggtgaggagtaaggactcatactgggttggatagtattggaagtaatcaactgcttcatgaattcctccattgcatttttctgatgatgaggtagacggtaaggtctcacattcactggtttagctccagggatcaatggtattgtgtgatcacagtccctagcaggaggtaattgttttggctccttaaatacatcaccatactccttaagcacctcattaacctcttcaggagtttccccttttctcccttcatcctcctgaactggttttaagtgcaatactgttccagccattccttgatctacccatttctccagcttgtgcatgctaatcaagaaattccttacaggaactgacacatctgagagcaccaaggtgtgtccatccttactcatagtcaactctttagttttaagattaagagatacagggctgaactggtgaatccaatcacatccaaagatgatgtcatatcctctgatttccaacaccctgaatgtagatgcaaattcttcctcttggatatggtatgcatgttgaggacaatgtgcccttgtatacaaaatttccccattagctaccttcactggaattggttcatagttttctatctccagattagcccttctcaccaaggatggtgtaatgaatgtagtagtgttgccactatccaccaaggctgtggctgtcaccttgccaattctgacctttaaggtcaaggttgtggctcccatatctccttcaccgataggatgcatagcttactccttttcttctccttttttgattttgtttcttgggctgtcagggctgcaggaat

SEQ ID NO: 40116 - DNA, 2703 bp, Oryza sativa
ttcctgcagcccgatggtatatccatgcatcatactgtgatatacatctataggagcatctatcccatcctcttccatttcacgcaccagttcttcagcccgttccatattgccagattgactgcaagtacaggtactttagtgttaaatcaatctcatatcagtgttaagttccaagaggtttataaatctgacaaatactaaccagtgagcatgtatgatgttactatatatgattccattgagactgctaagcttggtcttagcctctttgaacaagttatctgcagatctttcaaacaagataaaaaaatattagcaaaaagtcagggtccttgggccaagaaagacgagagaatgtttaagtggccaaatgcacagagaaatgtttaaaactgaatgagaatatgctacgcataaaagagctataacagatctatcattcattctgaacaaagcatgtgagagtagtacgtagaacaggctctagtcaatgagcagaaaatactcactgggaatcattaattttggcgaatcctgaaataaggatactgtaggtaacaattgtcagctcaagaccctcagatttcatttcctcaacgcaagacagagctccacgcatatctctagcaactgcataagcgtgaacaaggctgcatgaaatgaagtaaatttaatgcaggaggcaaatcaacaagcagcaattagagcaatcataaagattttgctaaagctaacataccaggcataaacagttgcaccatatatgcttacaccatgaaagttacatggctttctatgtcaacaattttatcagtgaacattttcttatctcaagctggcaaaccaggatccaaggaaccaattagtctgattctgtgtaaggttccttaccaactgttctttcagttccctcgtgatgtttatctcatgtaagttcttatctttacgtagtaaaaattctgtagcctgtctgtttcagggttgttttttttttacacaaatcctctggctacacattttatcctacaccagtttgtccatgattggaaaagaacagcaacaaaacgtttgcaaatagcagaaagaataaacctaccttgtaaaaacaaatgcattgggctctattcctcttgctctcatgttctcaaatgttgcacgagcatgatgcttatcacctcgcttggcataataaacaatcatcagaccgaattctctccttgatggctgaaacatcaagatagaagtgtcaatgcattgcatacaacaatgtactaatggtaatatgagttatgagatgcctctatcttcaatgcaataaattcaataagcatcagctagacctgtttttttctcctgtggcacttgaactttcttgggaagatgtgaacacataaccatgaatgtagagatttttgaacattaagaattggcacattttataattttattcgaaaaaatatagttgctcactcactaaccagaaatctcaatgaagtaattgtatacctattctcaagaaaagttataacttataatgcaaaggtcgggaggacaattgtatcacctcgatgtgatttaatgagttcaataaaggatccattatctaaaagaaaataacaaatatactgaactagtgaactatatgatatattgactacatgaattagcatcaaatctaataggaaaagatgaagcatctggtatttgtgtaatgaatattacctcatggagcagttttttaaaaagaaatgggtaagtaagatccaggacatccaaaactttgcttacaaagagggaagtatgcgctaactacaccagacagctgaagatggcattgaaatgacaattttcatgacaagtttgctaacatgtaaattcaaacatgcattgtataataaagatgtgcctattcagtggcacattaatccctattccgaaatacagatgacatttgtaggactcctatgcgaacggtactgcttcctgcaaaattacttatagaaaaacttcacctgctttgcattcttgaaaacacacacgtgtacacctataacaatgcaattggtttggtttcaaaaaaaatacataatatgcaattgatgtcctattattcaccggaaatagcagaaaatagattttgagatgagaagccacaccttgggtatcctctcgaatgcagagacgacggcctgccagttgtcgggccgtgattccaccaccctgcggaactcacggcacgcctcgtccctgccctcgtgccacggcgaccgtggctcgcgcctccggccgtcgttcacccagcgcgcccgctgctcagccctggccctccctttcctgccgtcgtcaagcctcacggtgagcgacctcccacggaagtcaaccccgtcaacctccaccgcacgctccgccgcggcgtccgcgtcgtcgcctccgtagtataggaagcagaagcccacgttgcgctcgggatcgtcgtggccgcgcacgagctcgaccttctccaggggcccaaactggcggaagaactcggcgatctccgccttcctggcccacagtggaaggttcccgacgaagaccttccccttgtgccggaattcctcctgccgccgcgcctccgcctccgcctccggttccggcggcggcggggtagtagtagtagtagtagtagaaggctctggctgctctagtgtctcggggggc

SEQ ID NO: 40117 - DNA, 11884 bp, Oryza sativa
gacggaagggggccgcggagtagaggggtttgaatggcttcggtgggaggacggcggccgccggcgaggaggcggcggcggcggagagcgagaggaactgcatgccgcggccggctactggtgttggggatttcgaatggcccgggaattggatgcggacgcgacgcgatgtgtaatccggattggagataaggctcgtctcgtctcgttctcgactttgggatgctatctggcgctcgggtcgtgttatttggcgcgcgtcctacttccgcaactggactggcccgggtgggccggatttcgtctacaattcggcccatcctgtaattctgattttatatctccttagagcatgcctaacagatttgctaaatgaatcccaatcttaatattaggggatttttattgaaaaatctaatccaacagtctccctatcctcgggcccaatagttatgattcccaaatcatggtttctcgtaggggcgtccgttcatcccccaatcagcgaaatcacaggaaaccagcctcctcgcgcgcgcgcagagaaacgtttccacgcagctctttctctttgcgccctcatctgccgctggtttgatctgtaccgtcgccggcgttctcttctccacagagagctggaatgcctgcatcgatctccctagcttccatggagtcggcgctcttcgcaggtgcggcgcatgctatggcagtgacggctgcatcttcacttcttcaacggatccaggcggaggacaaccgtcaccgcttccgcaggtagcgtcgccggcgccgcctcgattcggggtgccggtgtcccgtcgcgcccacccaggtatggtctctgtgggttggtgcctccccatcccgctcaaccgccgtcctccaacattcaggcgacagaggacagaggggaccagccagcctccctggtttgggagaaccaggcactagatcccctcacaatatatatatatatatatatatatatatatatatatagtgtatgtatatctatgctacataccgttggatttggctctgatcagatcgattgatgtgagtatgaaagttaacgggtctacccagtaacgatttcttatatggaatggtgacaacgaatcaaaagctgtcagatacaatagcctaattatgggatgataatgatatttaattaatgcatatgatcggatatgccatatttaaaaaatgtttcttaatattggtgatatagtacttatggcaaatcaattccatttagtatggacttttttcggtagtataatttttcttacaaaagtaaggtggaccttcttaatttgtgtcgatgaacctgaagaagatgctccaaaaatttttgggtatgcaacgtgcatgcatttcaaatgtactaccaagtaggggtgaaatcgggtcggattgggtcggatctcacccttctcatatcctaacctatattttataatcggaatcgggtcggacacggatagtgtcgaatacggatataggttcggataatatcgggcaaaaatatgggccgaatacatacccaaacggatacgtacactctcggttacaaatacttattcggatatcaagtcgaagaaacaatcataaataccatatagataataaccattcaacaaatctatatatccataatgcgattatattaggtcattaggggcttaggaaacaagacacagtagtacagtacgtgacaggctcacagccacaagctaaaagtagtacagtacgtcagacagccacatgccaaaatatcaccaattcttcataacggagacttatagtcattacagtcacagtcacaggctcacagccacatagtactccagtacataataccataatactcagaaacatgtcttgccaaatgccaaccaggaaacatcaccatttcacaagagtcttgagccaaccagaaaacacaaaccatttcacgtaaaccatatttaaggacaagacactcaaatcatcagtaggagacgacgactggcgcacacggctgtcacggcaggcctgcacacggcaggacggcacgacggagatggcaaccgacgcaggccgtgcagcaacggtggtgacgagcaccgtgggagccggcgcggtgacggagcggcgccgccggcgtgggtggcgctgctggcagccgtcgcaagggcgcggccgcggcaggagccaggaggagacgccgtcgccgagagcccgtgacggcaggagccaggagccgccgcgccgcccaggaataggaacagacgaacaatcactccactcggtctcctcatctctctcctatttcctcgggttaacaatactattgggccggtgagttttgggcctgagttgttggctttttggctagcttgcctcaaatctggttggttggttgtacagactacgtaatacgggtactatccgtatatatattcgggtagtatccgtatttccgtatccgtcgaatactgcgctcccgaacccgatcccatatccaccaaaaataacccgtattcgaaccctatatccgtataaaattttgggtacccgaatttctgagccaaatttgttccgaattaatacggtcgggcggtcaagcaggaaatacccgtcctgttttcacccttactaccaagcggctaggtacgtacatgcatgcagtttagatgtaccatttaattgggtataatataccatttagagcacgcatattttttagtatttaaacacgtataccggtatattgggtatgtgtgacgacgtatcaatgattctctttgggtatataccggtttaaacacacatactaggtatatacccttaaaactgcatattttgttaaaatacatatttctagttggtatatacctatctaaatgcgcgtaaaaaaattgatttttcaaaaagcttttttttaactgaatttgaaactagctagaccttttagttaagtttttttttctactctagctaggtagctgacaaattagttacttgtagatgtaggtatatgccttgtttgttgtgttttatagttaattaggtatatacctatctaaatgcacctgaaacaaaattgattttccatgaagcttattttttcctttgaactgaatttgaaatatgctaggccttttagttaagtattttttatactctagctaggtagctaaccagatgtagatgtaggtaggtatgtgacgtatcatgattctatttgagtatataccggtttaaacacacgtactaggtatatacccttaaaaatgcatattttggaaaaaaatacatatttctagttggtatatacctatctaaatgcgtgtgaaaaataatttgatttttcaagaagcttatttttttttcttagaactgaaattgaaactagctaggctttttagttaggtagctgaccagatgtaactagttacatgtagatgtaggtataagccctgtgtgctgtgttttctagttaattaggtatatacctatctaaatgcatctgaaacacacacaattttgcatgaagcttttttttttcttgaactgaatttgaaatttgctgggccttttagttaagtatttttctactctagctaggtagctgaccagatgtagatgtaggtatataagccttgtgtggtacgtatatcctgcccatgtagatgaattttaggttctgatatttatggaatagtgggatagtagatacaccatcccaaaaaaaaagcaacaaatctagacatagagtatgtttagatttattgtactaggaggtgtcacatcgtagtacgaggttgagttttttttgggacggagggagtatatacatagtaccaaaatacttcgtattaatttgaatgaccgtggaataattttttttaatgaacatggatattaagagtattttaaacacacaattatgaaatattattaaactaggtataatatattctagagtacaaactaataaattgggcaaggatgatgaattgggacctcatggttccaggaaatcaagatttgaagtacgttcatatacccactgaaatgcatattttggaaaaatacccatttctagttgggtacgcacctgtctaaatgcgcgtgaaaaaaaataacatagtttgggtaaatttagtcaatgtggaaacttatgtttaagtactacagattgggtattctatgcctagtatagttaatgtatgtattgacgtgtatctgtatatatagcatctcccacacatgcaaaactagcacttcccatcagtatagcatactccatccgtttcacaatgtaggtcattttaacatttcccacatttatatttatgttagtgaatatagacatatatatctatttagattcatattaccattgatataaatatgaaaaatgctagaataatgacttacattttgaaacggagaaagtagtttgaaaaatcctttcgttatataactgtggctaattaagtatgcgacaaaatatacctaatgccgacgcaattgaaccatggaactttgaaacttccgttaaatttcgaaagtatgattggatattttgcgagttgagtgtggtgaaacctgtctgactgagtctattcgtcttaatattagtgcttcacatttaaaattattattctttcagtgatcagtgataagtgattaacacaaatgtttaaaactagctgttttttcttattctagaaaaatctgtggtcatatagatgcgatcaaaggtatccgacacaagtttttttttgtatactctagaattattgtatattcaaattagttttcaagttaatttgaataacagcctactagctcctagtgcgtgcatccaactagtgcttcttcttcctacgaccatcttctcctgatcatcctgcggcagcatacgtgtacagtcattggatcactataggaggatgaaccaacaacttaattattagtaggatccatcaccgtcttaaggtcttgacaaacaaagaaaattgtcagtactcaacctgcaaaacagttgagccggaacccgccaaaatataagaatagattaaaataaattacacatgaaaccacgtcatcgccggtgacggcagcgacgaacctcctcacggggaaaccggcagtgacgacgacgaacctcacggacgaccggggtgccggcgacgaatctcacagacaaccgatggcgcattacggcgtggcgacgaagctagcgactggcgacggcaacgaaacctcgccgacgaaccggcagcgatgaacctcgcggacgaccggcggcgtcccggcatggtgcaagctcgcagcaacgagggtagaagtactcccggccggcggagcgcatgcagctaattaaattgtaaaattttgagtatcgttggatggtttatatatatacgtgcaaaaaaaaagaaaaattcatataaatggaaaagaaatcaattcaacgtaattaacggggctgattttttggacgatctatgatatagaaacataatgacattcaaaatccgtacgtcctttggaaatacatgaatgcgaattaaaaatggaatggtacctgatgcaaatctttcctaacgggttaaatggattaaacccactaattcgttcaatattctggttttaaaaagcacgcattctaaagcaaatggacggtggattaagttggagcctgggctccatggtgcaccagttaatatatatatagagagagagagaccacgaaaatatttacaggaagtataactgtataagagtaaatattagcaggaagtatatgctgatgtttttcgtgggtatgtgctgtggagtatgtactggtgctgtactgaatgctgattgttgctgctgttctgaaatgctgctgctgcctgctgctgattgctgcagatgttctaaaatgttgattgctgcaactgttctgaaatgccgctgaaacgatgctgaagtgctgctaaattgctactgattgctattgaaataaatctggatgcatttatcagttatcagtttttttgcggcagaagagctgtacatgatcaacaacttgtcgtttggctagggatcaacggatcaatgatattggctaggggattacctccttgataacacgaatagctacagtatgctcttaatgtttcgtttttcaacagattaagataagaacagcagtccgatcgcgacgaactatgaggcggctccgcctgcgggcaggggaagaggagtatcgggtgttcgtacatggagaggggagaggccgatcaactctcaagtggtcccaccatacttatgtggcaaaccaacaaattattgggatttaatttttaggtttctcttggagaagggagtggttgttgagcctaatttttattttgatagtcctaatttagaattttcgggagttaaatattagaaaactgttgggcatgctcttaccctaccttaaaaacggagtcattctctttccatccccttcttccaccacgcgcccacacacttagcacaagtaagtaagtaagtaacaactggatctaaatgttttatcccggtcacacttatacggacatggcccgttacaatgtaggggcatattatattagtttaaaaaaaacaaaataggtaagactgaatcaatactactatatataaaagataatagcagttgcagtgattttgacatcagcccaacataattgcttttgcatgttgtacaaattatttcatgatattttataatattatgtagtagtttattttatttttaatcaagtgagtacacatatattcaaataagtatgagtattttatccatagcaaagcatgaatattatgctagtttataaaaaaaatatccgtaagactatataaatttgttgagttgcgcattgtgttcatatattaatgactactccatatctgacattattaaaagaacctgccgacaaaataagatatttattagacatgtttgacaccagagataacagaatgtttgttttaaacaagctgttcaattcagattacagagcacgatgatcacacaacgttgatcttttacaagaaagaaagaaagtgaaacgatagatgcacaggtgaacttttacaatgcactactgctcgatcactcgccaatgccaatgctcacaagtaaagaaatgcatgtagtacagaagaggattacaattcgaaaataaaaacgcactcgctcgcgcatgcagatagaaatcaaacgtaaatattatatgcatgtataattaagcacaatcttttttaattagctagcaagatgattaagctagcgcttgcggatagagcaggcggccaagatgacgaggaacatgaggatgacgacggtgaggaaggaggcaacgacggatccgctggttcgctggcagaagccgtggaactgcatgcatatggccacccagttcgcccgcaggttgccgttgtgcgccaggtccacgatcgccgccgccgcagacgccgccgccgtcagcatcgccgccatgatctgcagtacacgcatcaaatcaattctcatcaggagccaaatctatcgatccaaagaaaccatttcattgcttagattaagatacataccatgtcgcagacgagcaggagaagcctgaggccgatggtctgaggccttatcacgaggacggcggagaaagggagggacagcaccaggtaccctgccacgatcgcgttcgccaccaagaagaacctgcaaagcatatgcatccgatcatcatcatcatcagtttgaatggcataatcgatggttaatttgggtgatcgagttggatgtgtgatgatatgtgattctgacaggaaggccgggaagtcatcgaatctggcgcggaactggtagaactcggtgaagacggagagcgtctcgtcggacgtgccggtggagatggccgccgccagtgcggggccgaaggcggcgatccgcaggatgaagtcgaggaacgcgaggcaccggctgccgcggtggtggtcgccgcgccggaagaacgggatgccgaccttgcgtggcgccaccgcgggagccgcggcgggcgcagcagcagcagcagcagggacggcggaggaggtggccggggccttgccatggtggtcgtggatggggatgctgacggcggcaggctcgccggagctcatgattgatagctagtttgattagcttttgctacaggttggctgcgagatagtaaagtggttttggctgcgagatgagagctgtgcacgagttgcatctgcatgaatagatgagatggatttataggtaagttttgtgcagaggtttgtgcagcgggtagggtggtgtggttcgtggacagagtgagtgtgcgagataaagcggagttgccgagttaagagtggttgacaactgctacgcgaagcggccgggcatagtagcaacagatgcactagtcgctagtggcgttcgttgacacacggaataaacaaaagctttgggtcagtagtaacgtaccgaaatcgattgcaagtgcagcagaatggtgtttcattcgtgcgtgcattgtgcgctgcgctggcagcggcagccgcaatattgccgtaagcctggatgtaggagtaccctgtcctgcttggctccagcgccgagctaggaaaaactcccagctttctcggtttcctgagcctctcatgctgggggaatttcgagcacgtcatactgactaaactcaagcctacgcagcgcgtctgtgcaggatccggctaccaatctcgccgtggcgagctaacacagtaacgcagtccggttttagatgcggcagcgccctctacaccttcgttgtgtttgccgttcgatcgatcacgctgccaccaccagcaatgccgtctcccagctttagtgaccaccagcaactccagttcttaccgaagctcaagcggcattaccggtttactcgtcaaagggacgcacacatcagaggttttagttgaccgttatattctagtaccaaattgagcagcacagcattaaactggaccgggggtgatgagcccgtccaagatttgcaaatgaaccaagcccttcaacactgccaatttccgcctgacaagaattccacgattttctctagaatataccaatgggggctaacacatatgaaacaaaaccaaaaagaaaagaaaaatgacctggagaaaacacaacgcttgctgtacaagtttacacgcctaccagcaagattgacatgtacatcaacaacgccttttgataacaatccctttttttttttcgttttcccattttcttgggtaggaggaaccaagaccaagttttgcccttcccccatcaatgtcgtgtctgcaggacttattcaccttcaatgtctttgcaatctctttcagggcctctgctgtcgctttcttccatatatacatcctacatgaacatatggacgagggacgaccttccgcacgtgcaaatcagaacaaggttaaagaaacccctagccaaattgacaaatgaacaacagctgcttccatgtccaatgattgttcacaccaaaacacctgccacaagcagaatgacggtgaattaaaagagatggcaaacaatacctcacttatattaatgttttccttccaaatatcaattgttcatagaacatcttaagcctgttctaagtaagttcaaataacagtatttcaggttgcatataagttttttccgagtgatggcactgatggatttaatggctacaccagtaaatgccatttgtgaccaaatatggtagcagatttggtgttagtgttatgagccacaatatggcaacagaaactgcattgcacaaagatgtttacaaccttatgattaacctagtagctaaagtcaaattcatcacatttatccaaacactgaacttatactgattacttgggctactgagttacttcagtagtaggacttgttagaagcatatacctgaagttatgtgcattttctgaactacaaatttgttcagtcatattcaatgtccactgctgctacttgtctcatgggcacaaccatccttgattgcttcttgagcttcattctccatgcctaaagaaagcagagcagcagcctgaagataaaatgcagttggccatgttggagatattactagcgcttgcatcgcatcactgagagcttgttctgccttgtcattcatcagatatgacaggcaacgccgcgcataaatggtcggagaaaccatcgtaccaacttcaatgaactgcatacaacaaatgggagcaaagtcaaaaatagctgtgaggattaaaagtttttccttttcaatggactgatggtgtttacagatagtcacacggtccagaaattgttgttttcacatacactttttttttaaaaaaaaaaagattaaatggaactgttcatactatgttgaatactaattacatttgatcatgcaactctcctgacacttctcacaaacccatatagaatataaacacagatgcaaaatcaacctgagaataacagtcaattgcagaagagaagtccttttgtcgaaaagcattgtcacccttcttctttgagttcaatgtatcttgcatttgattggtccacatctgaaatgagagctgcagcaaacaaggaaaacaatggatcatgcaacagcataacaatataacgaggatggttgctaaatcattcagcatgacaaagtttcaactacgtatataactactcacaatatccgactgacaactggtttcacatcgtcacatgctgcaactatgtaaatgtcacactcagaatatttggtgactttccaactgactattttgctttaacacactggaactaaggagatgacaagcagatcagcataaaatcatgtcaactatagttgctctaggatcaaagtgaaatgaacatgaagagaattcttacactaaaatgtattccaacagacatctaaaaaagcaaaatgcaatcagcatgccatcgataacaatatttcttgaggtaggacataaaagatgcaatgagcccatgaggactaacagtacaaatgattttatagaaaagattcgcttgcttgtaaattctgagaatgctccatcaagattgacatacaaacaaagattctcacgaaaagaccacacaaatcatactggcaatgatgtcaaaccctaaagaaagtaaagaagaggggaaaaaaaactaaaacctcatttgctgttccctcatcatccttgtagcccgtcttttctaggatttcatgtattgctgtcagatcctttctggaacaagcttcagcaagaggagaaagaagcaatgactgaacagatgttgcaccaccacggggtatatccatcagttcataagatggagtctgcaaaatatttcaacattactgcaattacaatattatagaacttcaagtccaatgaggatgccaaaatcaccctgttataatattttgatagattaactttcaagctgagaataaaaaatgtacacaagcataaatggcgtcagtcgtggaaagcttagggagggactaaatatatgaagagtttagatatagaaataactaatttggatatataggttgaaatagaacaaattgaaattcatggcgtaattttctcaacataattttaggagacctgaactcaacagtgccatagtgagaaagggaagtggaaagatattcacctcaagatccttctgaagaggagccaatgcttgcaccagagatcttacattaggtcgttcacgaggttcatagtgcaggcatcttgaagctaatcgcactagttctgtcccttcctcatttgaaaattgaccctctaaacaggagtctgt

SEQ ID NO: 40118 - DNA, 4264 bp, Oryza sativa
cctgcagcccatttatatatgatgcggaaatgtaaccatgaacagaacccagttactaattgatgtgatgacagcaacataaaagttctaaggcatgcgacaagaaatgcatggcaactcacaatggaaaagatgcttcgctagtgtgtcattgggcatgtattctgcaacaagcaatctctcgtcaccttcgcagcaacagccaagcaaatttgctaaccttttgctccgaagttgtccaactgatttagcttcttcctgaagcatagttgtttccaccaaaaggattattagatgatcttagagaatttaccacaaaaatatatgggtaatcaaacaaaaagttgcgtcaacaaataggaagtagattccaccatccactcacacaacaaaatgccatcaatatggaaaatgggctgcttaaagttgtggaagaaaacctctatacttgccattttaatagtatgtacaatagcaatcagaaacaaatggcatggtggtgaattaacatgtgacagttagcaaaataacaaggcatataaagcattgtccacgggaagagctagaactaatgcagtcaaaaatacataatgttaacaacaggtaatagtaagtttataattactgagacactaactcacacatagcaattaatggagtgatgtagcaatcaaacatgtaatccacaaaatgatggtgctactagctgtaatgattgctgtctgatacttgtttagtattggaatctaataatcataccaaaaaagatatgttgtgcaaacagttggcagatgccacaatttgaactgcaagccatcatattccacccaaaagccaaataagtaaagaacaagcatgcatatcatctcaggaacaggtacacatcaacaacctccatgataagagacaacccaaacctagaaaccaattcatgcacttataaatagaacagaatctaccattcccacaataaccaccacgtacccaactaccattggcaccaagcaaacgcacatcgttagcaatgcaaaaggattaaggtgaagacaataggataccaagaactgccgcgggtcaggccatgcagaacggttgaacctcttcacagcgatgcgacgctgcgcgtcgagcttccccttgtacaccacattgggcgccttctcaccatgctcagacacgatgttctccaccgcaaagcctgaggtggccagcctcagctgctcgaaggagaattcctgaaaggccggcagctcatacgactccccatggtcctcctccgctacagataaacatgtattccgctcaaattactccattaccacaagcttgcagccaaaaatcactcgaagatgcagaactaacaaaactaatcagcacccccaaatcactagcagaaacgctatataatatgtaaacaggcgcacataaatcagaaatagtttgaccataataacgcagatatcaccaccaaatggataggtggaacagattaatggctacccggagtcagtttaacaacgttccaaatgcggagatgtcgacccaatttaacgaattaatggccatatctaggcgaaaatagagcaaactcgggggacaaataaaaagtaagatcgcgagcgcccacagcttctggaaaagggaaagcgagctccaaaaatagcagcagaaaaagggggaaagatagatagatggatggatagatagagcattctggaaggcgcagagaagcatatcacgcacccgtcttctccgagctctcgacgacgactccatggtgctgcgagcggcagcagcagcaggccaccgccttggacacgcgcccgcccatttcgatcagcagcccgcccccctgcaggaagcgaacagagcagcacaccctgagaaaggagacgcgaagcaacggcagcggcgcagaattcgaacccccccgcgcgcagcggccgccgttgggtgctcggatctgctcgcgcggccgaatcgagaggcgcggcgcggcggcggcggcggcggcgcgaccactccaacctgagcaagcaaccggagcggcgccgcggcgtggaggagggggggagacgggggccggattggattggatctctctctctctctcgcggcgcggcctctcttggggttggagggcttggggttgaggctggctggctgggtggccgccgctgcagcaactattattcgctaataccgctacaaccccgttgctaatgaatggggtttatttcgccgggaatattatcgttgccgttgctgcagctggagtattattaattaatcaattagttatttaactattactatcatttgtttatttatttatttatttataccgacatgcctgcgctgtactgggtaactgggacaacggggttggttgcgtcgtgattacgagctctgaatttaatcccgcgcgcggtaattacctactctgctgtttggcagtaaaacgccacgggcaagttggccaaattgggtgcgtttccaacaccgggaagcgcgactattcgtggtagttcgtgtgctgctccagtaaccgcacgccggccgctgcgtgccgtcgccgggctggacacacacacggccaccgcatctatcaaaaaaaaagtataaaagccgtactaaatgtttatattttttgttttgcttgtactggtttttctcctgataaatcatactcccagctagctgatatacgagctggaatggaacttggaagctataggtaggaggagcaggttgcatctgatgatgatgatgatgagaaaagtctagttaatttgttctcgactcgtgcacacgcacgtttgcgttggcagacgaaatgatgaaaagagactcggacgctttctctttctgccagcctcagtacgtgcgagtgagcgatatgcggggaccaaatcttcgtataaaaaatatactccatatgcggcatctgtgtgcctgtgcgctactacaacaaaccagcaggtaattttattctatccaacttgcgttttctgcaggtttggtttgaccacagttcaaatgatagtaaactagataaacatcactgttactagtagcgaatacagtatgcttctgacttggcaatcgatcacaaaagtcaaaatcgttgtgtgaaccgaccgatattagcttgtactgtatgtgtacacgctacgacatgtacgtaagtacgttcagacaggcagcatcaagtcgtcctgtacatggccgtgcatctttgcaataaaattgctgcttaccagtattaattaactcgacgatgacaaaccggaattaatgtccataaaacaaataaatcaagctgccaaaaagcgaaagcgatgctgcaaggaagagagcagagcagtagctatcccgcctgtggataaaagaaacgaaaagaatgttgagattggcatggatcgatcgatccgtcaaaagccaacctacgacaagagaaaatggcgcggcaacttacctttttttatttttaattttctttttgggggtgaatggcgcagcaactttggtgaggtcatgagactgattgttcggcaaaaccagaccaaccaaacggagggaagcccaatcaagttcgctgtttacacgtaacgtaagtagtagtatttgtcgctgacgagtgtttagacggttgatcatgtgctccacatctttaaaaatgtgttttctcaacgaaattctaaattctattgcattgtttgaaccaaaatttattttattattttttaaaaaaataatatttgatttaccttatcaaacaaacaaataattcgttgcaagccgatcggagtcggccaggccgttaattccgttcggtgctgcagagctgaactggcgggcaagccaagcggctgttaatcgggccccactgagccaaaagcgaacaggtcgatttgatctgtaacctgcgtgtccgctcccgcgatgcgctgcatcactacaggagtaatattttcaggtggtgttcttttcttgcagaaatgaagatgaaaattaagttttttacgttgattgattgagatttaattattataaacttaaaaaatatattaatatgatattttagagcaaacttcatataaaaagttttcgtacgaaacataccgtttagcagtttgaaaagcgtaccacgaaaatcttaatattcattcatttcttgttggagaaaagagcaggaccataagttagcggctgattcgtcgtgcagctactgttgtgcttgctatcatcatgctactccctc

SEQ ID NO: 40119 - DNA, 959 bp, Oryza sativa
acatgtgcaatatagatcaatgaatagccatttcactatggacgaagactggatgcatgacactcgtgatcgactgtttttacatggatatggatcagtcagtaatttcttctcgttgtataataactagggataaaacgaaactaaagtgaaacttaacgggcattgccaggggtagagtcgtaaataaaaagatgggcagcagcagcaggagagagagagagagagaggtcagcattggagtgggcagaagtagtacgccagacattgggtacactagcatctccgtggtgggcccttgtgttccccggcccatcaacctctctctctctctcgatcgccttcgccttcacttcacacgcccaaactgtgaagctaagctaagcttctccgcttctccatctcattgccctgtagctttcgcctccctcttccagctagcgttgcttgtttccatttcctctctctctctctctctctccagctagcctatctctctctatatcaatctcgatctccatgccattgcactcgagcaggctcagctacctccttataaaccccaggctagcacctaactataataccactatacacttagcttagtgtttacctagctagctagcagctggctgcaacaaacattctgcatgcactttgaattctagagataggagagttaattagatagcttagctaccacaatgcatgcgtgcaacctgatagcttagctacgcgtagttgccaattcaaccggccgacatatatatcggcctgaggaaactagtggaggactccaaagggatcgcattgatctggctagctatctcgatcgatcgcctcatcgatcgacgacgacgtgcgtgatcgatcagtgcaatccctttggaattttcctcttgcttccgcctcctcatcttccttgatcgatcgatccttcgcctgctgggctgcaggaa

SEQ ID NO: 40120 - DNA, 10482 bp, Oryza sativa
gggttttttttgggacggagggagtatatggcacccctcaagtcttcgaaccattcaaatcatcgcattcagcccaaaccacgaggtctttacactgtcacgctgatgcggtagtttagtaaaaaaaaaaaagtacatgacccacctactagtgtggcgttcctcctcctccccccgcctctttcagtatcctcggtcggctgcagtggtctaggcagaagttgtgaggactaggtggcgacggcgtgcttatggttggcgcgttaaatatgaactaacaaaccttaaatattaagggatggagcgactattaattttccttttttaagtaagagggagtattaacttataatcaagacgacagtagatgcatagaaaaacagatagatcaccaagtaaaaacccctcaattgttgcaacgtccattttgtttgacagtactatttgtctatcatgcaacgaagaacaccaggaaatgcccggttgtatgtttggttgagctatgcctacgagctacaacgaattgatgaaacaatcaacgttgtctcatcgtgcctttataagagggggcggtataacgttgaaacatgtgtgaaatgaaatagatggcctatttgattagcaatataaattaatatttggaaaataaacatagaaaatatataactcataactagtaatgttagcaatacaatacgtgagagtttttaagaactcgtatttttgagaagcattatccagcaaatgataatcttgtattaatcaaccgaattgctaattaggtgatccaaactcttgacgtttaggccgggtttatatatatgtgcgacttgcttgagcttttggccggtaggtaaaataaaacgttggattagtgtatgattatttgtgtataattattataaaattggaaaattattttatttgatttttttttaaaaaaatcgatatacaagtgtagcaaacctagaattgtgtaacatccacggattcttgctcgtctgtgaaaaaaaactggttcctgctttgtggcttcggctctaaatgtccctgtatttacttctgggccgtacaacccatgcatttaactggagctgagtgtgtggtgtgccgtactgacggcccagttagacgaatggcacaaaagaggtacgaggcttctcaaggaaacaaaaggaaaaagtacatcgaaggtccctcatcatgtcctcggattacaaagtcctcctgcaaccacaaaccagatatttgacatcgctcatcttacaaaaccggatcacttttggccctcgggcgattttgactccgattttatctgacttggcatctgactcggtgtgggtcccacatgggccccacacgtcatcctcatctttctctcccctctccacctctcttgctctctccttccctctcctcgggcgggactgcggagcagttcggtgcgccggcgggcgcgggcggcagcgggggagcagctgggtgcggctggtggccggcaggggagcagctaggtgcggctggcgggcgcaggcggcgggggagtatctgggcgcgagtgacgggcgcaggcgacggggaggagcactagcaacagcctctgatggcgtggcgacacgacgacggcggtgacacgggagccccgacgaagcccccgtcccgacgctgcctcctcccctccccttcccttattcttatcgaaaactgcatcgataaatggcggtgcgtatccggtgaagagggatttgaggtccgacttgacgtcgatgagcgccccgtacattccgagcatgatgtagagcttctccgtcgccggggtggacatggccatggcgtccgcgagccgatgagctgcaggatgcatccccttgggatgtcggcgaaacactcatggccgagcttgttttgttcatgtggatgtgtatgttcatagatcggcagacatcagtgtcctgtatgcagaatcatagtagtatttggctgtctttggctagctctttgctgcagaaaagctcacatgaactctttgaatcgccataattaactatagagctggtccgtgcagttgttgatactctctccgtattttaatgtatgacaccgttgactttttatcaacgttaaccattcgttttattcaatttttttgtgaaaatatgaaaatatttatgtcatgcttaaagatcatttgatgatgaatcaagtcacaataaaataaatgataattacataaattttttgaacaagacgaatggtcaaacgttggatgaaaagtcaacggcgtcatacattaaaatatggagctagtccttgataggcatagccccgacgacgcacatccctcgctggtgacgagaataatggcaatccccttaataatttgggcgtaggcgatgggtgcagccgctgcgaccaaccaccgctgtggctgcggggctcttcccggtagagcggcgcttgtcatcgttgtcacggcgtggaaggcggcaacaagaagatggtggctgtaggtgacgagatggagacggagtctgctcgggagaggacggcagcaacgaggcaatgatggtgccggtgggtgacgagatcgggctcgatgccatcatcctttatccgcgcggagtcggcaaggacgggaaggagctgcgcgatctctgacagcgtcggagagcgcgagcagcgtggcggcggctgggcagaggggcctgcccgcccgcgcgtagctcctcccccccccccccccccgccgcctgtacccaccggcggtgcgggcgtgcgtgccaagctgctcccctgccgccgcccgtatagaaaggaggagagagtaagagaggtggggaggggaggggaagaagaggctgacgtgtggggtccacgtgggtccatgctgagtcagttgccacatcggacaaaacctgagtcagaactgctcgaggacctaaagtgacccggttttgtaagatgagggatgacaaatatctggttttgttgttggaggacaattttgtaatccgatgacaagatgagggaccttcgatgtactttttccaaaacaaaatagccgtccggcccataaagcctgcaaaatgtagaacatataatggccatgattttgttttgagggaggattagaaaggacttgataagctccttctgcagttacaccgttaatattttttctgatgtcgtgcacccaactcttgtccatatacatcttgtgcagtaggttggtttttttacggaatatggtatccatggggagataagatttgtgtactttttttttaataagtagacctaattgattttcgaggtaaacccgttcaactctagtcaccctcgatctataaatagagggccaacgtgtgcatagttgtacgcacaaatcattagagagctccacaatgggatcaatgggatacaagcttctagatctatttagcgcttcatcttttgcataagaggaggcagcagttctggacgagccgtcgacgtagtcagttctataacatgctatcaacatcgatcactactgctagactgatgtcgtcgggcagctataactacatatgcttcctcgtaaccatctgacttgccactccttcgagtcgtcctgcgctgatcaatctattttaataattgttgattgccattagtaaatttagtaaattgattagattttcttgcttttcctcaagatcttgtttttcctacttaaggtgtagcactagattagtttgctactttccatctatttgcatctattgcttcatgacggaaaaaatggaagaaaaccgtgtctacaaaatgaaaaaattgattagttgccccctttggactgaacgtacccagttacgcttgggctgaatcaggcatgcatcatccctacaccccatccttgcatctcccaacgccattatctcagtcgctctttctagacctttcatccttgttggaagcacgccaggagtatgtgtaccgctgccaaaccgcccatgctctgttgggtcgccactgtaggaaacgccacctgctatcacgtacgtcgatgttgttgcaggaaaccgctgaagacgagtgggaccaaatccatgttgccattgccgcaggaccttataccaaggataggcagtaaagtaatcaccgttaatctctcaccgatgcaccttggatacatggtgggaggtcgatggagcatccgtcgccaacctttaatttgcatagggatcacggcatggctggacacggcttagtctccgttgcaggagcctcagtcgacatcgaagttgagcctacacccactgccattttgaggatgcgtggatcgtggtggaggcagctctgccgaacaacgccgatccaccgccgcgcgctgtccctgccaaccgaggagcgatgggttgctgaccagcaaccacgtcgtgcaccgcctcgatgcccactgccaccgaccgacactcggcttcttccgttgctactatacagccatgctcatcgccggcgcgctgggtgaatgggcgtctccgcgagtgctggtggggagtggggaaatcctactctctctctcaccatcttcctcggtcttttacaggagggccagttgcgttggcatgtctgttagtgcctaactgctatcgagaatgctattgcacaactagttacacgactgaatacttgtcgcgcacggagagggggcacgggtggcggcgccgcgcggtttttcttatttttctcccacagttttttctttttttctttttgcggtttttttttgccggacggtttcattttcttttttttctttccgtatacttttcagtttttttgtttttaatacatatgtatacaaactttatgtacacgtatactaactttatatacacgtatataaactttgcatatgcgtatacatactttgtatatgtgttttttatatgcatttgcatatatatatatatacaaagttggtatatttttatatatacaaactttgtatatatcgtatacaaattttgtatatgtgtgttgtcgattcgacaactgcatcacgtcgaaagacgtggttctcccaacagtggttcgaagtaaagacaattgtattgcttagtaaaaatttttcaggtctccttgttacatggccctaaggggctatttatagccctattatagactcttcctttagtattttaggttttacaggagaatttacatggttgcccgtatgatagggacatctttacgggcatacagcgtcttttgcttgcatgggctcctaatggccaagtgactcagcccagtccttggcgaagcctctagaaggcatgttagcccgctgggccttctccttgcaaggtttgatacttggcaaaacccatgcccttcgtggcaaggctttcccctcacggctttcaaccgtatgctcctccggcagggtccttctttggcgaagctggtcaactcgatgccacggcttttgccgtttggctttcaccgatgctgtctcttcgaccttcgccgcttgcctccagcccgcgcctttgcttatgtccttggtttcagtaggcccggtcgaaggttctcccggccgaaggttctcgtggtatacctccaacaatgtgtatatattggttatacataaaaatataaaaaatatatacatattaaaaagtatatatatacaaaaatatatatatgtataaacttcgtatacatatacaaatgtatatgcatgtgctgtggagaagagagactaagaggggagaaactgaccgcgggccgcgcggggagcgcgactggtcgctaatcagcctcccccaaccactatggccctcctgaacgtgacagcctatgcaattgtaaaaaatagtactacctccatctacttttgataggtatatttccatatctagaaaatttaggcatattttaatctaaccacctatccttataataactttcttggatttaatgcgtgactctctattcttccacacaagattggctatatgagtgtcgagaaatataaatattaatgaatcgcttgtttacaatgaatactagtagcatgtttaaatggatcataacaaaattacttatccttggtcattgtgccaagataaaatataactgtttacacccaaatttggcacctaggattaaaatagggaaaattatcaaagtttggaagtctgccagttttcctctgtggggacggtctgaccgccgtatgtgggccggtctgaccgccgggtgagggccggtcagtccggcggtgtgtgactggtctgaccggcagagtccgagtacgggtctgtttcgccgagtcccgaagtttccttgtttgggaaggcatgtttcgggtttcctttggattctatcccgagttggacgtggaggagggcctgtagagggcaagactaacccctatatgagggacatggccggttcaattgtaactatccaatctacaatcaatcaatcgaatcgttttacatattggttttagttttcgcttagtttgttcatctttatcgttttgcgtcgtaaatcacccgtcgccgctgcgagagtgtcacacctctttgtaggtttgtcctgaaaacctttcgttttgactacgagacgggtagttatctagaatcggcttcgctagccggtttagttatcaaaacccatcgtggtttagcttttgctaggttgcggtggttggcgactctaagatcaccgtaaggcggtaggtgttgtgatcgtgcttatcaacttgtcacaaaaaattaccaataataactctcaaaagtaaatgtagggagtaaaacataaattcctagctggcctcgagtattgaattccgtctacggtccatggatggggatccagcggaaaatgatcaaagccgaacggtgttttcgcccgattggccacgttttactaaacactttgtgtttaagtccctttcactgttcaatataatcttacgatttgaacagctcgtatataactgattgaatgtgttcgtgcacatagactataactttgctgtttagggcttatgggtctctggactagtatgtaatgatgtttttaagcatttaattgtgtttactcttgatgcaagtccaattaattaatctactacatatgatttctatgttgagctttccataaaaaaatgtgtttacctagtgtaagtgacgctctccctttgtttgggtttattttcatgcatatataatgttttttggagagcataaaaatttgataattaatgttatataaggccaataataataaaaaaaaaataaatgtaagaaaaattacggaaaaattctgataatgacatacttcctccgtttcataatgtaagtcattctaacatttttcacatttatattgatgttaatgaatctagacatattaacataaatatgaatgtgggaaatgctagaatgagttacatgcatttcccacattcatattgatgttatatgtctagattcattaacataaatatgaatgtgggaaaatgttacaatgagttacattgtgaaacggagggagtagtcaaatgtggaaaaattccgataatgacatatgacatatgtcacattgttatgtgaattggtttttgcatgttaaacagaacaatatgtgtgaaaccaattcaaaatatcaacattgaatcgaaatgagaaacttggtcagcgcgcggcgcagatgttcagagctaggaaaaagtacatatatatcagttatattgtgaacatctgcatgttaaacgcgtttttaaaattaacaccacaccacatagtatcaatccctctctactatgcagctctcttatttttctcaatgaatattacgaagttatatatgccctggatggtaaaccgttcacaaccaccggtactgtactgtgtcataaaatgcattaatttattggagttgatgttttaaaattttgaaacaactcaggtgaagcatagctagacatcttcagtgtggtcctaattaatcgaactaattaagcagaggacagagagctgttagttggtacatataaaccactcgaggaatcaagctaattaatgacaatctagcttgcttcacattaaatcgaatgagaatcttggtcagcggtgcagatgttcagagctaggaaaaagtacatactatcagttatactgtgaacaccgcaggatgaagtaaattaacgctgcagttagcatatttgttggttcaatcatgcagtctctactcgatgccctaaatattaggtgaagacgactttgagctagggcaagtccaagtcaaggtaaccatgcagtatatatagtactacagtctagttccagtggtgtatgcactatgcagagctgctagctattagaagccctcatttccacccaaaaaacaacagggatgatgcaggcgctgctaatgccaccactagtattgcgccgcacaatggtagccactttactgtgtctcaccgtagcaatggcggcatgtcttgccgctgttgcagcatcctgccagaggaagtgcggtgagatagacatccctttcccgttcggcatcgccggtcagcccggctgcgccatgaccggcttcaagctgagctgcaacgacaccgggaacggcgtgcccaccctgctcctgcggaacgtggaggtgctcggcatctcgctgccgttaggtcaggctcggatgaagatggatatgtcctacgactgctacaacacgacaaggaaggatatcgactgcgtcgatatggttgatctgaacttgaaagggagtcccttcactttctctgacactgctaacaagtttattgtctttgggtgccgtatgctcgcttatcttggcccaggtgaacaaaatgatgtaggtagcaacctaactatcggttgtgcggccacttgtggtataggcgatgatctcgtgagtatcaacagtgccgggtgctctgggataggttgttgccaaacgaacatccctaaggggatccggtattacaaggtttggttcgacggtcgtttcaacacaacggacatctacaactggactcgttgtgcttacgcagcacttgtcgagacatccagctttaatttctccacggtttacaattccctatcaaggttcaatgacaatcttggtagccagccaccttttgtggtggactgggctattggtaattccacatgtgagcaagctaaaacaaattcagattcctacatgtgcataagcagcaatagcgtctgtttgaactcgcgaaacggacccggttacatctgcaactgccaaaatggattcgaaggaaatccttacctgaacgattcgtttggttgccaaggtaaatttctcaactagaggcttttgctggctagagtattgcatttacatatcatctattagcaactagcatactttagctttaaagtacatgtatttaccaaaatattgcatctttgtctagagcgtatttacatgtcattgaggggggggggtagggtatagcggtataagtaggtatgatatcaaaattttataaaattgtgataactatttattactcaaaaaaaaaggataactcaaataggtaacataaatcatgatcctacttaaggattgtaaaaggaattatctgtctacctattgattgccagtttttaggaatttccaagtagacaaaaaaggtgtgaattaatttagcatccatttaggacggaagcaaattattatgtttcaggtaaaacaaaaggagtccatatgaggtgcaagttggtaagtattaactgctaacatcaaaactagagtttatacttcatatgagctacgacttgtcaattattatcatgaaacatatgtattattaaattaagaaaacactaatatcttagatgagaggtaatctgctattttgttccaatctgcttttagccaaatcttgagttcatggaacggacagcaagctgattatcaggttatgatctccgtaattcacactagtttaattgtctaggtttgttgtgctggcataggaaaacaaatctgaccagctagcttattccatcattttggtggatgtattcaatatctttggttgaagggctaaaggactttggtgaatgtgttaattaatgtgtgttagttataactacttgtaaacaaaatgaaataagtatcttgcggttaaaacctcgaaaatgagtaaatttgtggtggaaactattgacttaggtgaaactcgtgtaaactctcacaaaatgtgatgaggtggtgtatctaaatgtgatattgttttaaaaaaaataattagatttacatgactttttgatcgggtttaaatgagttttcaccgcatagttatccccctcccaaccaaaaaaacaaaactctagaactaccaaattcggaatggtattgaagtgtgtgctagcattttcataaatcatcatgcttttgttttattcacaagcaaca

SEQ ID NO: 40121 - DNA, 15633 bp, Oryza sativa
attgcttactggtacacatatattatcatctgagtatattgttttgccataacctctatgtacttgaatgttcatgtagaaaccatttcacatccctacaatttatgaaaaggaaattcacattctttctcaaaatgttttcttttgtacttgaatgtatctgcatgcatagacactgttttttaaaatgaaaattaatcaaattttcttctctattctacattgttttatatattcagaagttggcacagaatctgaatctactctaaaagaaaaaaaaactggtacaacaagttatttaattagttcaatatttgaactcttaattgactcatatcagaacaaggtttcatttaagttatcactgcatactttagcatatcattaattatttactagcaaatacaaaaaatcttataagggtccctaaatgtaggtattgttatcggtatggctgctggttttggaattcttgtacttagcttatctgtggtactccttatccgtaaacaaagaagtgacattctgaagcaacaacggaaaaaatattttaggaaaaaccaaggccttctactacagcagcttatatcatctgatgaaagagctagtgataacacaaaaattttctccttagaagagctgaaacaggcaacaaacaactttgacccaacacgtgttcttggtagtggagggcacggcatggtttacaaaggcattttatctgatcaacgtgtggtggctataaaaaaacctaacatcattagggaagaagagattactcaattcatcaatgaagttgcaatactctcacagataaatcatcgtcatattgtaaaactctttggatgttgtcttgaaaccgaagtccctctattagtgtatgattttgtcccaaacggttcactaaatcaaattattcatggtgctacaagtaatagggaatcatcattgtcttgggatgattgtttgaggattgctacagaagctgcgggtgctttgtattaccttcattccgcagcatcagtatcagttttacaccgtgacgtgaaatcttctaatatacttttggtgcaaactacacggctaaagttgcagattttggtgcatcaagattgattcctaatgatcaaacccatgttttcaccaatatacaaggcactttcgggtatttagatccagagtactaccatactggacatctgaatgagaagagtgatgtgtatagctttggtgtagttcttttagaactgcttctcagaaggcaacccatttttgaatgtgagtctggcacaaagaaaaatctatctatttatttcctttatgagataaaaggaaggccaattactgagatagttgcccctgaagttcttgaggaagcgaccgaggatgagataaatacagttgcctctatcgcacaggcatgcttgaggctccgaggtgaagaaaggccaactatgaagcaagtggaaatgtcattacaatctgtaagaaataaaggtttcagttcagctggtaccagcccagaaagcaatcatgggatgcaaccagccctatccgaaacatatgtaaatctgcatcagcctcttggagttcatacaattggtataattaatttagcatcttcaaactgcaatagcttgcagcaagaatttatgttatccgctagtttcgcaaggtaaattatattactccggctattgaattatttctagatgttttcattatatattattgggaacatgtgcattcccacaatcaatctgtatgtcctaaataatacgttttgttctcatttgtgaaacattattaattgtttgtgtgaatttaatgcaatttgttttgtatgcttcatgctgaaacttttggtaagttctcatctcaaattggattcttataacagtgcaacttgctctaatttttttagtgagatgtgtgacttatttttctctctcattttttttacttgctcaaatatatctatcaatattcagtattgtggacctcgtggttttcggttcacctcgtacatatgtttttgttacaagattaataggctagttattgtagcagagacgactcttctatctctgtttgtaatattttcaaatcctagtgcaatgtgtccgcatttggaaaacttccatcttgaatattatggacttcatgtgaaatacttcaagttgcaaagacattcagcttgtagccaaaaagcttgaataattttcagaatgtggaatacttcaagggtttatttcttatttaccaccggcaaattcgcatgattctgagcttgatgtgtcactgatatgtgttccctagacccacatatcgttatgagaggaaaagagaaacaagggaatgtatcaactttccatgcaaatttgaatgatccatttcacgttcgctgaaaaaactgcacacttgatggttcaattacgtcattgttccattgaaaatggtactagatgcaagtcctcttaggctcttactctccaaccggacctgggaacaactactcacgacatcatttccaaaaacaagttagaagtcataaattactgccaaaagatttaacggctttctaataaccccaagctctaagagccagttcaagatgctcagtggaatgtaccatatatcttaaagcacggtgttacctttaaagtaatcactaggttttccttcgttaaattcacgtatatgcatagtattttttgaccgcctcgctccagatgcccactagaatgacaattcataatagccattcttgagcaaatataatttaaaagtgcagtaagaaattggattccacgaaaacattttttccccaaaatatatccaaagagaaaaacttccaagttttaagtttaagagtatatatgtatcaactatgcatcgccatttgcatgaaaagcctactgcagttgaaaagaatcaagtttctatccattgttgagtgagtgcactccatactatagatggccatgtgggccacccggcacagcacggcccaggcccggccttgcctagaccgaggcttgttgggccggcacggcccgaccgacgcaccgggccgtgctgtgccagcccacatgccgcactcacggcccaacactactcgggttgtgccggcccggtctgaaggcacgacggcctatcctgcttttcctcagaataaatctaatttttcttcctcctattgggttgtgacatatatatataactaaaataagtctatttaaggtccctatgttttggacagtgacatttatatgtctatttttagtccctatactttgtgtgccgggcctggcctgctggcccatcgtgccgggccagcccagcgcgccggtggggaggcccaggcatggcccggcggtcaggctgggctgacacaggcccgacccaagtcgggccgtgccgtgcttgcgccaggccaaaatgccgtgccgtgggccggaccttggggcctcgggccttatggccatctatactccatacattaacaccaacagaaatcagtcattcaaaataatgcgttatcccgacacagggacttggtgatcttcacccgaatgtctcctgagtccttcagcattccagtccctcgactcctgatgatttccacatttattccgaccactctacaatcatctgtgaactcaagcaatattctttcttgcaatcgaatttgcaaggtgcgttctgtacagccgtgtgccgcgccatcatactgtcgagtgtcgacagtggctggttcaattcggtgcatgagctacgtattacttgttaagcagtggttgctctcagcatagtaaaaatttactcaccaaatggtgaatgaccgggcatatccatattttctgtaagaagagcagcatcgaacggacaatctcttcccgacttcgaagtctgaaaggaaaattagtaagtgaaaagtgatatgcttttagtattaggtataaacagggcaaagcgtgcatttgctccaatttagtcgctcacttctaattcctcgtgccggtagcacatatttcgtataacatttggcatcatcgacgcagcagatttagaagaaagaatttgataagaaaaggattatggtgtatcctactgcgctgaaaataaaccaatatacccgtggagaggtgacaatctggctgtcaatgttgtgatgggcacaactatctacacatacgtatgggtagacgaaaagctcataactggttaactcgctcagctcgtgactagctcggcttggctcggctcggctaaactcgttgagccagcgttttagctcgttagttataacgagccagctcgatctagctcgagagccaaacaagcctaatgcagcaaatgagcagcccaatcctagccggccctgtaaggccaagcctaatgcagttcgatctcccgtctggctcctcgcccattcggccgttccgggattgggattcgatgacatttccccatgacattctcgatgattgagtcactacacgtgggtccaggctcatgtgggtcccgcatgtcagtgactcaatgtcactgagaatgtcacgggtcacgggggaatgtcaccgaatctgcgtccgccgttctgagcctcgatctaatgttgctcctctctctcctcctgttgtctctctcgccatgagcagcgacgcgctgtccatcttctccctgttcgggtgtccaagtaggtgcggtgcggaggacgacaaggtccgttaccgcggagtccgccgctccgacgtggtccggccggcgccgccttgtccccagccgcgtggtcctcctgccggttcgtgtccagcgcaaccagccaatcccatcctcccaactgcgaacctatcgcaaggtgtacagagaccaaatctctggctgagtcgctggtgcgttgcacaatgggatgttcagaatcaggtgcagagaagacaagtctggtgaagggacaacgggatgctcaggataaggggtagagaagacaagtatcttgaagcgaccatcgatatcctgatgacttccattcaaattgtagctcccatcatcgatgtcaggcaactgagccatttttttccctcattgctcgtgctagcttatcttgccgcagaacccagctgacttagctggctcaggttggtgtctgctactctgttgggctgctactcagggcatgtccagttcccaaacaaaatttttcacgcggttacatcgaatgtttggacacatactggagtctcctatgtagaaaaaaaaaccaattagacagttcgccggaaaattgtgagacaaaatcttttaagtctaattgcaccataatttgacaaagtggcgctacagtaaatatttactaataacggattaattaggcttaataaattcgtctcgcagtttcctggtggaatctataacttgttttgttattagactatatttaatactttaaatgtgagtccgtatatctgatatgcaggggcaaatttttttttgccaactaaacatgcccttattcaaccacagtggctctgtgtgaaatccgatgcacctactggtcattaaccgagcagattttcagtacgaaatctgcaggaaatggattttcaggaagaaaggaacttcatgtatgcgtttttttttaaataaaccacataagacagtacaatgtttcatattggtatagtagaaaaaaaattacaacacaatagtcctggagactataacccggaaaaaagacaaaccacactatgtgcctacaacatatgtcgcactgttgagaacaaaaaggagagcgccgacccaatgcactccattccatccatgtctttgggagtaggggagagagggcgacaatgaagaatggatccgctctcccctgtgaggcctgccaacgtggctatcttgcgttggctagtgcgctgctgctagaggatagaccatctgaagagtgtttcgaaagaaatggcccttcaaacgatgcctcaagggatgttgcgttgtcgatgatgacactatcgtcgtctgtcctggaaaaaccaggaatatatttttttttctaaaggattccaccggagcacaaaggagagacaatacccctaggagggttgtcgctcgaaagcgtcaccactatcggccctggacggactaggctttcacccagagatcttcctacggtcctacctgcagctaccactatttgagcaccttgaacatacagccacctcaccaatgccccaccgttgtgcgcccatgccaggggccctcctcatctgcaaaatccccgctgccaccgctcacccaggtcaccggcactaccaagcacgaggggagggagagcagccaccgatgtcaccataccttgtgccatcgaggatgcttcctcccaaacatccaacaaccagccacactgcccccatcctaaccggcggacagagataggggggggcatccatactaccattcccggcagccgcctaatcctccccctccaatgcgccaagcaaccgccagggcctctgccctcatgtcgcactgcattctctccctccccttgccaaggagggggcagttgcagtcactggtggggatatgggcgatggtcatgccctagctgccgccgtcccaccgacgttgtgccacattgctccttcgtcgtcgccaatgacagcatcggcacacccaccggagcagccgtcactgcatggccagattttagtgtggagggccggatccgtctgcgacctaaccaatgtcgacctaccactgcctccaccatcgtggacaccgacgtacttgccgtaacacccaggccacatcgtcgctgtctcaaggaatgatccaagcaatgtggcccagatacggccgcgacctgaccgatgctgttccaccaccgccgcacctcacccatccgtctccgtcaccgccctggatgccgttgcggcctcctccgcctccatcactgccgtgcatgccggcacaagcgggtcagctccctcagcacattgttcgctggttgcccaacagtccaataagaggggaagaagaagaacagaaccccgccactgccatccttgcagccgcgtggtttctggtggctcgctcaggtggcagcgagggaggaggagggaaggcgggtggtggtgcgtgggctgagtcgtcgcctgtgtcacccggatcagagcgacgcgggggctaagctacgccgcctacactccgtatgtggaaggtgcgttatgcttaccttcaggtatgttacaattggtattctcttatgcatgaacaaatggatccattagtgacataaaaattgttacgtagtttcttgtggtctcattagacagagataaggatatgggagcatcatggttcatacatggtagagagtaatcacatatacaggacattatttcaaccgtctatcggaatatttgttacatcaagtcattgtcaccgtttctctctttttttttctcagatctgctgtaaactgcaaattgtaaatctcctttgcttaatacaaatatacacaagctttatgcatattgtcggaaaaaaatccaatactagccattaagttatatactccttgagtaaatgtatttaagttacatgattctacagcgaaatgtgaagggaatctagcaaaacaaatgtgtgtgggctgccttgctagttgggtctaaacagtgcacagaagtaattcccctcttttggttgtttgcgtctaattcctcaatccggttgcacctattttgcaacttcctgctgatcccaaactttttgcatctgcaaattgtgacagatctgaaaaagaaattgattatgccaagacaaaacaaaccaacatacggaccgtttttttctgtgaaatactgagagtcaaaaaagctggttgtacagcgtggaggtttctttcggctgccttccaaagacagccctaaaccagacccaaatgtccaggcgacgatcccctcgaatggttggctcttggctagccccgaacacaggtcacctggagcaggatcattttttctcgtgctatgttgttggttcagaagactctgcgcgaaggcattgtattcggcagtgccttcttggtttatgaattcgactattcaggtagtcatgccgtgcaaagtatcctgatgcctcgcactccaattttctaccatcatcgatgcctggcgttcctatttgtctaccatcatctttctaggtaactgaatgagtttctctggtttctcgtggccttttttgtagcctatctcgctcactgatgaggctggctgcctgtttcatatttaaggacgcatgctatatgccaaaaactaaaacagtataagctactccctccgtttcaaaatgtttgacaccgttgactttttaatacgtgtttgaccatttgtgttattcaaaaaatttaagtaattatttattttttttcatatcatttgatttattgttaagtatactttcatgtacacatatagttttatatatttcataattttttttaataagacgaacgatcaaacatatgctaaaaagtcaacggtgtgaaatattttaaaacggagggagtattattaacggatgcacatgacaccaccactagcacagaacccaccatccatcacgggtgctaaccctcatctgtgatggataaaagcgtggtcaaggatgtgtggtcgctgatgtaaaaaacccatgcgtaacgtgtgaagatccgacacatttgagtttgacctctaacggtttacatgttaacacccgtcatcgatgtacagtaagtgtgaaaaaaaaaccaaaaatgttaatccttggtctttgatgtcgcattaaacacaatcacaaaaccattagttaggtacatttaattgttcggatctcatattacaatgtaacaaaatctcttgctaaaaagaaaaaaccatctccctcagctgattcacattaatcacaaaaagcaaccctcaaatcatctccccctgttccccacaatcatcaagtaagcagattcacatgtacaaaggcaatacaaatcaaaaaaatgtggacaatagacacaaaattgcaaatgtttagggaagtggggaaaatatttctcacttcagctgcagctacctgcaggtgcttcaaattaatctgtagcgaaacatgggtactacttgcaaacgaatcaagaagatgttctggtgggatgagatggcggcggcagtgtactgtctcggtgagatggatctggccatcctaatcctagcggcgtcggatccaattaagcagcgtgccgatgatgtcaccaaggacttcctgaacaagctggattcatatctttttggaagccacttatggcttttgtgagagttgagtttacaaagaagttcgagtttcgagattagtcaaattttttgagaggagtgcttttattgtactttgtaaaaatgaatagaagtaacaaacttcaatcaactttcgagagttctttgatttgtgtttgctcgtttgcatcgatcacaccggcgagtggatggtggtcagactggcagtttcacgttggttagaccaatggtggttcggcggttagaccggcagcagcggtggtgacaagttttggtcattcagtgtgcacggtcagacccgcccacaaggcttcaccattgttggtatttgttgcatacacaaataaatctgtaaacgcactgataccgccgtaacacttccccttagagtattacaactgtatcgtacacaaggaacgcatgtgtatatctacgaacgagatacaagcattcgatgaacaattactttataaaataagcattcgatgaggtacaagcaagaagaatactaatagctccggcgcttctccggaactccggtggaagaattccgacaaacccgacactcctccgaaagttctcggtgagaactatgatactctggggtactccttccagaacttcccctcactctctcactaacaccacatactaaagcaaagcctaacgcttgagttgatgttgtgtgttttccatgtgagtgaagacctccttttatagtgtgttatgactgttggaatggcgattactcctacgcaaccgcaattgggagagcatcaggaacctacatgtggaaggccaggatgggcggccagtatggttgttcggcattttggccaaactgtgggccccacttgctggctgctccttcggctaggaggctagcagtgggcccctatggtggttaaggatggtgtgttcccactttaggttagttttgactatcatgtgggccctccaatccttgtacttgcgtgtgattggtcggagattcattttgttgcatgttgggtctattttcatccataattgacctgtatacatatatataccaaagctagtggaaatggttattagtaaacccctactactaagtttcgatataaaactttattttgtgtatacatgagttaacgactaaagtttgcactgagtgaccgtcaacaaccagtaaggttgaaggtgtctgtgtggtcagaccgacttgtcaactccggttagaccgatcttcatagttttttgacggtaacttttattttcgctaaaagtttttgatttttggtgttcctaccattcacacctctctagtaggtctagttcttggtattcaatcctacatgcacctgtatggaatcatatatagtgtgctgagaatttaacttacagaagttagattcagataagcatagcaacataatacactgaaaggagatgattttgcaatatattggggatattggttacagagaagaaggaaacaacagaagaaaaatagaatgtttttccttttgaagcaaagaagaacaaatgttagggaaccggacttttactgtgctacttactgtcacctgttcccatggttcacagtatacatatgcgaagtacacagaacaccatggacaaaacatgcactgcacatctattcatcacttcctgccttaacagatcttgtatcccacttaaggtttgtatctattgatgattcgctcatccatttctatctcaggtgcgagtgtctgacagagtgacagcctcaaaaacggtttctctgatcactacgctgatttcatttgggtctgtcaaatggagtgatcagtcggcgtgatgcttaatttcttgatggatcagaagactcggcaggaaccaacacggagctgttccaacactacctgcctttctatgcagccagtgcactgtgatatgccggtaggcacacagtgcaggcaaaatcatgtttagagtaagctccgaccgatatcctgataccttgcattccgaacagtcatcctgcttgtttttcgatctgattgtccatggccatcttttcttgcttatgttatactggctgatgagtgatgaggttgcatggctggctgctatacatatttaacgacagatgctatatgcccaaacagaaaaacactaacttatcattaactcagcggatttttcgtacgaatgttaaatgagagtcgacacctctctttcgcctttctcatttagcaaaggaaagctagctactgcatattaaaactactaaaaatattaagtcccgcctctgaccacccaagacactggcgacttaattaaattggtcataaacgacagatactagaaaatagccatcccatattcatcatggacgaaaagaaaatactgttaatgcagaatataaaatgagcctatgatttgagatatacactatgtgttataaggtagaaaaaaaaatccaaaatgggttggtggtcttgaaattttctatgaaatatagtggctttgacatgtgaatatgccagacagtgtatgctggctgtcaactcacaaaaaattaagaccaccagaccagataaagttgaactatggactatggtaacattggcagcaaaaatgtatggtagtaatagctgtcagataaccttgatcatgctcgacaactggtatttgtgttttgcagctttactcgcttcttcacacgaaaaaaccaacgtagtattgaatgagacatttcctgtacaacaactttgttgttgtttgaacaactgccgcaccatctatgctactgcatgacccccatcctccacttatatatttcttttatccttatattttaaaaaatttaatttcattttacatacaaaattttatgtacttccagggttattttgtaaatttgattttactgtacaactaaaaagcaaagagataataacatctctcgatcttctccttttcgtcaccattcctgtaggctgtagctgttccttttttctctctctctagctgatcattgaagttgaaggagagtccagaggggaggagctttcatgctctgtcaaatcatccggaacctctgtgttttgatgggctctatttttattttactggctcctcttttatttttctatcggatggttaatatccattcgcctattgtttgcttgtgaatccattgactacaaatcaacatatgatgtggctcatctttgtgacatcttggaacttacttttcactaatacaaattagctaccagcctataaacatctatcaatctcagcaaccccatcaatttcaattttcaatggtgaccttctcccattcttagctctgatagagggctcaccaaccatgtcaataaccagagcaaagactcaaaaataaagagctgcatggattgagtgatcatgtccatcccctcaccaaaggaaacaggacacacatgcgcgcattgatgcatttgttctgtgttgggttgcccagcacaatttttcatgctttaatccgttctttcttctcaccaaaggcacggcgatctgcctttgctctgcttcggttgcccagttctaatacctgagccggttttcacttatttttgtatcctggcgtggacgctacgtacaattacagctcaaattacttcggatctttccagaggcatttgggatttcctctaccatatgtggaagatatagaaaaatttcgagaacaaaatcatgtggactatgctattttgcagcaaacaaatcatgcactcctaaaaaacgattttcctggatgaacccctcgtcagattccagacggcccataactgaccgcgtctgaaaaaatcatcctctcatttttgcgtgtagatccttaagatgcacgcacgtgaaaatgattttcgcgggcagttccttaagaggtccacacgcaaaaataagcctatttttacgtgcggacccttgaaaggcccgcacgcgactatcatcttaagagcaccgcgagcgaaaatccccttcctccttaggcattttcccctctcaaccacttcaaaaattctatcttatcgtctccacctactcgttgttatcctatttcttttatctctctctggtctcttctctccacaggcgtggggcacggtgatgggtgcgaggcggccggcggtggccgggaacaaaggcgagcgacaggcgcacggcggcctgcgatggccgacggcggccaggagcggcggcgggcagcggattcgtgcgcacaaccctgtggaggtgcccctcgcccgcccggcataatctggaggcggcgcccctctcccgcatggatccggcggtgggcggcggtgacggggccaggagcggcggaaggcaacggcaaacaacgacaatgacagcggtgaccatgaggtgggcggcggctagggttaggttcttgattttatttttttgcattttttttgtgcgtgcaggcgacataagccaaccgcacgcgaaaatctgatattttcgcgtgcgggtgcgtcacccacatgaaaattttcgtattttcgcagacaccccattgtagacgggcatgagatccgcacgcgaaaatccctttcgaccacacacaaaaatcgttttcgtattagtgatggaaactaattaagatgaggattggtcatccctgatcagtacaattatctcattgttcacgcacgcaagtaaaaagctggacctgcaaatgccatcctggcatcctaccatctgttaactctaaacctatccaaacgtgtccagggacctaatgatggtgacataatgtcccagccctcgaacgatctactagcgtatgcaagccattttgaagcatacaatgatcagggcgcctccactatttgtcttgctggtctagagcactcgataccgagatgttatgctctggcttgaattgaggatgccttattgccttccttcactgcgtgatggaatgttcaggaaggttgccatgtacgtaaaatcaggcctagaataacgtgcagactctccaggctggtgttggtatcctggtgacttccattccaattggctaccatcatattttctaggcaactccgccgatttctctaattgctgctggacttcctctctttttagcccatatagtcgcagaggatagctggctcaggttttgtgccttctactcatttaacctcactggatttttcacattttggtccttttgaaaaacttatttcgcaaatagacccttggaaaaacttatcccagaaatggtcctttttggggccagagtggctggcgccgtcgtccaacttgacggcgctagcctctttggcgccgtccccctgccgacgtggcggggcgatgctaaggtggctagggggagcgcgtcagaatggctagcgccgtccccccccccccccgaaattttttatttttcttttatttgtttaatatttttttcattcttagggacacacaagaaccaaccatagaaaaaatgaacccaaatggacgtaatatgtgacctgtaaaatttttcctctcctatcctctctttccgaactagtgcagaggagagagatgtgcaacttttttatttttattttatttttttgatatttttttcacacttaggaactcacaagaaccaaccatataaaaaataaacccaaacggatgaaatatgtggcatgtggaattttccaaagctctaccgaaaaacttctctcctcgaaaacacaatcttgcaagcggaatttggaggttttaatattgctgaactttttatgtagatgtacgtggatatattatttgcctgatttcgagtccatatgagaaagttacgcctattttaataaatgacacatgaatgacttttcgggagagctttggaaaattctagaagtcacatattttatccgtttaagtttattttttctacggttggttcctgtattctcctaagtgtgaaaaaatatcaaaaaataaaataaaaataaaaaactacatcatttcatgtggttagagattaagtaatttcatatagtggtagagtgattatgtttaacatgctaaaggagttatggtttaattttaatgaaggtgcaaagtaggctaagtggtatactattttcggatatctagctaaatggtatattccgttcgagtttaattttttttctctggtagttggttgtatcgtgatcttaagtgcgaaaaaacattggaaaaaataaaacaaaaataaaaatgttgcaactctatatagagaaacaggaatggaggcgaggggtggggcggaggggggcgg

SEQ ID NO: 40122 - DNA, 9437 bp, Oryza sativa
ccgtcccgttggacgacggcgccagccactgtggcgccccaaaaaggaatatttctgggataagtttttccaagggtctatttgcgaaataagttttttaaaaggaccaaaatgtgaaaaatccagtttaacctcagctgctctggggggaaatggtacacatgtcaattttgcgtcttccgcctatccgacggtgacggatgaggtgaaaagagccaaatgcacatagggaagtgggtctcacatgtcatctccatccatcatcttctttgctctcccaccatctctttctttacccagaaaaggatgctccatacagctcattagctaaaaggattttcagtagtaaagttgcatggaatggagaaccattttcctttatcactaaggaaaggattgacacatgataccagtagtgaaaaataactagttcacccggaatatttgacgtttaggataagatttgatcaaaatcttttataacttttattatttgacaagagattggtagtttgtgtcaagagcagaatgaaactaagtaagaagaatagaagtttgtggaaccggttaatactttttccatttattggatgattttaatcctctatccagtgcagtgccacctgggtccaatcgttcatggaacatgtaacaaagcacacaacacgcaacaaactaatcaagcacgctgttcatctcttcctctcttcattgttctcactagaggcttgtacatattgctgcttctctcgcccttctctatgatcacgtgatatgcagtaaaagtcccaaaactccccattctctttgtgtttcagaagactcagggcagatcaacatagaactgctctagtcgccaatactgttggcccaaaaccgagagacgttagcccaacctggtgaaaaccttgctacactctaaaaggtagcttaagaggtgagggactcccctcacttacttttaagttgattcaactccccatagataagcaatgtgggactattcccaacaaatacctccacggtgtctgcattgtgatgttaagctaggcacactgtgtaggtaaaacacaggtcttgcataaagctcaatttctcgtacagtaaaaaacttctcaagggaatggcccctggcccagatttccatataaaggatacggcgaggaaaaaaaccttctttaacctgaattctaattgattggatatcctgcataaggaatcgaaggaagacccaacgaaaaatgcacactactcccacttttctatcaaatcggtcataagcactacctatattccacaaaatagtgccccacaagtaggatctaataaataggcatgtgattccgtagaaagacatcacgaccccctatgaaaagaaaagccagctccggttggtgtcctgatgccttgcattccaattggctaccatcagttatctaggcaactcgttacaggctgctaagactggctgccccctgcttatttaaccgtagttgctatatgcaacaaaaaataaatatgtgtgcattgttgactacaacaacttcgcattgattcgtgttggtgtatgtgtgcctttgtaatgctgccctgaagatgtttgcctggacaatttagaagtatcgtacatagacttaatattatttataagttctcatagatgtttagttccaatctcatgcagtgatggattttttttttaaggggacgggtagggagctcctacaatttcactatagaagaagggagatctgaggatgatgggtcccatggctacacccctagtccgactcctgcgaaatctggggcaggttctcacatttctccatggggagaacaccctccttgcgatttccagtactgcggcgaaatcggggatgaccgccaggaggaagaaaaagaaagggaaggttgtacaagtcgcccgcggcttttcagactatatagtgcaacttgtctccctagctctcttcttttctcagaactagtctgctggtcgactagaaaacacgtgttatatataagtccggatattcttccggttagttctgactcctctaataggtgtgttgcatgctacttaattacataatactgtgccatggtaaattaaaccggcaatactagtacacaaaataactaggagattttcagggattggatgaatcgagggcttttacttgcatgtgaactctgctggacaagagttaatttaattgttttgggatgatgtattagtcgatcctgtcagattaaatgggggaataatgaaggtgcacagtgattcgatggctagcttttctgagaattatggtgcaactgagccgttaatcctgtcaataagtttcgcattggtgagctgcatgcatcagccagttcaggggaaagtttaaaccaatggagaataacatagttcatttatactctaatagatgcaagcaggcaatgtatgcgtaagcttttttaagatgttaacttttgtaaaaaatataacggaacctttattgatcattgttggagatagatcgtagccagtagcccaccctttggctgtgttctttccccaattttcccaacccacctgtctcgttttccgcgcgcacgcttttcagttgcttaaaaaatcatattaatctactttttaaaaattagttaatacaacattaatcatgtaataaaacgagcttcgttttgcgtgccggacggaggggttgccaaccactcctcccaaacgcagcctttatattgggacgaatcatgaacagagtggatggcaaaacaagaaaatactagtgatgccaagatggcaaagcacgccgaaggcgatgggaccactcctatctaaacttgtccaaaaaggcttaaaagtacagtttgtccgagtgaagggacaattatggaaactactactagtaagatcactttaaacctcacgatagtttggatgttaactacctgtaattaattattaaaagaaaatgacaataaataagatgtcctagtgagttacaatcacaagcgatctctattcaaattttggacttgtctaacatgtcactagacccatgtgatagcaggtcacgctttcacggttcatattcgtactagaaatcagaatcaaacgagcttttatccttttattccacatgagatttctattctcgttgagctcatcttagggcacctgcgttatcttttaacagatatgccgcccctgccaaactccccacctgacaatgtcttccgcccgagagcttccacttatcctacacctctcaagtcatttcacaaagtcggactagagtcaagctcaacagggtcttcttttcccgctgattccgccaagcccattatcttcgctgtggtttcgcgggatagtagacagggacagtgggaatctcgttaaccattcatgggcgtcattaattagtgtcatagggcctgttcactttgatgccaaaaaaaaccttaccaaattttgataattttggtaggatttcttatatagttaccacaatttggcagcaaactaaatgtagccacttttttggcaactttaccaaaatttggtaaggttggaaatggcatcaaagtgaacaggcccatagttactcccgccgattacccgcacttggttgaatttcttcactttgacattcagagatctgggcataaattacattgcgtcagcatccgcgaggaccatcgcaatgctttattttaattaaacagtcggattccccttgtccgtactagttctgagtcggttgttcgacgcccggcgaaggcccccgaagggggccgttcccggtccgtcccctggccggcacgtggcggatcgatctcatggcaggatggacagacagtaacttgggcttcgtggcattgagtccagcaggctgtacgtgttctaatttctatcccagcgctagagattgccatttgaatggcaatccgagttcacaaaccctttttctcagctgtctcacttatggtggcaaatattcctagctcaccaccgctgatggacatgtaaacattggtaaacatggtctggatactctgtatattaggaacgaaattcctgataccttctattccatgcatacagctgcaactaccacgtatcatttggcatcggcgtcttatctcattgacctctcggcatattcaagggctcaataacatgatcttggtgggattggtgcgtcgggtacttatgcatatgaaaattgagttggtcatgatggacatgatgaaaatacaattaatgcacatgcattattccaggaataggaagtacattgctgtcacaattcatggtgtgaaatatatatacgcgtatgtgcagtatatagagctctccaaacatgtgaaatattcatctggtcctatttacaggctaaagcttagtaatagctactaaattttgtttttccttcacttaattatgatacaaattttaggagcacacctgttatttgcattcacctagtatataaatatatactacctccgtcccaataattgtatttctaggatttaaatttgtcccaaaatagttgtcacaatagagtagtaattgtctcattaatcacttcccattcaaatttctccctattttaccctcaaccacctttccacttttatctatacaccatttaacgagggacatcatagtctttcttctcaaaccttaatatatgccaaataacctagaattacaattattttgggacggaggtagtatgtcctactagatgtaacgggctaggtctacggcgaagtgatcaccacaccgagatatcttccaagtgatggtagtgtcaaagagttatttaatggtaaagaggcttcctcaatttaaattgagggctagtagggccatcctccaacaaatattattcaatagatggtttatatatatggttcgagataacgttggcaaaatcctatatatgccatgaaacacctcatctgtgacatatgacaaccctcatttgtgatgggattttggtttcgatgtagatcttatgacttataatgcatatatatttgtggatgtaaacgatctctaataaaaaagttgtcagctataagattgtatatatcattttgatctacaactttaatatatcacatgtctccatctgtgattgtttgcaaaattgaaaattttgaattttcagtcattagtaatgtgtcgtaactaccaaatgttgggtggtagttacgacccatcacgaatgagtgactcgtttatggttcatagaaattatctgttacaagttacaactacgctcacgtatgtagtgagttgtaccaagtagccacattttaaatgagttaattttcgacctgttaaagataagttatctgaaaacctgttatatatggaaccaggatctgtgatagaaatgagcataaggtaattcaaatcatgttattacttagaaccctaccgtacagatttcttccccttaattactactccctctgtcccaaaatataagcgtttttagaccttgacacaatattcgagatgctactttgaccaacaatatctataaaagtaggaaaaagtacgaattacccccctcaactatcgtggtctatggaattatacccctaaactgaaataacagacattttacaccctaaagtattcataccggacaaacaacccccctcaacactattttgagtggttttcacttgagcttgcacacgtggcgccaacgtggcaacccagtcagcaaaaaaaaactccctgggcccacctgtcatgcccatccgctcggacggccggctgccaaggaggaggcgcacgcattggatggccggtggcagaggcggagctcgcccgagcgtccggctgcggaggtggagattgcccgcaccacgagcggctgaggcgaagctcgcccgtgcgaccagcggcggatgaggcggaccgggtggccaacggtgggcgactgagatagagatcccctgggcagcgggcgactaaggcggaacatgaccaggcggccggtgttggacgtggagcacgcccaggtggtgaccgactgaggcggagctcaccttgaggccggcagcagaggtggagattgctcgagaggcaggctgcttaggcggaactcccccgggcgtccagcggcggaggcggagagggacctagcttccgccagcgttggtggtgctggtgctgcgtgggacagagagctcacgctcccacaaaggtgacggccctccccttcgtgctcaccgcctgccctcccgccacgcctaccacccgccctcccccattgcgaccttgtctgtccggaccaccgccgacgtcgtcgccttctcctcccagaccgccgccgtctcctcttccccgcccaccgcctccgcactgcaggaaaggggagggagtcgaaagagaaggagaggggaaagggatgatcagcggtggcggccctcctcactgccatccacctcctgtgcggctccatctcgtgcgtcgccgccgtggacgtggccaccgaccctcgtgcgtagcatccgtgatcgcagccggccctccccgccgcatccgcagtcgccgcccaccctctgcgccgcgcccatcgcgcccctagcggtagagagagaaaagacacagaggggtagggtatgactatgggcccatagttttttattattatttttttggaattctgcattggctccacatgtatgccacattggattaaaaccagtccggattgaacaagggggtaatttgtccggtttcaatagtttggggtatcaaatatctggttttgtgggtaattcgtactgtcatgattgttcagtgggtaattcgtactttttctataaaagtaatatgttataaataaaatgagttgcatattacaatactttgtttaatgataaattaagagacataaaatttacatgattgatgatccttttgtttgttttgctattaatagtcaaagtaaaatatatttgacttgacactgctaaaagtgtttatattttatgatggagggagtaggtgattaaatttctcatgaagccgccgtcactgcgacggtgtgctctggcagggcgcaccctggttggccaactagcagctaaggtagcgcacggaaagctatccccgttgagaggtagtgaacgctgaacagtttccttcttctcgctgcatggagccgatttggtctccatcactaaaacttcattgcaactggtacatggaataatctgattctcaaaactcaaattgtaaaagttcagatgcagtgatagaataatttgatttcacctagagaaaaatacatccaaacacaaaaaaaaagtaattaactactcatttacaaaaatgtttaacaaccgattgatggtcatccctcgcgtgactcagcattctattcaacctgtgcccttgaaatgcttcacgtagtaccgacaccgtcaggccccactggttaatattacttaccacgaaaaacttctttatccgggcgatccatatatgctgagttggtgaattaattagcatcataacaggatgcaactcatggctggtcatcggcacagacaacttataatgtttgcccgtgcagttttgatcgcacgacggaaatataggtgcaccatccgtggtaaagaaggtatacatcgacaccctagctaaccaagcacgagctgtatccccaaggccttccattccaatttgagcaacccagtaaatttgccctgtgaggtatcatcaaccagtctaatataaaacgcatgacgttttgcgagggtatggtttgattggttgtgttctctgccatcgagctgccaatgtcgtctggtggtggctgctacttttatgcagttaggcatcgatctgcattctgtctcactctctctgaagcaaatgcttattgggcgcaaatagctagagtatggatgcattcctttattgcggttggcctctgatttattactagtgtttgtgcacgtactctctccatctcataaaaaaccaacatattattatattcgacacatcatattactacgaacctgaacatatatctgtccagagttgttctattagaatgtgtcatatctagttatagatacgttttatgtgggacggagggagcatattacatccggacatccagtcattgacagggatcggtccctagttaattaatatatatgtgtttgtgcacatgtattaattcgatcagggctcacactgaggccaagtttagttccaaattttttttttcaaacttccaacttttccatcacatcaaaactttcctacacacacaaacttttaactttttcgtcacatcgttacaatttcaaccaaacttacaattttggcgtgaactaaacgcaccctgagttataaggattgtattgggctacagtgcacagtcctttccactgtccaactcaactatttttatttgttagcctaaacatatatacaaaatttctttcaaccttttggcattttttcccccaaccataagaatttctgggctaaaagcttagacccatcaattaccaggtctgcactgagtggatgtttcacacaagtaaccatgatgcacgtataatttgttctaaacagagcacatatgcaaaatgtatatactcaagaattaaagatcaaataaattgcagtgaaaagaatcagtggacaatgaaaaagttaccaaataattgcttccctcatatggtaccggtgacataactagacgaaaatatggaaatgcccaaagaaaactaaaagttgtgacgaagttacaataacattggaacattatatgtacatgccaatgtgactgtcgaactaataaaaatcaggtggctgacgagcaaaacagatatataacgtcaacaaatacgatggtagaatattatgtcgggatagtaaggctagctagtgtcacgaaccaagcaccacccaaccaattctcaatgcacagaggcctcaatagattgcaactgctcaaatacaagtgttttgggatacaaattgaggagaaagagaggtatagactgggaagagagatcagacaaagaggaagcaggagattgggactagagaataggaattgagagggaaggtagcagcaagaaggaagaagccagtttcatccaatctgttcgatccttctccaactaccagttgcctcttatatcagtttcccttccagccatttaggcctaggcctgcccttgatgcccggcccaggaaccctgtaaggcccatatcgtgacagctagcttcctcgattggggaaatatttatgtgcataaaatataattggggcaaatatttatgtgcaagcgaacaatcacaagtaggggtactgaggagaattctgaactatatggcagagaccctcatctttgtttgcccttct

SEQ ID NO: 40123 - DNA, 11403 bp, Oryza sativa
catgcaaatatcttgcccaaaatttcctcttcttttattgaattcggtaaaagaaatgttcaaatttagtcaaaattttgcaaaattttaaagtactttggtgcagtaaagttccaaaaattttgaaaatattggtgaaaaatcagaactttcagaacatttgtgaaaaataaaagtgtaaacctccatgatacactgtatcgacatagaatttagtcaagcgatccgcgtgtgagcttggaacgcagctgatgtcactctaaattttttggtacagtctattcctatactccatccattccgtaaaggccaatctgaaatataatatgacatttttctagtagaatgaatctgaacataccatgtctagatcttcattacactagaaaacatcacatgttatccttggttggttttcatgtgaccgagtgagtactccactactttgccacatggctactcatgtttgcttcattgcttgtaataacatggatagtacatctacaactaccacatcgtcaaagatagtcagacagacagtctaaacatgataatggcattgatcgtgataaaactgatgattcggtcgacttctgccattagttttgaaagaagatgaaaatcatcaaacgaaaaggtcctatataccatcaagcatctcgaagcagcaactgaaggacaaccaatggagcagcaaggccaagcgtttgcagaactccaccaccttccagcatgttcattggagcagacgctacccgaaggatctcgtgggtttggctacctgcgagaataagaatcactatcttgctggcctctgtagcttgctacaatttctagtaatggaccatcacaattagtgcgaaacaaggtgcagagttggatggaacagtgatacctcgtgcgtctcaaattcctcataccttccattccgactggctgtaaagagagccggcgtactgtgcaatgaatcgtatacaaattaaaggatcaagcaaactggccaactgtatgtatatgagtttgcttggaaacctagctggtgcttttgggatagtaaccatcttttgtttagtcaggtcacgcagctggggccgaatgagctcaaataggcgttctgtgtcagaaaaaaaaaagattgtagcgcccgttccgtcgtggcgcctagcgggaaaattatctcttcaaaaccctaattgcgaaatttgattctttgcttgttgtctagagtccgtgccatctcaagatctcaaatccccgatctatcgtctagttcaattccgactccaaatccttccaaatcaaagtccctccgcaaaagtctattttgcctcccccgggttcgatgggccgaatctctctcggcccatctccccctccctcccggcgctctctctctctctctctcgctctctccctctctcccaccccctccgctccgccgcgcgccgcgcgcgcgagcgcgtgagccgcgccgacccgagccctcctctccgctccctcgctcccgctccccgtgcgtcgttcgcgcgcgcgcccgcgtggtcgtcgcccgcatcgtgcctgcgctgtctgcgccgcccggccccgctgcccggccgcgcctgtcgccgcttggcccggcagccagtgcgcgtgcccgagccgcgccactcaatccgccgcgcctcccgttgcatcccgcgcgcgcgtgccgtggtagccgaccgcctggtcgccgccgccatcaccctctgccgcgcctgcccgcgcctgtcgcccgtgtcgccgctccgctccaaaccgccccgccgtcatcgccgtcgtcatcgcctcgaccccgccactccgcgcgcaagccgccaagggacggaggcagagcccccctccctctgccgcgtcgcccccgctcccctcctccttttccccaaagaggcaagggggcaagcccccttttctctccctcttttccttttcccctccccgccggcgtcatccgcctctgtcaccgttttggccgcgagcgccgagcgccagctcgcgccttgaccgcccaaggtcggtttccaaaccgacatcgtcgtcctataaaccaaggcgccctcccatcgatttccccctcccgtttcgctcgccgccaccgcgccattgccgccgccttccgtgctctgtctcgcctccgccgttcatcaccaagcaccgggagaaccggtgcgttcgtggacgcggaaggggactccgggcgcgccctctccttcctcttccccggcccgaggccggagagattactcccgcgccgtcggcctctcgtcactgcgccccgtccgcacggtagtgcctccctccgttcttcctcctcgctccatctctcccccttagttttcggtagtagcatgtgtagcctccccgtagctagtcggcgccgccccgaccgttgccgccgctcgccatgtgctcgccgccgtcgccgcccgtgctccatagcacccgctcgtcgccggcctcgctcggcgtagcgccgcccaatccgacgctagggacggattcccgtagccgcgtagatgctctcaccgccggggattggcccctcgtgacctcgtcgccttttccctcttccctccccgccggttgctgccgccgcaatccgccgtcgacgcactccctccggcgaatccgagccgttggctcgtctcccctagtcctgagcaaccactcggtgtactcgctttcgcctgtaacgccatggttcgctccgccgctcgccgctgtcgtccgccgtccgttacggccggcgtcgtcgtctacctcccgccagcccgcgtggcagccacgtaggcaccacgtcggcgccagctcggccgagattggcccgggccgaccccggtcagcccctcccgtgcgcgcgttccaccgcgagccgtgaggctgcgcgtgggcccgccgcatccgttccaccgtgtccctcccccgtccgcgcgcgtgcgccgcgtgctcgctccgcacggtaaaccaagtcaccgacaagcgggtcccacccgggaccacgcgtggtgagcccggtccaccggctctctccctcctccctcccgcgcgcgcgcgccctgggccgccttgggccgtcttgggccggccagcccatttagctcggccggaccgccccatctctctcgggccgcgccctagccgcccgaggaaaagtctaatttccctccttcttttcttttcttctctattcttttttcaaaaaggatttaattaaatccttttcctttagaccaaaaatccaataatcttagaaattcaatatcttcccaaccgtaaatccatttgactccgttcaacttccaaaattcctcaaatctcgagatctatctaatggcatgcttagaggtcattaatagggctttattttcgctgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaatattatgcattgataggatcgcacttaatctgttgtcccgtctgcaaggcagattggcggacctacctaatttgttgcatttgatccttcctttgttaattgttatatcatgttcccttgtaaccatctagttgcgcctcgatattcgtgcactctgtgcgagtatcgacggtcgccttcaaacttaaaatctgagtaacaacttgggtaaaacttgggttttacaaaagacttggaaaacccgatacctgggtcggtgcttgtgaactaaatgaatttccaaaaccgcagaccggggaacgtaccgggtgtacggttttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctcgcacagtatggtctgggacctaacctgttgttggtctgggacccctctcgtcagcatatggtaaacctgtgtcggctttggaaatgccttgtcatgaaagcttggaggtcttccgacgtggctgatccccacgggctgggtgatccgggttagtaatgtcgtgtgggtaaagtgtaccccctctgcagaggttaacaaactgttcgaacagccgtgcccacggttatgggcggatgtgaggtgattcctagcgtagttttgtttgactactgcttgtgaaattgctgttgtggaaaggggttcgctgtttgaaaaatctgcagctgatgggatcagctaggcccgggtggccgtttgaaagttgttggccggggtggccatttgaaaagctgttggccgggtgccaaccttgattcaagtctaaagactgatacattgcacatactccgaccgggcaagacgcactgtctcaaccgtgtcgtttgagaagcactcacttagttgtttttagaaaagagttcaaataaaatcatctgcaaaaacaacagcctttccttgaagcctgcattaaacacttatttcccttggcttgctgagtactcccgtactcatccttgctctatataaataatcccccctagttgctgaagaagatgaagcggatcctgctgatgaggagttcttccaggagcaagccggctacgatgagttttagggtttcggcctagttcccaagtcacgcctgtgttggttggtcctagtcctggcttccgtttcctttttgtaatgcagttgtgagctcgggatctatccgtagcccaacatgactgtatctctactctataataaagagaccgttgttgctgtgatattctgtctccctgtgataccagcactgtttcctgggactggtatcgatcaacaggttaatttggagcgtcacgggctagttccggtcgggattagttcggggcgtgataagagatggtatcagagcacaggcttggccctagggcgaaacccgacgtttaggacgaccctaaggatactaaattcaaaactacttgcgaaaagctaaggattcttttgttttctttattttcaatagtttgtttctaaaatggttactgatctttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactgtgagctctctatgtacctttacccttgtggaggtatacacagagctggccttcgcccacaccacttcactgtggccaggcccactctccagatcgcgtaccaggacctctcctggactgcgcttcgtcgcctggcccacaactacagccaccgtctcgggggctccgccttccggcagcttccacgccttccttctggccacgcagacgccaggtacccttgtccgtacagcgagtctcagccagtgctgactcgcatggttgagctttcggaggctcaggccactcagcacgacctactccttgaggcttaccgctcccttgccctccgctacgccgccttggaggcccgtctggccgaggagggtgtcacctcagttgacactatctcttgggactcaggtcgcctctatcacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccctagttgcttcctcccgccgtggcccacgctttatccgcactgcgcggaagcgtgttgttggttcttctaccgtgttccgattccactacccagctcccccaccgccagcggcccgtgctgctgccggccctcgacaggttccgccggtcccttcgcgtcaaccgatcgacgtttcttcgactgaggagccgaccacaggaggcagccaggccgacgaggagtagaggaggcagtcttcagcagccgtccgtgtgttaggcccttttgttccgccgccaactcttttggagtcgtggcgaggtagtgcgtgcgtgtgtttgatgtgggtgttgattggtagtctggttctcctaggtggtgtgcgcacagtcaagctcagcgtagctctgtgacttgtccacacccgttgtatcaggtgtttttatgatttgaaaaatccagtttatgcctagtgtgtgctatctgacttgctatttactttgctccttgccctcctaagtgcttgtctgactcttacctcgccctcttctgggagtttagatggctagccgcccccgccgtgcagctcgtgcaccagcccgcttcggttttgaagaaggtagagttgagccagaagaaaatcatgagtcagctaatgagcagtctcaccacagcaaccgttcgcaccgtactgcttcccgcaacgcagaagttgagcaaccccgccgcagcaaccgcttgcatcgcacagtttcccgtaatgcagagatggaacagtctcaccgctctcaccgcactgccagtcacaattctggagaagaacgcctcccttccccacctcatgtggaaaacaacatgcagcacctgatggcggttcagacacaaatcttgcaaggattagccgcagccgtagccagttttcagcataatgcgcatggaaatggccaccctcacatgagcaacaatagatccaagctgacagattttctgaggtctcgtccggcagagttctctcagaccgtcgagcccgtcgaggctgaaagatgttgatagaaaactcaacttagtacagtgtactcctgttgagaagacgctctacgcctctcaccagctaagaggacctgctacagattggtgggagaattactgcaatgcacaccctgaacccactaacattgcttgggatgagtttgcgacggctttccgtgcagctcatgtacctgaaagcaccattgatatgaagaaagaggaatttaacaggcttaagcaaggcaacaacagtgtcaatgagtacctaagtcagttcaacaaattggctcggtatgcccctgaggaagtggacacagacaagaagaagatcaagaagttcttgaagggaatcgcagttggaatgagactccagttgcttgctcatgacttccccacttttcaacatatgatcaataaggcacttctacttgaggatgccagaaaagaggctaccgaagaatacaagaaacgcaagtctaaccatcagggaaattcttcccgaggcgcacctcgccctcgctatggtcaacccatgcaatatcaccaatcggtcactcaggctaaccgccagccaggctacgcccctcgtcctcagatgaaccgtccggcaccccagccacagcagtgtgcccctagtggcaatactgcgccaaacagtgttacctctttcaagtcaccgcagggaccgtcagcagttcagtgtttccggtgcaaccagatgggtcactatgctagacagtgccctcagaatcctaccaacaccaactcagggcatgctaatggcagcactgccaggactcctactccagcggcagctcagtctcgtcctagctctcaggcaagtggacaaggttcacgtgcttccaacaactttggtcgaggccgggtgaaccacattcaagctgagaccgctcaggatgctccagacgttgtgatgggtatgttctctgtcaactccgtacccgcaatagttctgtttgattcgggagcttcccattctttcatatcacaagcttttgtgaaaagaaatggttggaaaacccaaaatttacgtgtaccaatgatagtactttcccctgggaggaatataagggcgactcgaatatgcccggaagttaaccatagaattgaggaagttgacttcctagccaaaccgatagtcctagactcacaaagcttggacatcatcctagggatggattggttggctaagcacaaaggacagatagatcgtgccgaaaagtccatcaccttgcaaggacctggaggaaagcaagtccgctttacctctaacacccctaccgcaagtcggtctatcctaacctgtttacaagtcaccaccttggagtcggtgcccatagtctgtgaatatcccgacgtatttccagaagaattaacgagtatgccaccagaccgagagattgagttcgccatagaactggcgccaagcactgcaccaattgcaaaaagaccataccgaatggcagctaatgagttagcagaagttaaaagacaaatcgaagagttggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttgttcgatcaacttaaaggagcaagagttttctctaaaattgacttgagatcaggttaccaccaactgaaaatcagaactgaagatatcccgaagaccgctttctcaacgcgttatggtctatacgagttcacagtgatgtccttcggactcaccaatgccccagcattcttcatgaacttaatgaacaaaatctttatggaatacctggaccagtttgtcgtggtgttcatcgatgacatcctgatatactccaagaatgaggaagaacatgttgaacacctgaggctgataatggaaaagctcagagatcatcaactattcgctaaattctcgaaatgcgaattctggttagaccgagtagcatttcttggactcgtgatctccttcaacggtgtcgaagtagatcccagcaaggttgaagctgtacttgcttggaacccgcccaagaatgtgtcagagattcgcagcttccttggcttaactggatattatcgaagattcattgaaggattctctaagctagccagacctatgaccgagctgttaaagaaggaaaagaaatttcactggtctgcagcctgtgaagacagttttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagcttaggcctcatgaagtcaattatcccacccatgatctcgagttggcagccgtggttcatgctcttaagatctggaggcactatttaatcgggaacagatgtgaagtatacaccgatcacaaaagttttaagtacatcttcactcagaccgagttaaatatgaggcagagaagatggttggaactaatcaaggattacgatcttggaattcataccaccccggtaaagctaatgtggtcgctgatgcgctaagtcgcaaggcctattgcaatgtagctcaaatacggcctgaccaagatcgcctgtgcagagaattggagaagttgaggctgatcatggtacagtcaggtgtccctgccagcttgacagtacagcctaccctagagtcgcaaatccgagaagctcagaaagacgacgaagggataaaggagttaacaaaaagaatacaagagaagaaagacaccgatttgtccatagacgaccaaggcacagtttggtgcggtccacgcatctgtgtaccggccaaaaaggagttaagagatctcatcctaaaagaagctcatgagtccgcctactccattcatccaggaagtacgaagatgtaccaagatatcaaggcatacttctggtgggctggaatgaagcgagatgtcgcagaatacgtagccttgtgtgacatttgccaaagagttaaggcagaacatcagaggccagctggtctgctgcaacccctaccgattcccgagtggaaatgggaagagatcggaatggatttcatcaccggtttgccaagaacccctagcgggtacgactccatctgggtaatcgtggaccgactcacaaaatcagctcatttcgtaccagtgaaaaccacctttgatggaaagaaactagcagaactctaaatgacccatgtcgtatgtagatttggctgtcccaagaaaattgtgtcagaccgaggcactcagttcacctcaaggttctggaagcagttgcatgaagccctcggaaccgatctaaattttagtacggcctaccatccgcagaccgatggttagacagaaagggtaaaccaaatcctagaagacatgctacgtgcatgtgccctggatttcgaaggcacttgggatcgttgtttgccgtatgctgagttctcatacaacaacagttatcaggccagcattcagatgtcgccaaatgaggcaatgttcggaagaaagtgccgcactccctagtgctggaatgaggtgggcgaagcgctggtattcggtcctgacatactcaagtcagcagaagaacaagttaagctaatccgagaacgtttaaagacagcgcagaaccgtcagaaaaattacgctgacaatcggaggcgtgaccttgagttcgaaaaaggagatcatgtatacctgcgggtatcacccctccgtggtatgaggaggtttgggatgtccggcaagttagcaccccgctacattggcccctacctcataactgccagacgtggcgaagtggcttatcagctcgagttacctgaaggtctcgcagatgtgcacaacgtgttccacgtatcccagttaaagaaatgtcttcgagttccagaagagcaagtcctcctgggtaatatcgagctggaaaagaatctgacctacaaggaaagaccgatcaaggttcttgaagaggcagaacgtcagactcgaaggaagaccaccaagttctacaaagtccaatggagcaaccattctgaagatgaggcaacctgggagcgagaagatcttctccgtgcagagttcccggagctgctcccctaggtgctgaatctcggggtcgagattcttgttaggggggttggtctgtagcgcccgttccgtcgtggcgcctagcgggaaaattatctcttgaaaaccctaattgcgaaatttgattctttgcttgttgtctagagtccgtgccatctcaagatctcaaatccccgatctatcgtcgagttcaattctgactccaaatccttccaaatcaaagtccctccgtaaaagtctattttacctctcccgggttcgatgggccg

SEQ ID NO: 40124 - DNA, 1358 bp, Oryza sativa
gttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcacactccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatttcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgggttgacctcctccacagaagtctcgtttacttcagcacttggtccctcgccatcatccatgttcatctgcacacttggatccttcgggtgaacaaacggaaccaaagctagaggccacccgcgttgcaatgcattttccaaataccatctccacactcgagagttttgaactggcattagttccgaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggcccataacggacgtttcctggtccatggtaaacttgaaatatttgtttgttcgacatatctgtcaacgaaataactagatcatattactctttcatgcaataaacatctacaacgtaatatcttcttgtgtaagccaatgcaacggtaatgaattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaattagcgtctgaatccggcagggcttcgccccttcttctcttctcctcccctctcttcttttttttttcactggaattgaggagagaagaatgagggctgggggctgg

SEQ ID NO: 40125 - DNA, 12326 bp, Oryza sativa
tttataaaactggaactcaggaaggctttatttcctcaattgcatcaaatactcgtcttcaagaaacactagaaggatgattcttttcagtagaacatgaggttagtagtactatgttttctcctttagtattaataatatgtgtataaaataacacattcaagttatatagttgattgaaaatatgctttgtttatattagttatatgaaatttccaaaatttagggcgtatttctttcaggggccgcaaattcctggagacggccctgatgagtgcatctgtgctggatgagaatgacacgttcatatccattggatttccatgaacccttgccatgtcatcatttcagatagattcggatcggatcgaattgtatattttccgaaatttattagctcttctatgttacgatgacatggacaatggtaattaatagctgtctaaaaaactggcaatcctaccaatctgttgatgtgaaggacttaacaaatatttattgtgagcactcctagcacaagttaaaattgaatattgatgtacgatggcaaggatgaaagaaattgtagaaaaatgatttagtcaattattgttttaaaggaatatcctctagacgatgtatattccaaggtgtgacttgccattagtaatttagtatcttttactgtatgtctgtatagttcatgcgcacaaacttggtgaatgagttaaacgggaccaaacaactttaagcagagcaaatgcatgcatgttctgttgacagcatattacatgcattgtgcttttcatgaatcgcagaggagtgaatgcatttgatgcagctctctgtgttgacatcatcctttggtgtaagctatgagcctcacaatgagacacagatactgtaattagataagtagcagttagaaaccacaaatggattgccagatgacggagcacacatccacaattttttagggtataactggcgggtattatcagggaaatcgcttgagttgcttacatacgtggcgctgcctagtaggaatggaaggaatcaggcatatctccttgtgctatcttggacgtcacagtgcatccgagctgaaatcggcaagaacaagcatcgcatgggtctctaatgtagttagattcattgtcttttacacctatcccgagaggatatcagaagaatcaagatcgaccatagttgttggtgcattagttgaaggtgtatttatttatgtgaaatcagattactttgagaatggaactaaactttcaccacttgaaaattatattgttttgaatgtggaattcttacatgtctacatgttacaatacagtttcaccccaagagcagatggacaatatataatacatgggccatatgggcagtaccattgaccaaactatgacacgaggtataaaatttgttgaacctggataaatcaatccatgctatacaactacttgcacagcttctcggactgggagacagcaggaacgactctatccaagagtgcagaacatgaaagtggtgctgctcatgcactagtgctatgggatatctggtgatcggtctgcctctgccctcgatctgctttcagttaccttcagaagctagcaacttaattctgctagaaatatggcacctcccaaaagttgggttgttgtcgtgctttggggcgaggaattgaaccagaccatagaaacgtctagctgcagcctgtattgaagtgcagtagagatggattacatcaaatatgtatgcaaggattaattgatgaaatcactatgttcccccaactacagtaccgtgttataactgtttagtcactcttaaagattacgcagtagtatatgtatatattatctgcgaacgaccaaatatttagcaacatggatgcatttcggctacattagttttcatgtatttgctgctgattctttactaaccattccaaaaccgtgatagctgacaataaatttctgttgttaaatatgtagcatgcacctatttgagcccatcagacttagctagtagagtgcactgcgacacaaaccatgcatcactatgcaagttagctttaaaaggtggagcccaggagcaacagagtgcaactgcatacctgttcttaattatgtggaaggccctacacttgcaaagcaatcaatgaatctgaaatattttagttagtgttataaaactagtatgaaatcaccatcggaaaacaaacgcaagagaaataccataggatatccaaacatgatgatgacaccgaggcacaatatttgttaacgaggttcagccgaaacttgcatctctggggcactggttacaggcagtcctcccggaccagcatattacaatgtattagagtcacaatgactcgttgtcggacaccgccggctgtcgctccctctcgctatgctaagtcgccatatggttataacaagtccacccctatatttaagagatattctaagatggagtccgctctttctctagtcctactacctgttacaactctaggtgctaaattgtaaccgactttgtatacatattcgacacaaactctagcatagattcgtgagagggttgcacgacaacaggatgatataaattgcttgatgaattagtagatattcaaccaatgtatactgcaacacttgcctggcttctcggaatggaaggcatctgggatttgagatgcagtacacaactcttccatcaaccatcaacctgagcagcggcagcttgtacccatcactatgtaagaagagctaaccaaaaatatggtcttcctcttcgtccatcagatcaagagcttgaaacatgagtgagtccaccctctcgttatctctctataccaccagaagctgaggtgagaaagctgcagacggaaaactgcatgaagtgtggcacaaagtggataattagaccaaaatttacatgtaatggttgatggtctcagcttctttcgacgaactcttaggctatgcaaaaaatgactaacgatcgttagcaatattgagcagaccactagggccaatccatttcacgatctcctcaactgttattatgcacgcctggtagttttttttaaaataaaaatgaaccacacgtgatggtgcaatgtgtcatattgatatagcagaaaaaattataagactgtgacacatcgcccattgcgagagatggacaaaaatatggcattccacgacgctcgaaaccatccaatttgtttacgagggagagggcaagagagaaggatatatccacaccccgtgtgtagtcctgccagcgtggtttgtggtggatagaaaagcaccaccgcaggagttaacagactgctagagaagaggtttgtgggggaggaccttcaaacgacacctccaaccaggatgtgacgctgaaggcactgccgttgtctaaatagaagccaggacaaagttttctctacaacgatttctcggaagggaagaagacaccacgatgacgcctccaaggaggttgcagcgcctgaaagtgctgcccctgctggccctgaaacggactaggccttcgcccggagaaactcatgccctcccgtgcaacatccacatcgcccccaacagccaccactatccaagactagtttgacgtgtgttaccattgcaccagcaccacaccactaactggccaccatgctggaggttcctttctgaggaagggccggtgtccggcacgccatcactgtagcactgccattccccaccaccacctacaccggagcccggagccatcgccatagaggaaagttgccacaatcaacaccacacaagtgagcactacagccacaccctcccaacagcataggccactgtcgtcgtcccgtcagcaagagaggaaggttgtgggggtggggcgaggactgccaccttgccaccacacctggacggcactccagcggcccctcacccctcccccaccaccattgtgcatattcgtcgagctgatcgctgcggaacgccggatccaagctaccttgtatgaggagagtggccaccgtcgctgccacacacggaagtgttgcagccgctcctccaaacccacgatcattggagatgaccacgtcacgccatgccatcatcgctgctcctcgatgtttgttgtctgtagaagtcgttgccgagccgaaactggcacaggaaagtgctggatgcagtctcgaggtcactggattcagcagcccctgccgccacgtccacatcctccactctgctgctccatacatcgcaacctccaccttgcgctggccagcctctcctctacccagccacctttgcctatcttttctccgtatcgctgtatgccggtccagctaggggtggcctagatctgggtggcacttcttcccccttcctggtagccttatcgctcggtctagtatggcatcgttagggaaggaagaaccctccactgccaaccttgcagccccgtggcttgatgtcgggccattcgggcggcaacgaggtggaggagaggattgggggtagggtgcggcgcttgctgagcggagtatagcttggtggctgctatactggggtgagattaggtgttgtcaggattacaagtccgctaactacactaactaactaacttccagcccattaagcctgccttagcatgctttcttcactcttatagtgtgagagctgagaacccattgttaatgaatctgatgtacctactcctgctgaaccagctctgattatgactgggttgtgctttttcttaccgagagaaagtgctcttcaataagtagcaggcaaccatttggggccatcagtctgcagcaactccatagagcgcaggacattgcaaccagacacctaatacagcccaaaataatgtctcccctagtttacgttcacgatgacagcggttccactgaccacatctgatacaaccaaaaattatgtcactggcattcaaatctgcgctagtataaacacattcagttgctatatcatctatgtttggaaagttctacgagtctagttttcaacacaacaaatggtatatcatttgtactcccgagtaaggagttatcatttgtatttccaccaactacaatacggtgttaaaaccgtttagtcactcttaatgaataagtatagtagtatatatatctatatcttcgaataaccaagtatttagcaacatggatatacatttctgctacattttttttcatgtatctgttgctgattttacttatcatcaaaaatccttgatagctgacaagacattctgttgttaatttcagtgtcattatcgttaaagtaatactacgagtcgaaatattaagtgtccagcaggagaggaggtaccaaaatcatgtacgcccattggaacccatccgacggctgacgaacgtcggtaccgcgaggtaccgtaatgccgatgggcggtacctcccctccatccgtgttgtgctgattaagtggaagggcaaatctggaatttcgcatcgtacatccgtttctgaagctcgctccttcagatccatctacgccagtcctacaccgcggtggcgtcgcggcccttcctccacctccactctccccctgcgtccccactccccaagtccccaggccagatccggccgccatcgactttggggcagcgtatctggacaaggacggcgacgggaatatctcctcgagctcgtgggcaggcaaacaacgaccacaacgaagatgcggcgccaaggcggcgagctcagccggcgtatgcggcggacccctgggtgacagtgacctcggggtggtgggctgatgtgggggatgcggcaacctctcagatggcggcggtggcggcgatcgggcagaacctcttgaccaccctcccctggtccccccactactagaatagtgaatgtcaacgaccaaaaattaacgatggctgcataatcttggtcgttgatactgctttgggtcgatttctggtatccgacgacgctagttttttgtggtcgctagtgcgtagtgggctgaggtcgttgttgttatttactcaggttggatgggcaattgcaaatggtcgttattactcagcgacctgtgtcctcagctctccggccattgccgccgccgccgccctcggcttcagccactgccgccgccgctgccctcggcttcggccaccgccttcgattcgctccacagctgcaagcctgcagctgctgcccgtgctccctataactttgctctttgctgctctttgccacacaaaggaggtagcggcacagcgggaggaagaatccccatcattggcataggaaaagtctatcagatcccctccaatccgctgctcccttccaattcctaaatcccctcttttccctaaacatatttcgccccaaatcaatatgaatcaacagtttttgattccaaatccgagatcccctctgctacccccacatatttcgccccaaatcagtataaatcatgaggttgagagatgagaggagtgttgattcaccgccatgtctcgcagccgcagtttatcaccggaggtgacaactaggggctgcatcgaatggcctacatggtctcctcagggctcccaaatgtcaatcctccccaccactgaacatcttgatgccaagctcctccatgagtacatctttccacctgatctgcccagccactctgttatttgttccagttcacttgggactcatcaatcgacgaaaatagtcacaacaggtattctccaatctcctaatgtaaacatttgcatatgatttgtgaaacatattgaattatgtgctaggttaaatgttaaatcttgccaggttaaagtgttggttgtattgtcctcttcgaaactaataaaagctgcaaagtttgcttggtggatactgattatttctatgctgccctcaacctgaaatgtttgatatggtcctgacaatttatttttgtggtagctatggcactttcattagcattaggctgtgtttagttggatccaaagtttggattttggttgaaattggagatgatgtgactgaaaagttgtgtgtgtatgacatgttgatgtgatggaaaaggactgaagtttggatccaaattttggatctaaacacagccttagtaatagaggaatgtaggcaatttgtttgtttgtaggcaagaacagcaagtgttctagctttattcatagaatgaattcataattatattttataaacagaaacattaggtgtgacttctgtgcaattaacaattatagttacatgtgcattagttcttcctaatttgacatatattcttctcctagactgtttttcatgatggtactactagtttgttgattttagttgtaatttgaaataattatagtatcagcagtgctttacttaaatggtgtacatctcttgttttcacctctgctataatgctagcaatacaagttatttctatttacttaaaattgagttctgcatccagctaactctatacatacttcaattgaagggtctaaagaccatagcttctccttggattcagttgggtccaaagaccatagctactcctttgtttcagttgttgaggacactatgggtgatgctgtcgaggacaagatgtaccaagttgtaaaggaagatgaaccaaaggaattacttaaagactccaaggttaattttatggcaaacgttgttgaagacaccatgaaagagaaagagattaatgaagatgaccatatgggttggtactccttagcttcagttgttgaggacaccatggatcagcaagtgggagcagacatcatggaccagcaggttgtagaagactccttggtaacagacaccatggaagagagtgatgaagatgaatacttgaaggcagaatatgaaaagggtgcattaatcttcgctagagatgaggcaaatgccttggaaagaaaagaagctgaagctcgttatgaaaaatcacttcaagagattagagatgaatttttgaaaatttatgtccctttgtattttactctaagaaaaaagtaaatttagttagatagataatatataaattcgatcagcatccagttcatggccagttatttgttagcaaagaataactcatgcatctgtaactctgctatcactttagtatcttcaatgaagactatatattgtcttattgtggggtctgacttgattgatctatgttcactgtgtgcattcttgtttcagtttatagtatcattctctgcagcagtaagatagtactttgctggacaatatacagtctgaaagtttcacttcaactggaactttaagttatgctagacaccacagggactgggactctgccaatgatttgtttgttctatcccttttaaactttgtatccattgtacagtgcaatatgatttgttcaacaaagttgtaaagtattcaactacaggtctagatgaagggtgctcgatttgttcaaggaagttgtacatgatttaagtgcagccggtacactgctatgtgtatttcaagggtatgctaatgctgtaagcctgtaaatctgtaagcataacatcgaaatatttttgtacatgagctatgctttacagctcagaaaatgcatcttaccttttttttctgctctaaacatgatgtgttcgattttctggtcgtccttttatttcagttagtatatgtataaagtagcaatacaataaaataaacatcaaactagcttttcccagttggatattgtgttgtaccttaagttagaaaggtgctggtgctgggttcgagtcccctgaacaaaagtttttctaatgattttactttcttttccatacgtttttctttaaaaaaaatacatctactatatgttccaaaatcatgctatgtgaacaagatattttttattaattacaatgttaacaccaaatttagtatagtttatggatttgtcgctatcctacgtatctttgttcttgggttaagaggtttagacaaccaatccaacacagtcgtctagttataaaagtgtactctttcgtataaggtcataaccgatccaacaccatcgggtgtatattcggcatagttcatcaaggcattaggcattagaggatcgaccgttcaaactagttattatagtagaagaaaacaaccattatatttctttcaaaaaagacaataaaatatatgccgtgaaatatattgtactaaaatagtgtatattgtaaatgaattttaaggtaaaaaagaacagagaaaatgtattgtccgattatgacaaaaatgagtatagttacaaagtttactccttcgtacaaggtcataaccgatccaacgccatcgggtatatcggcatagttcaagaagccattaggtgttagaggattgactgttccaacaagattattacaatagaagaagacaaccattatatatagtgcataaaactttgaataaacacaataaaatatattgtactaaaataatatatattgtaaatgaattttgagttaaaaagaacagagaaaatgtgttgtgagattatgaaaaaaatgagtctaaaaaaattattagtacagtttcacatcagggacattaaagaaaataagttgttgctttttaaaaaaatttcagatgcatggaaaaaattatggcgggtgattacataccttttttattttttttggcgctcaaaggaggagttttaggcatatgtccatgtacatatctcctcctccattcataatagacccaatatcttctcccctctcacatcccctccctcaccagattgagagaaccacggatggagcgctaatcattggtgccgatcggctgatcctctacttctccagcgcggcaccgtgccgcgcagcctcatcgcgctactgatccggtggttcccgtccgagtgcttcttcaatcaaaccctagaaagttctactacaggtcactacttctccctttgcattgaaatcatgtcgtttctgatctggtgcctgtcctctatccttaatcaatccatgatgtttggattctatccttaatcaatctgttgcatgtccgcatttgttagacatttctgaattgttgttttttgaatcaaacatattttatagcgctgggctgtcacttttttttgtgtatgaattatttcatctatagtcaactaaaaacagaatgcagtgcaattaatcatattgccaaataataatttatatgatatctatctagtcttgacattttacctaacagtgtattgtaactcttctttgacattaattatatatacagggttatataaaacttaatatcaactagcaattagaggggatggctccaagcaaggcatggatgggccttgtggatgattggctaaatcacgagtacttagagggtgtagagaagttcatagattatgcattcagtaaattagatggtgtccaggttatacgttgcccatgcatcaagtgctgcaatacatattctttgcctcgtcacatagtgtcttctcacctgaaagcgtatgaaatactgaggagctacacattttggtatcatcatggtgaagtcttagcagaacaagagaatgacatagaagttgatgagtatgattcacaggaatttaatggggaaggatataatggaatgcaagacctgatggaagatttatttcctcagtgcaacacccctggtggagacgaagcgacacatgaatctactgatcagggacctgaagaggagccaaacactgatgcggccaagttctatgctttgcttgacaaatacaaccaaccactgtatgaagggtccagaacctctaaattatctgccttagttaatttgcttcatgttaagaatttggggaaatggagtaataagtccttcaccgcattgttggaattgctgcgcaaggactttctacctcatgactctacactgccaaattcttattatgaagcaaaaaaaactattcgtgaactaggactaagttacataaaaattgatgcttgcaagaatgattgcatgctgtactggaaagaagatatagatgctgaatcctgcaaggtatgtggatcatctaggtggaaagaagaaaaacacacaggggaaattaagcactcttcagctgggaagaagattccacataaaactatgcggtactttcctacaaaacctagattgcagaggttatttatgtgtaggaaaacggccgcatatgctaagtggcacaaagagtgtagggttgatgatggagttatgcgacatcctgctgattcaaaagcatggaaggagtttgataaaatccattcatcatttgcatctgaacctcggaatgtgaggctttgtcttgctagcgatgggtttcagccgtttgctaacatgtgaacctcctattccatctggcctgtattccttgttcctcttaatttgcctccttggatgtgcgtgaagcaacaaaatgtaatgttgtcaatgctactaccaggacctgatggtcctggggatgcaatcgatgtttatctgcaaccattgatagaggaactgatagaactttgggaagatggagttgacacaatgattcatcaaccaagacaaatttcaagctacatgcagctcttctttggacagtgcatgacttccctgcttatggaaatatatcaggccatagcacaaagggaaagttggcatgtccagtttgtcataaagaaacaaattcaatgtggcttaagaaaggtcggaagttttgctacatgggtcatcggcgctttcttcgcaaaagtcacagatggagaaatgacagaacttcttttgatggtacaaaagagagccgaggaccatcaaaggagttatccggagatgatgtgctcaagcaagtgcaggatttacagggaattatattgtcaaaggatatgagtaagaagacaaaagtatcacgcagtgataggggagataactggaagaaaaggagcattttttttgagttaccatattttaaaactctattgctacgtcataatcttgatgtgatgcatataggaaaaaatatatgtgatagcattattggaacactaatgaatgtcaaagggaagaccaaggacaatattaatacccgtagtgacttaaaactcatgaacctgaggccagacttgcatccagtagatgatggaggaaaggtggttttgccacctgcgccttacacgttatttccagaccaaaaaaaagcactgcttagtttttttaaagaattgaaagttcttgatggattttcttcaaatataagtcgttgcgttaatatgaaagagcggaaaatgtcaggattgaa

SEQ ID NO: 40126 - DNA, 1567 bp, Oryza sativa
tttgatcgctatcagataacaattgttaattattttaacactagtgtagccttgtaggttgttgtgatgatttctggaaggtaggaagaaatagagtgtctgcactgcagaacaacaactcgaagttcattagtcctggactgcttcagcaacaagttgcaagatggacagcaccttcaacagctgatgatttatttgggtcaccagagaacatggtgtcagctacagctattgtgcaagaaggaaagagcaagcctgtctatgtaaggcagagcaatctaaagtaccagaaacacactgctatgccacaacctggtaattatccttcatgaatgtatattcaaaattaaataatatttaccaagtaacaatagaattaatatgcttcttttctgataatattgaacaaatagctagctagtatgcttattaaaactaatttcttgttttcttagagaggaggatgattcagacgaagagtcaatagacacatggcttcggagatccaggaatataacaattccaaaagttagaatattcccctctcaatatctactctacttatgccatatatatttttatatcaacagcattaacatgtattgtagacatgggcgatgcaaatgatgataccaccgaagaggatggcgtacataatagtaatcaagctgctaaaagaagacttcgtccgcaaactaattcacatgctccaagtgatggtacgacaagaatttattttattttctacataaagtacttagtataatttgtttttcaattgttttaggttctcaatcagttaagcgcagtagctgtggcaaaaacaaatgtgaggactgcatcatctcaaggagtaaactagtaacaaaatgaaatattgttaagttacttattttgtcctcgtatcaatttgttgtgtcatgtagatattagtaatagcaataatggatcccatgctttggatgatgcacataacagtatccttgctgcaaagagaagacgttctactcaacctaatttgcaagatacagaacaagatatattaaaacattcaatacaagtttttccattcaataaataaatttactataatagttgttttcttgacatatctgttagatactgagcaagatgtaattgaacgagtccaggtgcagagtttgaatggtaccttacaaaatggtatgcacgataattcaactatcatttgtttaattcatatctagagttcatatttttatgtttatctaatttgctaggtactaaaatggttcagcacaagggccgtggcaagaacaaatgtaaggaagttgccaaactcaaggagaaccaaaaaattaaagttgagttttacaacaattgtgctctttcgaatagtttttcacgtcatctgggtagaattgttcgtgatcggaacattactccgatcaaagtgaagaaatggtcagacattagtaacacagagcaggaacacatatttgcctcgattacggtacgcatctgtcttcctatgaaatgttctctcttgttttcaataaaactatgcttgcactgaatcatttgtttt

SEQ ID NO: 40127 - DNA, 20243 bp, Oryza sativa
tccttacctctccataaataaagatactgaaactaaggttacaagttggaataggattggaatctgaattgtttataagttctttgttttttcaacattttgaagaggtatagataattgtgttaatatagagctatatacccctagggaggtatatatataccttctcactaggactatgggctatatattcctttctacacattccaataactataaaagtctcaccattgccaatcataaacttatcttctaattggtttaaccaatttaatctgtttataaacctccccaaggaaggaataaaatctcacttcagtagtatgtaaaaactccaactacataattgatgaccagattatagtatatgtaataactagatgatgccacgtgtgttgcggcggactattcgttcgtgtaatgcagctataaaatttcaatgtatagacatgagaaatattataaacctataaagcacgttacatatgaaaatcgaatacttcttgtagtggtttttttatagcatactacactaagtggtgaatgaatattgggataccttataatcaatgaaaaatgttaattgtcaacatttaatgtctattggatggttgtcatgaagcatggaaattatctaatggctgttgttttgtgggtgatgtggctcaaagaatgtttagtttttggtgccaactatataggatatatagtttaccaattctgctcctaacagaaaatatcaatgcaacacacaaatattgcgccatcacaagagtaggtagtaaataactgggctggcatcaagcaattgaaaactctactttaatatatcaattcagaagatatttgaaacccttctccagcatctgatgtgcttgttggagtccctgcaccacatgcacgtttatcacagtactatggtatcagtagaacggataccatcatctcaatcgggcggtaacccccatctcaatcgagcatggcgttcgtcacagcttagaagtcactgatgtgaaaagttatctcaatcgggcaaacggccgtcacagatgaacctatctcaatcgggccataattaaagctcgtcaccgatagttttaacccagacgatcagtcaaactatagcccgtcacggatgacctatctcaatcgggccaaaaactatagcccgtcacaaatgacccttatctgtgacaggcattaactatagcccgtcacagatgagtcatctcaatcgggcctaagttaatgcccgtcacagatgagtcatcacaatcgggcctaaattaatgcctgtcacagatgagtataatcccaaaaaaataaattttatttttaggcatgccatctagcctctctgagatcggcttccagaagagtagttataacttgttggtatgagtattctattaatcctattaagccctaggccaggatgtcacaccccaacatccttcattcttatacattcattcacatacacaaccatcaaaaatcctaaacaacaaaattgtataactcaccgagatctacaactattgtatcggtcctttgtacaaataagttcatttgaacaattcaaatttttaattttcaaaatttgacaacttcgaacaaaagttagggttaataaatgatttcaaatggaaaagtcaccaaaaccaaagttgtagagctcatcgaggtgcaaattttttattttggtcatttctccatccaactctacttaaacaatttaaaatttgaaattcaaagtttgagaaattcaaacagaattttttgttagtgaacgacttcaactgaaaatgtcatcaacaacaaagttgtataactcatcaagatctataacttttattttagtcatttttctatataacattttttgaaccgtttgaatttgaatttaaaaatatgacaacttcaaacaacattttcaaatactaaatgatttcaactgaaaaagttatcaacaacaaagttgaataactcatcaagatctaaaacttttattttggtcattttttcatctgataaagtaatagtaacattgttcagaaaattgacatatctctgatctggctttataaactataacacatatatgtaaaatttgtgaacaatgttactaacattttatcagatgaagaaacgaccaaaataaaagttttagatcttgatgagttatttaactttgttgttgataactttttcagttgaaatcatttaatgtttgaaaatattgtttgaagttgtcatattttaaaattcaaattcaaactgttcaaaaattgttatatagaaaaatgaccaaaataaaagttatagatcttgatgagttatacaactttattgttgatgacttttccatttgatatcatttactacgcgtaaaattattttgactcataaattgaattattatactatagttcaacttataaatataaacatttcatatgaaaaatggaaaaatactcatcggtgacgggctttagttaatgcctgatagagattaagtcatgtcaactagggattagtatatagcccatcactgatgagtcttgtgtgatgggcctcaagttggtgcacgtcacggataatggtcatctgtgacgggccccaacttaaggcccgtttgagatatggaatattatctcaatcgggcctaaagttggggcccgtcacggatgatggtcatctgtgacgggccccaactttagccccgtttgagatatagaatgttatctctatcgggcctaaactacggcccgtcactgataggtgtcatccgtgacgggcttaagttttatgcccttctaatatgtctgtgcgaccatatctcaatcgggcactttttcggcccgattgagatgacttccttgtgacggcccgctatttccaggcatgttagaggccatcacagatagaaggatctgtactagtgtatttctcattacaaatatataccacataccatttttatgtttacacgctaagtaaaattatagtcagtggtacttaaatttcaaaagttctagactggatacatgttatttgaaaggatagtatttgataagaggtaatatatatgcagtgctaggggcataccgagtttcagctgaacgttatatatgtgtgcacaactaagcctgccaatgggttggcatccaccccgaatccaacccaacccaaagtgactatagcaaaattgtcactctaatccagaccaagaattccttgagctaaccccacccaacccaacccacaaagttgctcagtccaaattcaacacaatccatgggtggaatccattttccaacccatacccaatccacggcaggaagcagagcagagcagagcagccggcgaacactaacactgcatacagctactagcatacttacaaataacataagcaagatgcaaaaataatcaatcaacgctactagcatacttagaacttttgatgctttaagtagtgccatccaacaagttttggcaactaaatattacaattatcactagagattctactagagcaacaggctcaagagaaaatctccaacaaaaaaagctatcaagcattacaagcctcagaaccatgtataactgaacatcaacaatttcttcatgtctcaatctttagattaccttctaagataaccaaaaccaaaaacccttccaattctcagccacacattcttgcagatgacagtaacctgaaagaagtagatgtcatcaaaaatttatatccaggaataactagaaaattgtgacttcgttgcttaagaaagcaaatatacaaaattacaataacaatttaaataatgtgacctttgcagtgttatcaaaacaatgtgccaaattgattcaattggtaaataatgaatagtaacattttatatacaaacagaataggcaacaaagtggtaaactcaattttggaaaaatgcaggttcaagagaagtattccattccaaatttccaatacgccaaaggaaaagttgaatttaaagttgcatatatgtatatggaaagtcacctttccatcttcttcacttcaccacctgaataaatcaggacaaatttccacctgtaaatgatatatgatcactacttcatgattgaaatacacagaacatttatggaggaatcatttatcactattataccttcagcacctggaatattgatcaaaggatcgttggctttaattaaccaatctttcgcacaaatgagagcatcaagcatttcaggtgttaacgaacttcgtgtgtcaccaagtatcctgcccctacaactgaatgctgattcggaagatacagtgctgaggggtattgctaggaaatctttggccatagctgacaataccgggaatttttgagcttgtctcttccaccagtccaaaacatcgaaactctcactatcctcctcaacatcttcttctaaatatatggcaaattctgatttcatttgccatgcagtcctccttcgagacttgtataaagcaaactcttcctcgagttttcttttcccaagaacaggtgatccaacactgttgctgccttcatgagaatgtgaaagcatgtgttcatcatttcttcttataaacccttcatatttttcataataatccttcaaccaatcttcagcagaacccactttttcgacaatctctgtcacactgttagatgttttctcataaaagaaattcaaataatctccttttcttcttggatctaacattgtggcaatgacaagtgcagagttaaacccactgtcccaatatttgacaaactttgagagcatagctgcagccaatacctttaaaatatcactagtctaccaatcagggtcattcaatgcatgacgaatttgtagcaccaagggcaagaacctatgtgctgttggtttcctatctgctgacaccgataatgtggcttcttcaaaagctttaagaaaagcacaaattgattcaactttctgtcattctagttcagtaggtgcaacttcaccatgttgatttgcatagctatccaggatagatctgtacattaatccttctacaatcattttataggtggaattccatctagtcggtgtatcaaaagaaaaactcaacttcgaaggaagatttttcgagtttgccatagaattgaaatcttgcattcttgatactgaagaatctaaatgcttcaacaactcacgtagcttgtgtattgtaggtttaattatcttcataccatcctgaaccaaaatatttaggatatgggcacaacatctaacatgcaaatgctgactctcaaacatcaatgcattcttgtgattctttatcaactcttgacatgcagaattgttattactggcattatctaaagatatagtaaacagtttgcttctaatgccccaatatgtcaagcaactcattatagcttcttcaatggcgaatcccatgtggggatacttcaattccttaaagcttataattttcttcttaatgttaaactctctatcaatatagtgtgctgtgacaaccatgtagcctatattttgaattgaagtccacatatcggatgttagacatatgtgcaaatcaagattatgtaattcagcatgcaagtcttccctcattcgctcatacaagttaaaggcatcatcacgaagtgtttgacgccccacaactttgaaagttggctgcatggactccacccactccaaaaaataaggatcctcaattttcttgaatggcacctctgcatgaatgaagaatctgaccattagctcccggcttctcttgggaacaaacacgaaatcttccccagtctgtttcttaattgttgcaaggaagttgattctagcatcaccatcaataactggacatgattcggctatgtgattaataaggtgacttgttcctgactttttggtggctgtcaatcttaagctacaatatttgcattgagtcttggggacaccatctatcattacaacctcttgctgaaagtgttcccatactttagctctcttaagtgttcttgaagattgattattatttggactattagtacctgaactctctaacatttgtatgaacgtatttattattgagtttgttcaattgtctacatagaggaagaaatctaaaatcaagatagttgaaagaacatggtctataattatttttttcacacattgtacacgtgctacaatctaaaaattacacactaaaattcgattgaccatagaattaatttgcatctcaaaatcatatcatgactcaatctgtaatgatatgttaaataatttgcattgggagatgaagggaacctgcattcactatacctccttatcttcttcttgaaatcttagaactcctgcacataaacccatcgaagattgtaatcttgagcaagttaactcctcagtaaaaccaacaaaaaaaacaaaatcttatagaaactatcacaccaatcacactgttcacatacgtcatggtacatgggcttctcagggagattggcgacgcggccggaccgccggaggaggacatcctcgccagcgcccggcggcgcacgcaccttcctcttcttctgcttcacctgcacccgcaaccaccaagatcaggaagagacccaaaaaaaaaacacaaacaaaacaaccaggatatatcaaagaccgagaaaaaccagggaaaaagaaaagcaatggtggtgggggagggaatctgaccggtgacggcttggcggcggattcgcggacggtggcggagaggtggaggaggcgaagcaaggggagggagcggcggcggcggaaggagtggagccgtggacgactgatgacgctaggtttggagagtactggactgtctagtgcatccaaagaaatccatggactgaatccaatttggatccaaaaatcagaaaccaaaaaccaatccaatccaaaccgtttccacctccaccctaaccagtccagcccattaaactcctcaatccatttccatccatccaaactacacccaaagctgaaaccaatccattgggcccatttcaatccagcccattggcaggcttatgcacaaccataaacaattaaaaattaaatggagagcaaaccaaagtagaacaaatgcttcgtgctttcaatgaaccagtgaggaagatatgtgaaggtgtgcattttttcctcgggttagtgattggacggtgaacaatctacaagagagagactacaatcgcatcgttatcaaccagagcccgactccttgggatagatggcagagcacatatacagtttgacctacaacccgagatgataacacaatagaattcgcttgacttccttagactgatggtaatagctcataggaatggaaggcatccgggatgatagtcacgcagcgcctactgcttgttctataacttgttgtatggatggcagctgttccagagcattatgggtggaacactgcatagacaaatattagaagggtgttgatgtagttagatccattgtggtctacaattggcccgagcagtgtagcgatagtaatttttccactatcgtggagcatgagaaggctactgaaccagtacaggtccaggagcattttgactacacctcaaaaactggctgttggaaagtttgatccagggccatactgttggtgtcccatcctactagttggaacagagtcggcccaatgcccaaccatgccactcatcatcatcaccttctaactaggtccttactccttagggtagccaagaggcagagatgtcattgatgtcactaagatttctttacaccattggaacaggaaaaacgaccttgacctggccattggaacaagctattgaaatacgagtgtactatttttcaagtttcgtgtaacagaggacaatcgttaaaaaaaatatctaagttaaaatgttgaaaggactgtctcagaaataatgtatcacttccatgattattctcagacctagccatcccatctcacgacaacaaaaacgatattcctggccggagccctcgtttgattgcaggacggaccataactgattgcgtcttcaaaaatcgacctctattttcacatatggctccttaacaagcacgcaaaaatcaattttcacaggcgggcctcttaaaaaggcacatatgtgaaactatattttagcatgcgggcctcttaagcaacccacctgcaagtctaatactattcctctttccctctcaccttattaaaaatttgttaacttatctctttgtcgcatctctctcccttatctttttcttactacctctcctctcatcctcactttgactgcgggggccatggtggctgtgtgatagcgggtggcgacgacgatgacgatggcgacgcgctcggggagcagcggcaacgagcgggagctgcgggctagggagaggccggtcccggccgtgagctgcgtggcggcaagggtcgggagaagcggcggcggccagccacgggggcagcggtcttcggagctgctaggagcaacgacgggctcgcgtggaaggcggcgagggggaacggcagccagcccccgccaggatccggcagcagcaaccatacccaccccggccggtccggcgttggtggctgggcaggctcggcggcaagttggcacggaggccggtgggtggtcttccttttttgtgatttctagtttttccggatttttagttttgcgtgtggaccacataagcaccacacaagcgaaaatccgattttcgcgtgcaggtgcgccgcccacatataaaaatagcgattttcgcagatcatttagtgtgtgagggctatcctaccacacgagaaaacctcttttgggccatctgcaaaattcacttttgtagtagtgtctctccgcttggaataaccccgtttcacctaacattactgatctaattagtccctccgtttcagaatataataagttttggcattcaaaatttcttagcccaatgttacaacctaatacaacttttatcaccaacctaccgattctactcgtcatcattgttttcagcaaaaaaaaaaaaaagtactaggtcccacctccaacctgggggcccaccccaggaacgcacgttcccatccacccacggtaaagagccctccatcggcatccaccacgaagttgtcgtctccactttgatggcagcaaacaaactaccagtactgagttagtacaggaataatcataaaggtagtatggtctttttctactttccttaatactctcgttcatatggtccttgaacttagtacaggaacttagtacattctggtacagagaaagtactctcgttcatatggtccttgaaagtccagtattctctctggtttcatatttctaggcgttttggataaatgtatcgtcaaacttttataacttttactgtcaatacctttaaaaatatttactttaaagatactaaaaccacgtgaatagatttgtcttacaaagtagtacaataaaagtaaaaaatgtatttatttattatatatattataattgaaattaatagttggagacatatttttgagatcatatctttgtaaaaaatgttaataattatggaaccggagtgagtagatcttttgtataccatttattgccgacttaatttgacactagcatgcagcactcttctcccagactaacgggaataagaagggcacatatatagcacatgttttgttctcaagaaggagaacaaaccttgtacaaaatagcaaattaaatgaggcaagctgaacaagtcagttatacatgacatatatatatatatattgcaggttttattattgtaccctgtaacgtttatgggaaacaggaggaatcaagagtttgagctgttcattgtacatatatactgtttagttcgtcacctccagttttgcctacaatttgaccatttgagtattactcagaaagatagagccgacacccggcattgtaaaggatttagagactcactatggtgctctctaataggagtataaaacaatctgaaccattgatctcatttgatcgatgggtttgtatctatttataccaccaccttagttagtgatagtagaaacatgaagggtcattattgtcaaaataaaagcgttgaggggtataatcgtcatttagcaatttactagactttttttctttttttttgacatttcgatgaaatacgatctatactagcgcaatagatgatcatagatggatttagctaggaaaaacataaatgacaaaataactccaaatcatcatagttgtaaattactaatttgcctctaataatgctggtaatataataccagtagagagcaccgaagcatccctcaaggatttaggggtaggggtggggttgggggatcaggctcctctaccttcaaagacatgtgcctttgtcactaatatgtgggtccaataaaccatgggcccacctgccagtgacaaagacatggtgtgcctttaaaggtagaggatcttaattcagggtggggagcccggagtatcaatgcctaagtttacaaatgttggtctactggtctataaatacgaggcaacacaaatacagcagagcacgcagcaagacagcacgagccactgcacaatttagctttagaaagtgaaagctacaagcaagtataagcaaggccactgcaatgtgagatggttgcacaatgacacgagggaaattgcttcagcctcagtatatatgcaatattatccaatatatatgcagactagcacttgcctagcttctcggaatggaaggcattaggaacaggagatgcagcatgcgtgtctttacgctgtggatatcaaacataggcagctcagcacggtggcacacaagtgtgtcatggtactgctgaccatggagcacaaaaccgagaacttcgaacatggtaatcagtcgaccatcaagacatctgtgtactgattcatgctaatgacaatattgccggatgatatgctcctgtttgctgttcctgaccatgacgtccagacgtgagaaaacagttgcatgtaaggattgatataatcatcttatttccatcatctccagtaccatgcaacaactcagttgttgtaaattattcaagtagtaatacacactactacaatagacatttttccgtgcggtcagaaacaggttttcgcgtgcagttagccctaccgcaagcgccgaagggtctacaacaatcgccatgcatgcgggtgcgccacccgcacgtgaaaaatatgggtgcttatgttacccgcacgtaaacataaaaaatcaaaaaaaaaataaattcgaacgaatccaaaaccctaaccctaaccctagaagttgctgccaccgtcgtcgcccgcctcctctgccaaaccggccataaccgccaccggatccgagcaggggacagccaccgccgctgctacatccgggcagggggcagccgcctccgccggatatgggtggggggcggtcgctgtccccctcgtcgccttccacacgcggccgactccgcgcgcacgccagccgcctccgtccgccaagacgcccgctgccgctcccgaccgctttcctcgaaccctacgcagccgctcccgagcccgttgctcgccgccccggccgccgctgcttctcccgatcccgccggcgccattaccgcgcagccgttgccgtcgccgttgcactaccgtgaggataagagagcggataagtgagaatgagaggaggagaggataagcggtcagttatggtttactgtaacctaacgagggtctcgtacatgtgctatctgtgtaacagcccaatatgcagaagtcgagagtgttagtatcctctccataacagaatataagaagttttgaggttggacacgattattaacaaattgagtagagaattaaatgtagggaggttgtaattggttgataggtgaaggtaggtggggaaattgcatggtgcagagttaaaattagttgagaaaagaatgttggtggagaagttggtatattctgaggtaaattctgagtattagaagttgttatgttttgaaatggaggacttgtaaataacaaaccaggctgttcctaaacacctaaaccgttgcatagagtgataaacaacacttttaatacatcagttattgaagtttttgaaacccatctcctgcatccacttgcatgttaaaactcttgatagctgatacactactaaaaaatcgattttcgcagtcgaaaccccctccaaactctagacaggcataattacatccgcatgaaaaagtatttggatggggttcggttaaggtcacctgtgtggagattatggataccccatacctacacggcatgtatagtccgactgggtatggggtgccatgtatagatagaatatctttaagaggactcggattaaaatctaaacttgtatgtcaaggaaatatccgagatcctagtcggttacgattgtattttatctgtaactacatattccgttagggatatggactatattttgtaatacgaaccccttcccatatataaggaggcgtctgggtgcctctaggagcacgactttctcccagatcatatgatcaataatacactcggcagatcaatccccggacaggagtagggtattacttcttaattaagaaggcctgaacctgtataaaattccttgtctctaaactcatccacttttcctgcttgatagccaccccttttaatattgccgaaatcttgtttcaacagttggcgcgccaggtaggggtagcgtcaagttcttcgccgactagtgcgatgggtttcgtttccggcatcgatgacttcgtcttccctcccgggcaggtgtttcgtttcggcagcctcgacttcatcatcaatgacttcggcaagatttctctcctcgactcggattcgaaccagtcaggaagagagcagatctccgctctgttcggtatcctgaactcggccgaggtctaccccaagatcatctctgccgagttggcttcaaaccactcggatgagatccaatctacttcaacacgacccaaacaagacgatggggcctatccgccaatcctgatgaaactccccgatgatttggctgctgtcttcaccacaaggccgtcttctccccgtaggcctaggccagatccggcttcagccccggtccggcctagctctacggaagtcggcgtcatactccagacactcgtcacggtttcgacggaacaactggacggctacctcagctcccccggggtcgactcgcggccaacagagatcgtggagtacgatgacttcggctaccgctacgactaccgcaacctcgacgacttcgacgaaggctttgaagacaactacacgcctctctacttcggcatcttcagggctgacaatgagacagaagaacagcgcaaagcctgagaagcagaagagctacgcatacaacaagaagccgaacgatgccgactggaagaggagcgccaagtacaagagcgagaacggatgcagcatgagcaacaggaacgcgaacgggccgcaaaggaggctgaggaccggcgacaacaggccttggacgccgggcgacgagcacgagagttcatcgggcagcaagacgtcgacggaactgcggtttttcgcacccctcaacagaacgcggttgcagcgatcaccctcctcgacaccctcctcaaggaagacacactcaatcaagttaatcacgttgtcaacatcttgaaccagaccaagaccatgatcgccgcctcggtcccggttaactctgcaagcgtccgcatgccgactggcagccgagttccccatcttcgatctcaagactatcaccaaccgagcctcagcgtcgccggcgcgggatcctgtcgcaggaacaggggtcacgacgagcgatctgtgcattcgcctcccgaacgacacagggagcaccgagttgaacggccatgctccccacctcgtaggcgccccgtcgatctttgtgatacaatcaaccagcgtcgcgcggcacgaggctacgctccccaccattcaccagattgccacgaagacgacgtggatgaagtcgcttcctttacaagcgacctgcgtcgagtggattggccagctggcttcaagccgactggaatcgagaagtatgacgacaccactaacccggagtcttagctcaccgtctacggtctcgcaattcacacagcaggaggagatagcaaagccatggcaaactatttgcctgtggccctagcggattctacccggtcctggcttcatgggttaccccgcggcacaatcggatcatgggcgaaacttcgcgaccacttcatcgccaacttccagggtacctttgaacgccctggtacatattttgatctctacaacgtcattcagaagtctggagaatcccttcgagattacatctgaccattttccgagcaacgcaacaagatctccgacattaccgacgatgtcctcatcgtcgccttcactaagggaattcgtcacgaagacctagtcggcaagttcgggcggaagcctcccaagacggtcaagcagatgtttgaaaaagccaatgagtatgccaaagctgaagatgccattatcgcgtccaagcagtcgggcaccacttggaagccaaagaaagatacgccgactacaggaggaagtggaagtaccaatcacaaggatcgcaagtgtaagcccaaggaacttgtggcaactacaacaccatcctcccgacaacgttcgcgcgtcaacacttttgacaagatcatgaattcccaatgtccgcatcatcccaattctaatcacgcggcgaaagattgcttcgtctacaaacagtttgcagaacaatacgccaagaacgcacgtaaggcctctgatggagatcaaagcacgtaaaagaagaaggatgatgacgatcatgccccgactggttttcaagaccatcgcaaggaactcagccacatctttggtggacccctggcttatgaatctaagaaagcaaaagctgagcgaacgagagctcaacgctgttcagcccgatacgccccaatttcttcggtggtcggagacgacaattaagtttgaccgctcggatcatcctgaccgagtggtccacccggggcggtacccctaggtactagacccagtggttcgcaacgtcaagcttcgtagatccctcatcgatagtggcagtgcactcaacatccttttcgccaaaaccctagacgacatgcagatccctcgcgcggaattaaggccgagtaatgcgccctttcacggagtcatcccagggctatctgccacaccactcggccagatcactcttccgattacttttggtactcgggagaacttccgcatagaaaacgtttgcttcgaagttgctgatttcgagacagcgtatcatgccatactcggatgcccgacgttagccaagtttatggttgtcccacactatacctacatgatgatgaagatgtctggtcctcgaggagtcatatccctgcggagtgacatcaagcaagccgtcacatacgacaaggaaagctgcgagatggcccagacccgcgagatcacgctcgcccaagaagaaatccgactagctgcgtccacagcaagcgaaggagaagtgcttgcaaccaagatgccaaagagcgaagaaagcgacgccaagaccaagaaaattcctctagatccttctgatcctactaagactgctgtaataggcgctgagttagattgtaaataggaaagcacgctcatcacctttcttcaaaataataaagatatctttgcgtggaaaccatctgatatgcctggtattcctagagaggtgattgaacactttttacatgttaaggaagacactaaaccaatcaagcaacgactccgccgtttcgcacaggataggaaggacgcgatcaaggaggaattgaccaagctgttagcagcaggcttcatcaaggaagtccttcatcccgattggctggctaacccagtcctggttcggaagaagacgggacaatggcgcatgtgtgttgattacaccgacctcaacaagtcttgccccaaagatccctttgggttgcctcgcattgaccaggtagttgactcaacggccagctacgaactactcagttttttggattgctacttagaatatcatctgatccgactaaaggaatccgactgcttaaagacttcattcatcacgcctttcggggcctactgctacatcaccatgccctttggattaaagaacgcaggagcaacttatcaacgcatgatccagagatgtttttcaacccagatcggccgcaacgttgaagcttacgtggatgacgtagtcgtcaagaccaagcagaaggatgatttgatcacgaatctagaagaaacctttgcgagcatctgcactttcaggatgaaactaaaccctgaaaagtgcatcttcggagtatcgtcagggaagctgcttggatttatggtgtcccatagaggcatacaagccaacctagagaaaatcaatgctatcctcaacatgaaactgccaagctcccagaaagatgttcaaaagctgactggttgcatggcggcgcccagccggtttgtttcacgactcggtgagcgggggatgccctttttcaagctgttgaagaaaacagacaatttccagtggggacccgaagcacaaaaggcctttgaagacttcaaaaaacttctcactactccacaagagcttcaccacatccgcaagagcctctgttgttatatgtgccggcgacttcccaggttgtaagcacagtcctagttgttgagcgtgaagaagaaggccatgttgaaaaagtccaacgaccaatctatttcgttagcgaggttttggctgattccaagacaagatatcctcaggttcaaaagctattatatggtgttttaattaccgtcaggaaactatctcactacttctaaggtcactcggtcacggtggtcacatagtttccactcggggacatacttcataatcgtgaagcaaatgggcagatcgcaaagtaggccttagaaaatatgtccttggatatatccttcaagctgcgaacttcgatcaagtcccaagctttagccgactttgtcgtcgagtggactgagtgccaagaagacatgcccgaggagaagatggagtattggaccatgcattttgatgggtcgaagaggctttcaggcaatggagccagggttgttttaatttctccgactggagaaagattgagctatgtattatggatacgtttttctgcgtcccataacgtggcggaatatgaggtgctgcttcatggattaaggatcgcgatctccttgggaattcggcgtctgatagttcgtggagattctcagttggttgttaatcaagtcatgaaagagtggtcctgcctcgatgataacatgaccgcctaccgacaggaggtacgcaagttggaagacagattcgatggacttgaactcacccatgttcttcggcacaataacgaggtagccgacagactggctaatttcggttcaaagcgagaagcagccccttctgacatattcgttgagcatctctatgagccaaccataccaaggaaagaaataattcaggctatgaacactcaagacgtaagcatgattgaagccgactggagagagcccctcataagatttttgaccaaacaagaacttcctcaagataaagatgaagccgagcggatctccaggcacagcaggctctatgtcatccatgagactgaactgtacaagaaaagtccatcgggaatcctgcaacgctgtgtgtctttagaggaggggaggcaattgctaaaggtctcaggggctactgtggagattatggatacattcaggcatctgtggtaatcacactgctgcacgaaccattattggcaaggcttatcggcagggttttttctggcctatagctgtgaccgacgccgacaaaattgtgcgaacatgtgaaggttgtcaatttttcgcccgacaaactcatctgccagctcaggagttgcaaaccatcctgttgtcttggccgttcgcggtttgggggctcgacatggtcggcccgtttaagaaggttgtcggtggttatactcatctctttgtagccgttgacaaattttccaagtggatcgaagccaaaccagtcattacaatcaaggcagacaaggctagagattttttcatcaacattgtgcaccggtttggggtacctaatcagatcatcaatgataacggaactcaattcaccggcggaatatttaaagacttttgtgaagacttcggcattaaaatttgttatgcctccgtagcgcaccccatgagcaatggacaagttgaacgtgccaatggtatggtactctaaggaataaaagcacgagttttcgaccggctgcatccctatgccggcaagtgggtagaatagctaccgtctgtactcttgtccctgcgcaccactcccagtcgggctacgggccagtcgccgtttttcctggtctatggagcggaagcaatgttgccaagtgaggtggaatttgaatctctacgatttcgtaacttcagcgaggagcgctacggagaagaccgagtagatgacctcaaccgactggaagatgcccgtgaagcagccttaattcagtcggctcggtatttgcaagggatgagccgttatcacaatcgcaatgttcgatcacgagcctttttagtcggcgacctggttctgagaagaattcagactacacgggatcgccacaagttatctcccttatgggaaggaccattcataatttctgaagtcactcggccaggttcttaccgactcaagcgtgaagacggtactcctatcgacaactcttggaatatcgaacatcttcgtcgattttatggttaggcattacttttatatttccctctttgactgccaacatcaagttattccttgagttaccaatcgggggctactataataataatggagtgtgatttttatcaattcaatttgcttacttgatttatcattgccttgcttgattttttggcttagtcaacgaggactgaaagttttttaataacttttgcaggttttaggctcaataaggtttgaaaaaagctattaagaaatcaggagctaagtttgaaatatcaggcacagcataaattcatcagtactgtacaaattgtgcctccatcatcatcatcatcatcatcataatcattgttatcaatcagtatcagttttttcatcatcggaattatcagatccagtcggccgaaggtcgttatcctggaatctctcaactgtatcaatggctatcttatcggcggctttctacgcatcgttgatgaggtcaagggcggcctcttcgctcgtcccgtctacaaagccatcaatggcgtcaatgtcaatcttcgggtataaagacttggtcattgccaatgccaggcttgctcccatacttccagcttccttgatattcttaaagtatgtatccggagcaattctcagctagtcgaagatttcggaagcatcaaatgttctcggaccattgttattgaagaacatggcttggacgagtggggtagcagcgttggcgacttcatccctagcccttcaagcctcttgattttattgaccaagacatcaaattgagccttagatttaatcttgcaatctacacaaatagatttacattaacgagtgggcataaagaaaggaatgatttttgcaatatgggttacccgtaccttcaacatcttttagagccgaatccctttgtcttgccaattcggtcttgtcattctccagagcttggatccacttttccagctcggatatcttggcagcttgcactgcattgcttcttgttggttgatatcacatgcatggcagcataagtaagttagacggagattgtattaccttttgacgaaccgctcagttcgaagttggagtcttgaagctcggcgatccgatccctcagatcatgctcagttttccttgcaagctccttagcttcgtgcagctggtttctggtggcctcaagggttccaagatggggaactaacctctcaagagtcgcagtcttcgcctcgttcctgaaatggattctctgcaatgcgaatttatcggcatttgagcaaagtggcaaacaa

SEQ ID NO: 40128 - DNA, 9300 bp, Oryza sativa
aattccctgaggttgcatgtcatcatcccaccacttgactagaatgggtgggcgagaatcctcagctgattgtatccgaagaacctcttcctcatcaccggtcatcggaccttacatggttatggataatgagtgaggtagttgaagaaagtttgttggatcaagatgggtttggaggatgtttttacctgtgataatttccggtcgggaacaagtacgtccttgtactttaacaggagagctggaccctggatcggcactggcatcctttttaggagggctggcggcttgagcttctacttcaggaatatccttatttggttctgtacccgactggtttctagtcgggggcttctgatcagcattggctccagcttcggcaagttattgatttctacattgtcggttgccggctagttgtcactcgggcgattttctacagtcggcccggttccttttgaagaatccgtctccacatttgtcaattcagcgtcctttcctacgagtttgagttatgctatcaacgctatttcaatagtgggtgagtagcaatacaaagaagatggccatatgatttgtacctggaagattttctgatttttggcataggacgactggaagttttcttcttcggattagtttgccttggtagttttccagtcgcttctttgttgctagtcttctcagcatcgtcgccctcatcatcactcagaaccaatttcctcttacgagagtctgactggctagttgatttcgaggtgtttggttgagtatcagaccgaatttttggtcctccactcgcctgaccagcttgccggcggggtgatcggcgttaagcggttggaggatccgacttcatcaaagcaaattcctgggcatgatatttcaaactttcaattagcttaacagaagataaaggcatacttttgagaaaggatgaaatgtttgaatacataccggtggaggaggattgaaggcgttatatggcaccactggcagcaaatgcgaataactgaccacgatagcgtttgagaagattttgtacattctctcctttatgaccttaaaatcaagagggtatggatcttcacggtttgggtcatgcttgccgtcaaattcaaaggctgtacgggatctctctttaattagagctagccggctcttgataaaatgccgggtgatctgttctccttgcagaccttgctctttcagcttcagcatgcgatccatcaggacaagtgcctgggctgcttcctctcccattggaagtgagttccaagtgtcgtgataaaccggagaagacaggagtattcggggagcgcaggctcggggttttgtagatagaaccaatttgcatgccagcctttgtttgaggttttgaagggcatggaaaaatacttttggccatggaaaaacacttgctcacgacagtttagcctaatgctgttaaaatcctttttgacgcagttagataattctttggaattactacgatgcaaataaaaaggtgcccaacagaaaagtgttatactagttttgtaagtctttttaggctgcaaaagctgttcgggttttattgagatgactggtttttgaatagttattctctcggcatgttatatgcttattttgattatggcgtgagttatagtctaggctatttagactcgtcaattttcatgatatcacatttataccacatttgatggatctttttgagtttttactcggatttttgtcttatgtgttgatctatggaccgttagagtattttctactcgggcctctttatatcttcatttttggtatattacggctaaagcagttggatggatgttattgacaccttgactatatgtttagtttttaactaataacatagtcgggggctacacctaattaggtgcatcttgtcgatgcacccgattttttctattttcagcccttcacagtctttaattttggtactcgggagatcaatacagaagaaattgaagcactcggattatcattttacgttctgagagaaggttatctcgtcgactttaaaggtttcaggggctactgtggagattatggataccccatacctacacggcatgtatagtccaactgggtatggggtgccatgtatagatagaatatcttaaagaggacttgggttaaaatctaaacttgtatgtcaaggaaatatctgagatcctagtcggttacgattgtattttatctgtaactacatattccattagggatatagactgtattttgtaatacggaccacttccgctatacaaggaggggtctgggtgcctctaggggcacgattttctcccagatcatacgatcaataatacactcggcggacaatctccgaacaggagtagggtattacttcttaatttagaaggcctgaacctgtataaaaattccttgtctctaaacccatccacttttccagcttgatagccatcccttttagtattgccgaaatcttgtttcgacaacctgccaaaatgattttttgtcagtggagcgtaacggccgtccacccttcattattttccccccaaaaccgtgtgcccacacttccacaactcaccatttcaatcacactccctcctttctctctctgccactcatcactccgccaacatgctctctcccacggtcccctcaatacccccaccctactctctccccccatccccgtgccccatatcttccccaccctctactctctcccacactctctctatgtggcggtgcggcggtgtcaatggcctcagacggcaatggcaaccgtatcagcggcggatccacagccgaagagcttaggaagggcggatccgcctccagtggccttgggagcggtggatccacccttgcacgccatagagagaggaggtggaaaggtggtgcggcaatcacggcaatggtggcggctggctcataggctacggtggcggcacccaacaactgcgtgcgacctagggtattagacttattctatttttttctaaaaaaaatgttgcaagcggcttccttaggatgcctgtctacaaaaatggtttttcacatgcagttgtgatgcccccactcaaaaaataccaatttttgcagacatctggctctagacgtgtgctcctcctgcctgcggaaacaggttggccgcatgcaaagatcattttcgtagtagtgatattacatttcgttcaaataggacttcaaaatctactatgtcttccgtttaccattatttatacccggtttcattcaccattccgcaacgagcaacaatggaacgtacgctcttgcatataccttcttggaatggtaggcatgtgtgacttgagatgcactctggaggtctctggtctcgagccatcacccagtgtgggcagctcctgcatctggagattgagacgttggaacttcatgatctgtccagtatcaatctgtcattaccataagaacctaaccacgggatattctaatactctaataaggatagctcggactgctgctgacctggtgctgtagacctgcctcgaattgcagaaaaactggtttacattgaacatgggtgcaaggattaaattataaagtttgcattatctcggccaactccaatacgatgttaaaaaaagtttgttcatcattaatgattggacagtatatatattatctttgcaatgacgaaatattgagcaatcacgtgacaaagttgtcaaatgaatagttttatttttgtcatcttagaaacaagtactgattgtatagagtagtagtatttagttgaagagcgttgctatggtccggcagaaagtaccgctcggtactggtaccgcacggtaccagagcgaattcaatcggtgggcaagatgggaaatgtgttgcgcgcgtggttggaggacgaaaatcgagcggcgccgcaagggtttatcctctccgttccttccccgcagctcatcctcatctcgtctctttcgaattgccttgcatggcgccagcgtcctctccgtcttcgcatcgccttgcacggcgccggcgtctctctatcttcgttgcgccgcgccacggcaccgtcgtctctcccttcgccgtgccaccggcgtcgccctggacttcgccggagaagctccgccaagcacaccgcccttggctttgccggacaacctgcgccaagaacaaaacgaatcgctgctgcaacgctcggcttcagatcggatcagaaagagagccctaggatttctcctgcctcaaaccgaatcgatctctcatgatatgcgaagttacgcatttgcccttccacgtctccaccaactcgtggtacggctcacaatcaaccacggtacctcgcggtaccctcatttacagaccattcgatcctctcgaatggacggcccagatttcgtaccacaaggtaccgtgcctccctgcaggaccgtaaaaaagctcttagttgaaagtttctaatttgtgagaacagggaacgttaatgaaatatcgaaattaacaagttcagtggcacatttcattatttctagttatgaatctcctgaaagcgctttcccatatctccttgtggcatatcctccttagagcaaatactgctagctcttatccaagagtcctttgtacatgctcaagagaaatacattaaattgataagcgaaaaaaagtagagatgacattataactaatccactatacatgtttattgtgctaatcctatatatttataaagtttgtctctactaaatgtaattaatgttaattttcttttctctcgtgaagccacaccatctcaattatttttagcctttgcattattcatcaagggtacaaattatatcttttatccctcaaaagctacactatacaactaatcatttgaataatgatcaagttactaaatatataagcatataaagaaaaatcgtatagtacgatataaaactttacaactcatatctgttattttgtcacatacttctgcagcgatccacgcggtactcttctagtattagatgagcttatagccgatagttagctcaactattaaacttgcgcatataacatgacagtgcttctagtatagatgtattattatgaaaatatttaaagcagagcccacatggacgttaaagtctttaatagctgacattatatttcattcacatagtcctcgaaaatctggtttacttttcttgtgtcatttatggccgatcgattttatttaccattttaatttcatgccagttttacatttaagccgtccagattcagcagcttgattgcagattacaaagccacagcggatgcaccattacacaatctactagcttttaaatgtggaggccagctgaaggaaccggataaattaatttgcacaacaagttttactcctatccggcaacagctactggcttaagatcgagtaagctagaagtgcaaggtgcagagcaaaaaaactgaaacatccattttacacttgcacgtctgtctagcttctgggaatggaaggcatgatggatttgggatgcactacgcaaagagtccaatctccagccttcatccatggacacctcgtccattgattcctggacttcctcctctactcgcacgctgagaattcagaacatggctgatagtgatcagtccactgtcggcgcactggtgtgcgtatcaccggaagctggcctgaggattccacacaaaatgtggtgattcctcttcatgctcgttatgatggcctccttcggacaggctgcggtcaggttgatctggagaaatagcatgcgcgcgacactgctctctcagactactaactggatgaaggatgcatggcacatacgatacacgtctcattgccgagcagcagaactaaccttgagattacaagaaaggaagtgaggcaagctgaacaagccagttttaaatggcgtataatacagtgcttctaggtaccttagaatagttatgaggaacatgagacatctaggtaccttagaacacccttgtcgtgaacaaactaaaggatttgggggcaggagcagcttgcagcacgtgtgccacagtttagaatcaacatggttggcgattgacagcagcgctctgtcaggcttcactaaaaattgtggaaaagtaaataaagtgtattaatcttcaaaattacggatccccttggggtctacttatagtttttacagtgcaagtttatacagccctatgtctcccatgtattaggcaatttacatgaccgcgcttacgatagagacgtttacaagggtaattatagacaatcaacccatctaaccaccgtcaggtctctatagatcggtccagctaggcatcgacttgcttcgcctaatggcagaggttcttcgctgcgccccctcagcggggagtctgagcttcgccctcagcttgatgctttgcttcttcggtgcttcgcctcaaggctgggtaagctgtttcggcggggttggccgaaggccctcttgacatgcctccaagaaaaatcatgacggaagatcacacatccatgttgctttcctggtaggaaacgttggcgaagttgacgggaatggtagacctgtgtgagcttcatagatcatccatggtacactcgcacctacctatatttgattctcatactgccacatatacaggcttgcaacgaaaatgtggtaagcagagaacaaggtcgagctatcccgctggcatagaacattttttttgaagggatgaattcttagcactggatattcttcatgtacttgacatgcaaattagtcaaggtatcatgattcttttgccaaactcatctttaaaacctgatttctgatggttcagctgagaaaagttaaggagaacaaaatgtgcctgcaactattatatatcagtgtgctagaaattgaggaacaactacatcggtcggtgtgttcatcttctagtttccttctaagttgggctgtcgcagtgtaatacattttttttaatacatgcccctgtataatctaagtacttctaatacaacatcaatatttgaactatttgaatagcttctacttcagactcaacatgtttgttgaagtccttcagagctgacaatgtttttcattcatatagttctcgaaaatcaaatagatttttttttgctggttgcctattttactatcattgtaattctttgatagctgaccatacatttcttttgctgaatatgtagcacccacctatttgattctgagcagatcaaactccgctttgcagagcacacagccacacaaaccatcattcgttatgcaattttaggtggttgtgtacaactactttggatgtagaggctgagttttaatccactttctaaaaaataaaagcaatttagcatttaaaaggcggagcccaggagcaagtgcaactacatacctgttgttatatatgtggaaggctctacacttgcagataagagtaagctatgaatacacggcacagacaaaggaatctgcagttctttagtcagagtcatgagatggatgcacgacaataggaggccacaacaaagcactgtacatccagttcatatggatgcctagcttatcggaatggaaggcacgagggatttgagatgcactacacaagactccagtctccggccttcttccataagcagcacgcacctggcatgaagaactgagtcatggtcgtccccctcaacggtgatatcaagagcccatcctctcaataattctatcactattaagccactaagtagactagcagtccattaaggctgacatagcatgcattcgccataccatgcttcctttctttttcgtttttaatgattttctgagttaatgtttcctagcctcgcagagggagaaccatctcttagggtaatcccatcccatagtgtccgtaggtagtgtctagagaagaaagagggcaataaatatccatttaggcataatcttctccaatgtatagtgcccatggctgtgtttgtggagaaaacaaattaaatgcctttattatgcatgtgcaaggatcagctacggcaaaaatcctaaagatcagatatggaaaaggggtggacgacacaaaggtcaagatatctagaaaaatatctagggtaagaaacaactaatcacctccaacgctactttggctagtattcagggccttgatgcacacgccgatctagtttcctgcatgtgacattgtttcatcttttttcttgctctccgttctttaattaccatgccacatatgcatccgaattttgatcgggtggcatcccgataaattctatacacaccagcttacgtggtgggttgggactgccattaatggtacatttgaatctgctctttaaactgctttgtaatctttcttgcctagaacaagttctggtcaataagtggaaggcaaccatttgggtctatcagactgcagcaacagttttgcaatttagctcaaaaagtagagtcaaattcttcagggtgcagacttgttatttgcatgaatggctgtagtcgctaaccttagagtgtgtaatgtacataataagcaaaacgatcgcaatacacccgatgcatgtgtggagattataggcactaggtatctacatgatcaatatatctggctgctattaggagatggaccatgactgtgatatttgtaattgtacacattttaattgctagagtttccttgcctgtttggacatgaccctaggttctaactaggttatcttttgtaatactaaagaaagtttatgccgagttcggtcgggtttcctacttgtacccttaccttcttttttttagataatgatgtacccttacctcctaacctatataagggtggggagcccttgaagagtatatagcgaaacgcaccgagatcgtcaaatcaatacaataccaagcgaatataatcactaaacatgaatagggtattatctctcattgagagggtctaaatatgtctaaacctttgtctttgtatccatccggttttacaactcgtacactaccctttttattattgcccgtataaaacatcaataacatgattgcaccacaacgtcggtgaactccttcatccccccatcatataagatagtgtgcatatactgcttcatgccaagctcgttggaatgggaggcatgtgggacttgcgatccactatgcaactcttcgtgatccatccatcgtcctcatttggctctgttcgtgcgtgaaggactggagacaatccccgatgctgcacagtgcacacggagaatgg

SEQ ID NO: 40129 - DNA, 2653 bp, Oryza sativa
tatattattatgaacatatttaaagcagagcccacagggacgttaaagtgtttagttcatagctgacagtatatttcattcacatagtcctcgaaaacctggtatacttttcttgtgtcattttctgccgacatattttatttacaattttaatttcctggccgacatgacatttctaccgataaacaagcaccttatatatttaggccggccagattcatcagcttgattgcagagtgcaaagccacacgggatgcaccattacacaatctagcttttaaatgtgattaaatatggaggccagctgaaggaaccgaataaattaatttgcacaccaagttgtatccggcaacagctactggcttaagagagtatgctagaagtgcaactgtgcagaacaagcaaggcaatacatccatttgggaatggaaggcatgagggatttgggatgcactagacaagcgtccaggctccagccttcatccatcgacacctctgccattgattcgtagacttcctcttctagttgtgcaggggttgatggtgatcagtcgaccatgtggtgattcctcttcatgctcgttgtgatggcctcctttatacgggctgaggtcaggtcgatctagttagaaaatcgcctggtgaaaagcagcatgtgacactactctctcggagtactaactggaagaactaattggaagaagcagggcatataaggcacacgtcttgttgtcgagcagcagaagtaagcttgagaatacatgaaagctagtgagaggcaagctgaacaagccagttttaaatagcatatactccctccgtttcaggttataagatgttttgatttttgtcaaagtcaaactgcttcaagtttaaccaaatttgtagaaaaataataataatattttcaactcaatacagatttattatgaaaatattttcaattattaatttaataaaactaatttggtattagaaatattactatatttgttcataaacttagtccaatttaaagtagtttgactttaaccaaagtcaaaacgtcttataacctaaaacaaaaggagtattacagtgcttcgaggtaccctagaatagttatgaggaacatgagacatccggagtttcagctgttcgtcgaagtacacccttatgtcgtgaacaaactaagatatgatggctttccacatcaagacggaagaacgcacaaccatgtagctttccttataggaactgtgtgggcttcctagatgatccagggtacactagcaccttcctatatttgattctcatattgctgctactcatacaggcttgcaagtcgcaaggaaaatgttgtaagcagggaacatggtcgagcgatcccgatgtcataaaacctttttttttcgaagggatgaattcttagcactggatattctttcatgaactagacatgcaaattagtcaaggtatcatgattcttttgccagactcatctcgaagacctgctttctgatggttcagccgagaaaagttaaggagaacaaaatgtcccagcaactattatatatctgtgtgctagaaattgaggaacaactacatcagtcagtataggtcaacctgcatggacatgtttgcagtgtattgaaaatatcccacattcctacccctatcaaagccgtacatgtgtatgggtacactgttggagaaagggttttcacctacggttcgtaacccccttatataaagatgttaaaataaccggaactaaaagttcatctttattaccggttagtaacatcaaccgggattaaagaggtgaatctttattcccggtttggtattaccaagtccttcagagctaacaatgttttttgttcacataattaatgcaaatctagtagatttttttttgccggttacctattttactaatcattgtaaatattttgtatctgaccatacatttgtgttgctgaatatgtagcacctatctatttgattctgagccgatcaaactctgctttgcagagtgcacagccacacaaaccatccttccttatgcaattttagctggttctgtacaactactttggatgtagaggctgggttttaatccattttcttaaacataaaagcaatttaccatttaaaaggcggagcctaggagcaagtagtgcaactacatacctattgttatatatgtggaaggccttgcacttgcagataagagtaagctatgagtgcaaatcgcaaacaaaaaaatctgcagttccttagtcagagtcgtgagaaggatgcacaataacaggaggccataacaaaccaatatacatccaatttataaacatgtctagcttatcggaatggaaggcacgagggatttgagatgcactacacaagactccggactacggcgttcttccataagcagcacgctattggcgtgaagaactgagttatggtccttgtcctcaatggtgataacaggagcttggagcatgggcgagcccatcctctcaataactttatcatcattaagccattaagtagacaatgtgactagcagttcattaagcctgccatagcatgcattgccatacatgcatgtttcttttttcttgaaaaagggattgccgagttaatgtttcctagccttgtcgaggga

SEQ ID NO: 40130 - DNA, 19679 bp, Oryza sativa
ttcctgcagcccttcaatgtatagtgtccatagctgtgtctacagatgaaacaaattaaatatctttactgtgtatatgcaaggatcagctatagcaaaaatcctaaagatcagatatggcataggggaggacgacacaaagaatcaggatatctagaaaaatatcgagggtaagaaacaactaatcacccccaatgctgctttggttagtattcagggccttgatgcacacaccgatctagtttcgtgcatgtgatattgtttcctcttttttcttgctctcccttctttaattaccatgccacatccaaattttgatcaagtggcatcataagaaattctatacacatcagcttacgtggtgggttgtgactgccgttaatggtatatttgaatctgctctttaaactgctttgtaatctttcttccctagagcaagtgctggtcaataagtggcaggcaactcatttgggtgtatcataatgcaggaacagttttgcaatttagctcaaaagtagagtcaacttcttcagggttcagacttgttctttgcatgaatggctgtactcgctaaccttagagtgagtacattacatattaagcggaataattaattatttgtcactcttagagtggtgataaaagatttgccactgaatccacatatcatagacagaagagagtccacgtgtcatagacagtgagtggtaaataaacaattaccacatcttaaaagtggtaaaatttaaatgtcccataataagcaaaacgaccgcaatacacccgatgcatgtgtggagattatagacaccagatgtctacaaggtcaatatatatgactgctattagaagatggaccatggctgtggtatttgtatttatatacattttagttgctagagtttccttgccggttaggatatgaccctaggttctaaccaggtaatattttgtaatactaaagaaagtttatgccgagttcggtcgggttttctacttgtacccttagcttctttttttagataatgatgtacccttacctcctaacctatataagggtggggagcccttcaagaggatatagtgaaacacaccaagattgtcatatcaatacaacaccaagcaaatataatcactaaacagaagtagggtattatcgctactgagagggtctgaatatgtctaaagctttgtctttgtatccatccggttttacaccttgtgcactacccattttgttattgccggtataaaacatcgcgataacttgattgcaccacaacatcggtgaactgcttcattccccttcacataagacagtgtgcatatactgctacatgccaagctcgttggaatgggaggcatgtgggacatgcgatccactatgcaactctacgggatccatccatcgtccttgtttggctctgttcgttagtgaaggactggagacaatccccgacgctgcactcggagagtggaaacttggaacctggtggtgtgtgcgccctttgggtaccttcgaaacaccataagttagccaaggaaatgcacctgataaatccctctcgcatgcaggtcattgttgacagacccagggacgaccaaggggagaaccagatatgttgatgtgctcagcccatttcaaccagcttcagtgacaagctaaaattctcttaacattagtaaatgacaatatttttccagacaaatataaatatgccattatgatgttttcaaacttataataaacaacatggcagcgcacacagcgagacaactcagaccattgtgtaatttggctttaataagtggaggacccaagcaactgaaatacggagtaaatggcatcccctaaaaaaaactgaaataaaatttagacattgttgtttaggtggatagctctgctcagtatgcgaggagtgcacggagcagagagtaatcagtaagcaaggattataaagagcagagtaagcaacacgactgcaatgttagatgattgacaacataacatgcctagctgttcggaatgggaggtatgacgaacttcaggatttgagaaagttcgcaagtttgtagcatccagccttcacctatgggcagtttgaccaagttgtgaagaacagagtcgatcatggcccgtgtttagttctttggctaaattttttttacgtatacggacacacatttgaagtattaaatagactaataacaaaacaaattacagatttcgtctgtaaattgtgagacgaaactattaaacctaattaatccgtcattagcaaatatttactgtagcaccacatttgtcaaatcattgcgtaattaggctcaaaagatttgtctcgtaattgacatgcaaactctgtaattggtttttttttcgtccacatttaatgctacatacatatatccaaacatttgatgtgatggaattttcggaagtttgaagctaactaaacatggccatgatacccctcctggaggttaaactgaaaaatctcggaggtagtgagtccattctgtctgtgtcagcatagcagtacaagctggctgcaacataacagggtcaagttatttcgcccaagtccaatgacacgacgaaatcccctgtctaatgtttgtagtatttgtattaatattgagcaatcacgagggtaagcagaaaatgcggagtaactagcttggttggttgcaatccactggatagtgtgatgaacacactgatgtaaggcactaatccgaagttaccattttatttaaagaaaaattttaccatccaacattgataccttgaggtagtataaatttttggtaactcgagatactttttagtatacctcgaggtatcaatgtttgttgttaaaattgctcttatttaaaagtagttaatgtactccctccttacctaaatgtttgacgccgttgacttttttaaacatgtttgaccgttgtcttattcaaaaacttttgtgaaatgtgtaaagtatatctatacataaaagtatatttaacaatgaatcaaatgataggaaaagaattaataattacttaaattttttgaataagacgaacggtcaaacatttttaaaaaagtcaacggcgataaatattttgggatggaagcagtattaaagttactaggggtgcaagttacagagcaagcgagaaaactgcagatctctgcaacccaaagttgtgagacgattgcactaagacaggaggtaaattacttgaggctgcatacatccaacttatacaaattcacttgtctatctacttggaatggaaggcatcaaggatttcaactccaccagattagtctctccaagctgcacacttcacccaaagagtgggttgtcccggcagtggagaactgagtcatagacatcctcctgaaccatgttggctagaacttggactgtgtgatcagtccaacctctaagtatctccctacctgtaggaaggcatggatgaagtcggagggtaggaaagttaactaggagaaaacctgcatcagagtatggcaaaaaatttgtttgcattaaatttgtttgcaaggaatgatacattcagctttactgcgacaaactgcaagtgttttaagtaccacgtcagaaactgcttgaccgttgttattaaacataggaacagaacatgcagtattattcgtgcaacattcttcttgtttcgcataacaaatgacagtagttcaaaaagaataagaaaagtgattttttacggtccagcgctcggtaccaaaaattgaaccattgaatccaggatgggtaggatcgggacagaaaatgagcaagggtgaatgtgctcgtaaatcccggcactgcaggcagcggcatcatcgatccatgcggcggtgacattgaagtgttcaatcccagtggtgaggactcgtcgattccagcaatctaggcaaccgccgattgaagacgtcattcccggtggtggcggagttgaagtccaggcgttgaagttgtcgatctaggcggcggcgaggactcgtcgatcctggcggagtagaatcccagcgccgactggctgaagagtaggaatcccgacgccgatgggtggcaggagcaggagtcattctcggcgcatacgggcggagaaggaggctagatgcaaggcaggcggcggtggatcgcggtacattgttgcacacaaagttacatttttgccattccacctctgtcctccgagaggtaccgcattagggacacaattggtacctcaggataccaaactctaccagccgttggaattttggtacctctcaatattttacactcgaaaatgtggtaactcatagtatcttctcaacgatcataaaataaatccaagtacatacatgtggcagagcagaaggtgtaccagactgttaatgatgtaacacaatatgtacacaagtattttctttacaataagatagatggggaaatgacaagctatgttgaaggtagaaaaatacatcatgcaacaatttaacagcatgacaatcatagtttaccgtggaagacttccggataacataaattcttcctgcaggctatagcaacctggagatgctaaattagccatactgttgattccaatccccgtagcttgatgataatctacatgtccttctgattgtggagtttgcagctcatcgctatcttctggagaaactgtgcctgatctgaaacctttatttcttatagattgtaatgacatctctacttgcttcatagttggccgttcttcacctctaagcctcaagcatgcccgggcaattgaggcgacaatgttaatttcatcctcagttgcttcttcaagaacttcaggagcagctatctctgcaactggccttccttttagctcagaaaggaagtaaatagataaatttttctttgaaccagattcactgtcaaaaataggttgcttcctgagaagcagctctaaaagaacaacaccaaaactgtagacatcactcttctcatttagatgcccggtatggtagtactcaggatctaagtacccaaatgtgccttggatatttgtaaaaacatgggtttgatcattaggaatcagtcttgataccccaaaatctgataccttagcggtgtagttggcatccaaaagtatattcgaagatttcacgtcacgatgtaaaacagatactgatgctgcagagtggaggtaatataaagctcccgcagcttcggtggcaattctcaagcactgatcccaggacaatgtgaattctctcatacttggatcagcgtgaataatgcaatttagtgagccatttgggacaaagtcatacaccagtagagggacttcggtttcaagacaacatccaaatagttttacaatgttccgatgatttatctgcgatagtattgcaacttcgttgatgaactgactaatctcttcttccctaatgatgtttggtttttttatagctaccacacgctggtcggacaatatgcccttgtaaaccataccatgccctccactaccaagaacacgtgctggatcaaagttatttgttgcctctttcagctcttctagggtgaaaatttttgtgctatcagtagcgcattcatcagatgatataagttgctctagaagaaggccttgattttttcgaaaatatttcttccttaattgcttttggatatcattctttcttttacggacaaggaatgctacggttaagacaagaagaagaattccgaaaccaactcctaggccaattgcaatacctagaaaaacatatacacatgttagtttatttattttttcaattagatgtaacgacaagtaaaagtttcatgaggtaatttaaatgaaaccatacatctaagattagtttaatattcagtgaatattattttgtctacttgtttaatgctgtgaaagagaccggcattacaaaacccaagttattttaatttttttgaaatatttgtagaatgcaaaatacattgtgctacttcctttttaaatgattttaaggggcccaaatgcatttcatgtgaactttaaagcaaatattggctataaaaaatcttgcagtattctgaggatatgtgtttaccgaatgctagtggaaactcttttcggcatggtccaacagaagcatctcctcgagtacccgcagggcaaaaacaatcgaatcctccaagtttgttgatgcacttcccatagcaagggtacttattagaatcctcacactcgttaatatctacaatcatatttcacattgatgtcaaaatttatgatgttactcccaagaaaacaaatattgcttgatggcatgcagtaagctaaaaaaaagttgtatataacactattaacaagctttgtttcgattatggctaaagagtacagtttgaggtttagccacccagaatgttacagacatggatcaaaacatgggtgagttgctaacaccaaagtttacatgcatttaattattaataacacattcaaaattttgtgtctccatgatatgtgctggttctagaaccgacaccaagaaggaacaccgatgagagatggtcactagtgccagttctaaaacaaaaccaacacttacagtgctgtctgcgattttgattttgcttacatgtcatgttgaagatccattaaactgagcaattaatcttagcatgtggcagctatgataaattcattcttgcgccaagaagcatgcataccataactggaagttattaaaccatggtaaaattggaaagacgccatttcgaattagctatttagtcaaaaaaaaagcaagttacattaactctacttcttttaggattacattaactcttttttttgacctaagtcgctgtattttgaaaattattaacgaagatatgcaccgaatggttaaatttatagtattaatgattagtaaacataactcatgcaacgcacgggttggtgattagtaaacgcaatatctgtaaatcataggcgtagtgaaatattcaccttggcaaccatcatgaccctgaaggtaaggattcccctcaaatccttgagaacatttgcagaagtatcctggtccattgctcgagtcaatacacacgctgttgctgctagcacatgcatatgaatctaaatgttttcttgcttcggcgcaggtattgtttgctacaacccagtccaccacaaatggaggctcaccaccgaaagggttgctgaaattcgatgacgtggcataaatcgtggagaatttgaagctggcctcctccactaacgctccataactgcaacgggaccaattgtggatgactgatgtgttgaagtgtgtgtcaaaccaaaccttgtagtgcttgatccctttggggatggccgtctgacagcagcctatcccagagcatccttcaccattgatgcttaaaagatcatcaccctggccacaactggtggcacagccaattgttaggttactgcctacggcgctctgcccaccaggaccgaggtaaccaagcattcgacatccaaagaccgtgaacttgttggcactgttagagaatgtgaaaggacttcccgtcaagctcagatttgccttgtcgacgcagtccatgtcatgtttcgtcatgttgtagcattcgtatgacataggcatcctcatgcgagcctaaccttctggcaacgagatgttgagcagctccacattccggagaagcagcttgggtatgctgttaccggtactgttgcagatcagctcaaaaccaggcatggcgcagccagcctgacctttgatgccgaatggaaaagggatatctatgctaccacaacttctctggcaggtggatgctgcaactacagcaagaccacctgaagttgctatggtgagacatagtagagtagggaagatcaatgcctgaatcatctttgttgctggaaaaaataagattgctagctagatgttgtccacctttgtgtccaaggtctggtatatatagctccatatgagtgatataagtttattagctagcaattttagctttctcagttttttatgcaattttagctttcgctttttccatatttttcccagctaaaatgaaattactctcataaagtacaagtcctcacacccattaatatcagcaatcgtattctccgattttcatatctcgtatttccgatgtacttaaatgaaagacaccagaattatctgatatagatttataattgtcatacatttattgaaaaaaaaagatggagtattatctattagcttcatcagaatgcaccgctcgaaataccttgacttggactttttctaggtcttcctcacttattgctttaccaggaatttccatgactagttgttttcacaacaccaactctatttatgaatccaattaaataattcatttgcctgcatatccatggacatacatcacaccagcttgtcataacccgattcaatcgtatacagaagaaatgcatgggtatgaataattgtctagctttgcatccaatgaattctagctctaccagggagattcttttctattgcagtataatattttagataatggagagtctgatgtctgcacatcgcgcatccagctacctaaagttcgcaatgacaaaaatccaagactatgcacctgccaaattgggacaagagatcgttctctacccactccaactctgtagatccattgagcacattatccggacacggaaacgagccgatcggaaatataatctacaaagattataaatacagcaacaccgcacatggccaacatacagtgcaccagtcccatcaatattttgtaatggcatatatatatgcatcctccttaattaaatggcagatcggtttgtaattttcgattcaagccaatgcatcgagccagctttttgtttttttcattcctagaaccttaaaggtgcaggttcctaaacatcaccattgagtcctcctcaaaggcgccgcctgctagttgctggttcagaaatccaacacctatgaccagttcctaaccggcaccgatctccttctctgtagtagtgataattattccgtttataggaaaaaatggttataatgtcttgttaacttaacatctttcatttttttttctaaaagaaaggttttattttacatacttttaaaaaatataatctggacatttggaattcaatacgatgcatacttttctcgtatataatatccataaaaagaagtgattggccccacgtgatgttcccctgcctcttttttctcctatgaaatgatatcacttatgttagatatttactcactctgttgcaaaatactatgactttttgaaatttgacacaggtatcaaggagaaatgtaaactaaaattatggatgatttttgattggttaagatgaaaaagtaggcagataaatcaaattgaagatggttgtgatttgttgagaggaagaaaaggttgctatatttttaggaaaacatggaatgttaaaggtaactacatttgggatggaaggagtatttagcaaggggatgagggaggactaccttaagctgcatctcttttaaggagaattgaaagacactttcccactgaaacttatatttgcatgtacttcttatactcacttacctattcacctttcataatccttgcggtacaactctttctatactttttaacatcaggagcatttgaagaatttctaatgctccatcaatccaaaagtcattatattttattttatggttgtttcatttaccccccttaactatcacggtcattcgatttaccccccttaactacaaaaccaaacatttgacaccctcaattatttataccgaacaaattacccccctcaatagtattttgagcagttttaagttgagcgtgcacatgtcgggccaacgtggaaatccaatcagtaaaaaaaatgcttccccggcgcccacctgtcatacccctccctcaacccaatacttccccatcactctctctctcacacacacatacacacactcctctcacacacacacacacacacacacacacacacacacacacccgggcggctggctgtggaggaggaggcggactgggtggccggcgttgagaggctaacgaggagcttgcccgggcgactggcggcggaggcggagctcctctaggaggtccgacggtagagatggagatcgcccacgcggcggaggaggtggaccgggttgctggcggcagaggcggagaacacacgagcggctggtgactgaggcagagctcacacgggagacaagcggctgaggcggggatcgcccgggcggtgggcggcaggcagcggaggcggggctggtgccgcacgcggcagagagcttgctctcccatgacggccctccctgccgcgcccgccacccgcccttccccgccgtgacctccatttggaccaccgccgctgccttctctgcctggaccaccgccgccgcgctgcactgcaggaaaggggtgggcggcatgctaggagacggcggcaggctcgtcgccgccttcatgagagctacggctccaccgccgcagatcccaactggcggcgccgcgacggtaggtccaagcggcaccgtatcgacggcagtatccggatgcagaggcccgaggcagagaggttgaccctcgaggactcgcgtcgttgcttggccttcccgctcgtcaagatcgatgggtgagacacggccgagggagaggatgtggcggggacgctgccttccaccgcgtatgttactgccactgctgccgccgcctaatgcacgctgtcttcatccgctgtctcatggtggtcgtcgctgccttcctctacctccaaccgcttcgggttgattcgggggggtgattcatccaatatgtaatgctcgagatgtaaaatatctggttttgtagttaaggggataaatcaaatgaccgtggtagttcagggggaaaatccatactttttccttttcaaaaatgagatggtcgtaatggtagtctcgatgcatctaacacataattgaagatcttgcctttttgctagattatattgttgaccggaacctgagcagccatcttaagactcgttacagacctggatgcatgcatacaaaagaaacttctatgggataggttaatactcactgcatgcaggcaaaagtttagttacatgctgatgagttaatttgctgttggtcttcacaacaaaagatatacgccagggacttttgcatgccgtctgtatcccgttgattcatcttaattttagttgtaagaggaaataaccaaagtgtctcacattaataggaaaatagtattttcaacggtatatttgtttttaggggttgggaacccttcctgcctagccggcaaaacaaacactacagcatgacacaaaatccccaacggaaaatcggttagcaaagaccacattcaaagacaaactgtccgtcggcaaaagtatagatgaattatttccatatgattttggatgggaatgtttggacatggtgtagtgaagagatggaacagcatatgattatttattagctaaaaaactgaaaaagttgattaatatggtttttaaaaggaaattttaaatagaccctttatattaaagacacactatttagcagtctagcaagcgtgcacgtaaaaaacggtaaaaaacgaggtgatagaagtttggaaagaggagaaaagaacacacaccaatacctcttccatcccaaaatatgtagagatacctcttaccatttgtgccaaaattagtggatttatatctcctttcctacctcaatcgaggagttgatatatatatttaaaatctcttacatactatgctagtgagttgatatatggaacgaggtgatttttttccctacatacagatttgtatcccagtctctacaaactaacttcttttgagggatgaatgttaccgtgctctctaccagtagaaatgatgtgtggaccgttcattcctaaggtcatcttagtactcgactaactcaatgattagggtaagtttgccattagcttttttgttctcttgatcgctggcagattgctcacattcgataaaattaaaaaaaaaaaagttgctcacctcgctcgtgaaatcctctcgccgacggctccttcggtccttccgccggccactctcgttgttgattacatcattgccaacacgagcgccgcttgttccattccggccattgctgacagtgtcaatcatcaagcatgcaggagtctcctgtaatattattgttgatccatcccgcgatgcataagcagttgtttgcctgactcatattcttcttgacaataccaatgtgtgtgtgtgtatatatatatatatagacacacactgttgggatgcaaatacgcgtgcgagacaaaaatatatttggttgccatgggtgtgaaactactggggatgtctctgttcatcggcggcggccgtcagttcgtccaacggtggcagccgactgaggggaagactgtttcactcgatcggctagggttagtcagtgctaaatgatgatttcatcccaccgcacctatttttctttttttttgacaattatatccttttatgtttcttctgccgtctactgaggtggtaatagaaataaatctagctagacccttggatcaaaatagatacacggttccaatacttctcaacttttggacctagggtaacttcgaagctagaaataattaatcctagctttgtgaaaaaattttaacactcgatagtcattaaaacttttttacacattttaaacagtggaaatgtcttggtgagatgaagtaacgtgtatgcatctaaagtggtagtactttcctgcaaatgactaatcatatcgcactattgaagaattgatctttactgggtcatgcaaaattcacattagtcccggttcgagtaggaactaggactaaatacggtttaaaaacccacgggtacttttttgatatttagtcccagttggtaacaccaacggggactaaatatcaattagagaaagatggggggtccattagactaaatatcggagccttgtgtccttggattcaaaaacatgtcagacaccccattatctttagtcccggttggtgttatgaaccgggacgaaagatccacctttaatccttgttgtttttactaaccgagaccaaaattaaaaaatcgcgaacagctgccctgagaggggcgcagagccacgcgccttgtcctacccgcctccttatctcctcacacctcatcctccccgcctccctatctcctcatcctctcctcctcccctctcatgttctcaccctctcctcctccccttcccctctcctcctcctcctcccctgacgatggtgatgatggtgatagcgggcggcgccctggtggaagcggccatggcagcgcatgaggcggcaggcggacggtggcctcccctccactatatccggcgggaggagaggctgggcggtggaagcggtcgccgcggcgggctgccgagaggcagcggcagcggccgggaggcggcgcacggccgggtggcctcccctctgctagatccggcgttgaggggaggccaggcgtcaaaagcggccgcgacggcgtccgggaggcagtgtactgctgggcggctggcggcgccgaggctttcgtggtttttttttattttttgaatgatttgcaaattttgttgtagatttttttagatttgaggatgaatttgtgaatgactcgtggattgtagatgattttttggatgggcatgtgaattgtggatgatttgttgtggatttgggcgtgacaatataattgctagtagcaaaaaaataatggagaaaaaagatccatcttttgtcccggttattttatccgaggataaagatgtgtatctttagtcccggattagacgtcccagtttgcaacctggcactaaaaggggttgcaaaccgagactaaagagcccttccctagcagtgtcagaggtctgcgaaggagagtagttgcaattattgctggatcctctggagttgtaggttacagcacataaatataatgaattttggagggtgtgacgcatcttaatactacgaatttacataggtgtatatatcacatctcttcaaaatccaatatattgtgggacagagggagtgcatggtatgtagcttcatggggtcaattttccagattaaatgcatagaaaaggaacagtcaattcaggtcagttcaaatgcttggtggaatgattattaagcaagactcatttcaactggagtagttaacttgtctccttcgcccccattactacttcttcattgattatctggtgtaaccaccgtccattttttctttgatatttcacagcgaaaggtccactgaacttgaaaattttatttcggacaatctttcactcatggactttttttttatttactttatccattagttaaataggctactgtaggatttggaaaaatattgcatagagtaagtatcactaacaataggcgttgttttccatacatactcacaggttatgccaagcattatggtgtttgctaatttcaatggagtgtgtattattcaggatatgagctgaaaaacaggacagggggtggccattgtccagaaagcacatcagacacaaaggggctgttttaattttttttttgggtaaaacttggcttagtttaatttttttatctctcaactctttgagcaagctaacaaataaatggtagtatggataaatgcttatattgactattttacaaaactactgtcgtgggggcggatgttatctaacttcagaagataaagtgatgggctttattgtgttttgttgttgaggggaaaaaagggtctgagatgtggtaatagaaatttttttttcccttgagatcaatacttgtataaaaaaaatatagtaaaagtactatatcctccctccattccaaatataagcatttgtagaattcaaaattttatactaaaaattccaatacaggggaatttaagaatttttttcgccaatcatattgttaggagaggaatcgaagcaagtcaagatttataatttgagtactagaggggtgactaagactagaatggaatctttctctttttctcaatagttgagaaaaaacaagaaatgttatatttagtaatagaggattactatttaaggactatgaacgataaagacgccgtggtcagtttccacgtaatattgatgagatgtcataatcctcaagtcagtcaatcttagattcctaaggagcaacgaattgaccttaggaatccaagtgaaaatatcaaaaactggattaaggcacacacatgtccatgacatattaacagcttcttcaagtctcatgcatgactcagtcacaccatgtgacctacgctgatcacgcattgacagggagtgctgacactctgagtctaaatcacattgaattcgatgaaaatcctagtagatatttgtggttacctagtcagctaatctacaggttttgcgtacaatgccttggactactcatatctgtacgtgcttcataatttgttgaactgcataaaatggccgatgtaaaacacacagcttgaatttcttgaaattttatactatttatagcatagtatttttacggtatctccagcagcggagctagctcccgggcaggttgggcgtttgtccatgctttctccactacgaccgatagctatgggttactgtcgacgaaaaacgctatcagtcgctcgggttaacggcgtcgctgagtacctgttaagctatcaggaggtatggaacttcatattatagaatttgacgcctcttacaactcaggtatcgcaataactgtaaaatttgtttatttaaatatatttaatccatttggctggactagcataatagatttcagataaattacataaaattgttcctggtgttaaatttagcagttgaaccgtagaataaattacaccatctcgcctgtacctaaccaacggacattcaagagacaaaccggagtagacaacagcaatctttaacaaaaaggaaaagaaaaaaacgttgatagttacaacagggcgctgcaatatatgtgcacaaacgcccagtaactaattaggaatcaaccgcaataaaggaatgcatccttgttctaggtatttactcccaatacatagtttgctccagagagtgagaggcagagagttgcatagcagcataagtagcagccatcggcagacattggcagctcgatggcagagaacacaaaccatacccccacataagccatgtgttttggctagacaggttggacgatatctcaaagaacaaactcaccgagttgctcgcatagatgttggtggctaatcggaatggaaggcctttgggatatcgctcgtgcatcggtggattctcagattacaccgtaccttttctcgcatggatggtgcacctgcttctgcattcagggatcaaaacttcacggacaaacatacttgaaagtagctgctggagctgtgatgtgcgacgacagaggaagatacaagacagcggcagcccaattttgtacgcaaggcgagatgatggtggaagttatggcattgctgtagagcagctgaatttacagatccggatcctccctgcggtaattcataggaacactgtgtcaacagttcatcgtgtataccgctacaatgaagtgatgtaacactgtagcaaattagcttctctatagtttattcctcaatgcagaggatctcgatcctgaactgatagttaagctaggaggaacgaaagtcatcatcgaaacatatgctatggaattggcgaggatggtgtattttgaaacagtaggagctaaaccggtctatcattggaccatgatctaagaactaaagtcgaggctaagagttttctaggaattaaagataatctaggtttgaccctcgtccctcagtgaatatggtcgcgcataagttttctcatttcctccggtttttatttcatacttccttgatgatgattgtaagaaaccttaatgtggcttcaatagagtgctactactatcgtcccaaaataagttcatttctccaatacaaaacaaaaaaacaaaaaggattggaatgcatctactttatcaaatctcaaatctcagtacaattattcattgctttatcttttcccaatacatttattctctactttcacaaactctgatgcaatttggtggaaccgagttagtgatctcgcgggtattgtcatcaaaacaacggtctttaccaacatgatggaactcgacatctttgactcgatgccatatgaaaactgcagtgtcaccaatcctgtcatgtgacatgtggtcgatttagtgacatatcggtcgactctccaactctccagattttggaccctcacaattagttagcgtttcctccgaatttatgtttagacgcttctaagtgtactcctaccagacatacttgtacaaattaaggaaatagtgaatttaccattctacccttcatcccctcccatctctaccttatccatgccaagcttttgtacggggagatggcaaggagtgtcaaataaaaaaaagatgattcccgaatgacttgcgatgtcatgcaagaaaggatggagggagtagctttttcttctgcaattatatttgcacataaatatttgccccaattgtagattctatgcctatcacctactcgcggccaacataatactttagtattactattcatcaacattgtacatcaatttggtaggcattcacagaataccaagtttgaatcatattataattttgttacaacttttagtttactttatggatttccaaatatttataaagatatattgccagtaccattaagtgggaggggggggagaaacgatatgataacaagatttatgttgtgcacatattcttttcactgcaatatattcgtgtctaattcttgagtatatacattacttaaattcgtgttctgtcttagaccaagttctacgtgggacctaaatttcagttaatgatatctttgtgtgagacagtggctcactgaaatctcggttaactaggtgaaataccgcgcattgctgcgagagtttagtatgacaataataagtaaaaataatgcgtaagatagctaaataatattaacttacttaagttgatgtggtttatcataatttaaatttaaacactaaatagaatgatggttcaaatgtaaaaagtaaggtgacgtggctctctgagagaagaaaagtaatgagatagtttgaactttgaaccatagattaatcgtttaagacgacttgatgagagaagagagaaataacactacgtaaggataaactaaataggtatatatgataatataaaaaataacgatttaacatacttgtattttcaaactataaaatttaataaattataaaattatagataatatagcatgcttacatgatgtttaattaaatgtagtaattgctagtggctgatgattttgcatcttgttagtgtatgatgatacgacatctttgtctgttaagttttagaatttagtgtgttacaactttatactaagataggatatgactatgttggatctttgtcacgccccgaactaatcccgaccggaactagcccgtgacgctccaaattaacctgttgatcgataccagtcccaggaaacagtgctggtatcacagggagacagaatatcacagcaacagcggtctctttattatagagtagagatacagtcatgttgggctatggacagatcccgagctcacaactgcattacaaaagggaaacggaagccaggactaggaccaaccaacacaggcgtgacttgggaactaggccgaaaccctaaaactcatcgtagccggcttgctcctggaagaactcctcatcagcaggatccgttttatcttcttcagtaattggggggtatatttatatagagcaagggtgagtacgggagtactcagcaagccaagggaaataagtgtttaatgcaggcttcaaggaaaggctgttgtttttgcagttgattttatttgaactcttttctaaaaacaactaagtgagtgcttctcaaatgacacggttgagacagtgcgtcacgtccgctcggagtatgtgcaatgtatcagtctttagacttgaattaaggttggcacccggccaacagcttttcaaacggccacccgggccaacaactttcaaacggccacccgggcctagctgatcccatcagctgcagatttttcaaacagcgaacccctttccacaacagcaatttcacaagcagtagtcaaacaaaactacgctaggaatcacctcacatccgcccataaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccaacgagaggggtcccagaccaacaacaggttaggtcccagaccatactgtgccaggaagcccaggggtcctccccg

SEQ ID NO: 40131 - DNA, 1338 bp, Oryza sativa
attaaatcctttttgacaaaagaatagagaagaaaagaaaagagggagggaaattagacttttcctcgggcggctagggcgcggcccgagagagatggggcggtccggccgagctaaatgggccggcctgcccaagacggcccaaggcggcccagggcgcgcgcgcgcgggagggaggagggagagaaccggtggaccgggctcaccacgcgtggtcccgggtgggacccgcttgtcggtgactcggtttaccatgcggagcgagcacgcggcgcacgcgcgcgagcgggggagggacgcggtgcacgcgcgcggttcgcggtggaacggatgcggcgggcccacgcgcagcctcacggctcgtggtggaacgcgcgcacgggtggggctgaccggggtcggcccaggccgatctcggccgagctggggccgacgtggcgcctacgtggctgccacgcgggctggcgggaggtagacgacgacgccggccgtaacggacggcggacgacagcggtgagcggcggagcgaaccatggcgttacaggcgaaagcgagtacaccgggtggttgctcaggatgaggggagacgagccaacggctcggattcgctggagggagtgcgtcgacggcggattgcggcggcggcaaccggcggggagggaagagggaaaaggcgacgaggtcacgaggggccaatccccggcggtgagagcatctacacggctacgggaatccgtccctagcgtcggattgggcggagctacgcctagcgaggctggcgacgagcgggtgctacggagcacgggcggcaacggcggcgagcacatggcgagcggcggcaacggtcggggtggcgccggctagctacggggaggctacacatgctactaccgaaaactaagggggagagatggagcgaggaggaagaacggagggaggcactaccgtgcggacggggcgcagtgacgagaggccgacagcgcgggagtaatctctccggcctcgggccggggaagaggaaggagagggcgcgcccggagtccccttccgcgtccacgaacgcaccggctctcccagtgctgggcgatgaacggcggaggcgagacagagcacggaaggcggcggcaatggcgcggtggcggcgagcgaaacgggagggggaaatcgatgggagggcgccttggcttataggacgacgatgtcggtttggaaaccgaccttgggcggtcaaggcgcgagctggcgctcggcgctcgcggccaaaacggtgacagaggcagatgacgccggcggggaggggaaaaggaaaagagggagagaaaagggggcttgccccct

SEQ ID NO: 40132 - DNA, 8981 bp, Oryza sativa
cgtgcagcggctccatcgaccgccgttgctgaccctcctcaagctcttggacctctcccaacggatagtccaacattggttagaaaaactggattggagattcggaaattttctcagtggattctacatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacattgagctgtagtgcaaggtacccaacagcacaggtttgagatactatgtcaagataaggcaagcaggggtatctaccacaagagagtgaagcaggagtgtgttctcaaagctgacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccacaacgatatggacgagtcggaggctggcagggtgaagcgttgcagcaaatgcgatgaacatgggcacacctacaagcattgtcctaaagacaaggagaaaccaagtgcggcggaggcaggactattaggattagcagcagatggagctcgccctacgggtgaaggcactatcttcactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatgtcacgaccggaaataacccaacgggcgttccttacgtgcgtgtattattccttgtcccaggaggcaaggtacaccaaaagttgatacaattcagagttcacaagcggaagcgtaattaattaatttattacatgggcggcgaaggccccgcacaaaagaagacaaacgaaaaacagcggaagactagggcgacgaccacaggcacttgacggcaggcacgagctagacaccaaagccttcatcttccaggaactccttttctgagtttgggaaaaattgagcaatactgagtacaaccaccgtactcaacaagacacatccacaagtgcagaataaatgcaagggagtacaagggagccataatatagggggttaggatttgcagtaaacagcattaaaagacacttaattgctcaaagctattttgtaaacacggtcctagagctatacaatattattaatcaaggccgtgaacccacacgaacctgccttaacccaaggcctatgatgatccagaccgaactggcaacccgaccctgggtcccagctcgacccaagccaacccaggccaaccattccatattttagttgttaagcaggttttaagaattaaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctagcagcaggacaccggccctgtgccatgacatctcgactaccgggccgcagctcgtgtagcctttatttgtcctagagatgtccatcgacccctgacttcgtccatctccatccgtgtacttttgtttataaccagactgagccacaaactaagccttacccactagacatgtggaagtacggtagtgctttgcaacagaggcccaaagaccggtccttatatggccgaggtgctactatcaaaaccatgcaccccgagcccagcctaaaaccattttgagggttttgaatagagggggaggtgtgaatccaattccacaataatccaaccattccatagtgtccaggtgatatgaatatcccaaagtctagagttgtaaaaccacctaatgttacctaattaagcagcgaagcatctacctaaattcatactagtggtaccatgagtagagtgtccactagttggggttttgtttattctagggtgaacaaggaaataatagcaataacaataataaggtcataacaaaggtaaataggcatggctaggtaaaacagtgataacgcgggaatttaaataaagcgataatgcaataatttaaatcgaaataattttataaacggggattcaatatgttcaaggatgatgtgacttgccttgctcgctttcccaaacgtcggcttcaacctccacgaagagcggttcttccgaacctgcagcgtctacacgaccaatggaaaaataaaagggcttttactctaataaactccatataacaagcaggaaaaaagcacaaagatgggttcttgacttcttaaggaaaaattagagacttgaatggtccaattccgagttcaaatggccaagttatggccatttgaagtttatatgttctttaaatgaaatatttgcgaatttcttcatttaaattttaatttaaaaagggtttattgcgtcagccgagggggagcgggcgcgcggaccgggtccacgggagtggggcccacgcggcagcctcacggtccacggtggaccgggcgcacccgggctcgcaccggccggcgccgtgggccccacgcgtcagccgcacccgagggcgcgggcggctgacggccgggccccacgcggcagccactcggcgcgcccgagggcggccaagccggcgcagccggcgggaggcggcgcccgcgcccctatggtcgccggcggcggccataggcacggcggagcggtggccgagagaggggaagggaaggggaaaagaggcggcggtccacggctcaccctaggtcgtcggcgacgacgagaaaggcggccggagcggaggaaggcggcggcgtggctcggctcgacggggtcgacgacgttccggcggtcggcgagcgaaacggaggggtggacgaggtcggcgaggatgcggcggagccgaaggaggcgacgccgaggtcggaggtggtccggggcgacgaggcggcggaccggagctcggcggcgacggcggagagagagggcgacggcgcgagctcgaatccggcgaggaggatgggcggcgagaggcggaaacagacggaggaggtgcggggagggtttaaatagggttggaaggggagagagcggccggaggggaagaaaaccggcgcgggaggtccggccgccatcaatggcgccggcgagatttgcgggggcaaatccgcccgtttgaacgcgagagagagagggaaaaatggggggaaagggagaggggatcatagggagtaattctccccactttattgcacgcggggacggcgggatgcggcggattcggcggcgcttggcgcgggcgaggcggcgggagcggcgggaggaaggggatgacgggtgggccccacccgtcagcgagggtggcgggcgggcccgcccgtcagcggcgcgcgcgcagggattagccgagtgggccgcggggagaggagagagagggggagggggatgggccgggccggcccaagggagtgaagggggactttttagggtttttctgtttattatttgtgctctgaaaattccactaaaatttatttacgcattttaggcttttaggaaatatacaaaaatcctctaagccttatttgacttttaactttgcacattttaattgttggaggctttcacacggattttaattattctaggcatcatttagaggatatattttagggttgctttgggacgtgacgctacatatatgttaaattgcacgtcatcgttatgtaccattagtaacgtttgctatatttaaatagcctgtactcttgttgtacataattaatctcatgatttgattactatgtcataattttgcaagttatattttgttttacattactattttttgaattgttctaacacgaaacactatatttttcagagatggcacgtcaggatacacctcagttgttggacccggcgatagatcaccgacaccggtctcaccttactgtggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcgactggtggaggctgcggccggcgacgcggacccggccagacgatagactgtggacaggtccctcctagcagctttggtcgatcgatggaggccagagacgcgcacttttcacttgccgtgcggtgaggtagcccctaccctacaggacgctgttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagttggggttccgcgttgttggcggctctgtaccgtgcactttgtgagtcttgcacgaagacggatcccagcgcgacctttggtgggtgccctctctttctttctatctgggcagctgagaggattccgatcggccgccctgaggtggaccagcacgcgtaggaggagtcactgtacgaggagcgaccagaggtcgactaccctacgatgggtactctgtggtgccgtcgtcaggtacgttgcatcgatcttatcgtattgttaagttaattgctaagttcgttgtacatcacatcgatcgtctcgtattgcagcgccgatgggctcacgtccaggttaggcggtcgtatcctgagtttgttatggagttcgaccgccttctgccgactgacgtcgtgtgggagccctatagtgccgcggctacctaggctcgtgcgccgttgggtctgtccacactctgcaccagggaccaggcgtgctggatgactatggttccgatggtcttcgacatctgcgttgagcctcacgcccctttccgcgtgatgcggcagttcggcttccgtcagccctttccagtaccgtttccgaccaccgtcccagctgctgttcaccggtaagatcttgcactacactttccgttgttgcattaaaatctgcctgttcataataatttgtaacatctgtcgtttcacactaatattacacattaattcgcaggtactcgcgcaagggtcagcagtcagctggcgactggcccgccaagttggcaacttttgttgaggactggttgctcgcaaccgaggaggtcgtggaccacgagggagagccacacactgaggagtcatactacgtctacctacgctggtaccagccacgcacccgtactagggtcaccttcgctcccttggagcagcagccccacgttgcgagcactagaatcctctatgccaggcaccgcgaccaggacttcgctcgtgctgtgagtaccctgcatcgcaccattcctttatgttttcatgtctttctcttcgtcaaattttacgaatttttacgaacaaattaaccatgtaggtcgacgacatcaaccgggtcgtcgttgacggttcaacgacgatacaacgtttaggcgcggggattccggtacccgtagaggagcacctgaccacgtacacgcggatggtggagtcgatgcgctcgattctccgagtgctcacctgtcgtgcagacgacgttgctcgggcagacgcagctgtacagcggccacccgtaccgactagtccccgtccagctgcgcacgttcctaggccgactcccccactgcacggaggtaagtatttttattactatttatgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttagaagggtcccgttgtcgatgtgtaggttttgcccagttcgctatgacgcaggccgcccacttctcccaggctgcagggtcagcgtctcaggcagctgtgtcgacctcgcactcagcgcagttctggcagtacactgggacttcgtcacaagcagccggcacgtcgagtcagggtccaccactggaccatgctgggacctcgtcggaccgcttgctgccttccaccttgctcttcgacatcactgacttcgacttcgcttcaggctcgacagaggacgtctttggcccctcacagctgggaggcgcaccgccgttgcagacacaggaccagacgcaggccactcctccgcgggacactcatgctacccgtgctgtgccaccggatcgtttcacctactcccaggaccacgtgcgagcacaggcccggaggaccaagcgtggtcgcagcgcggggcagggccagtagagcagtcttctgtttgtttacttgcttcactttccagtactgtatgcttgtgtaatgactacgttgttgttatatgtgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcgcatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggtgtagcgatccttgtgtatacctactaccaccttggtgccagcgtcctctctgcctatgcggtgatcgatgccaactaatggcttcgaggaatcctgatattcgaggaaggcgcttttttaggtgccctatctatgaccgtgaggtattttattatctgcatatgcttattcattccgtatgggcaatcgctttattcttcgtaacactactctattcggcagacccgcactacggcttgcgcatacattgagtgggtcaatatagaaaatcccattctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaaggattctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcaggttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcaactgggtcccttgc

SEQ ID NO: 40133 - DNA, 719 bp, Oryza sativa
cctgcacccctcgacggcggtttgcggcggcagcaaccggcggggagggaagagggaaaaggcgacgaggtcacgaggggccaatccccggcggtgagagcatctacgcggctacgggaatccgtccctagcgtcggattgggcggcgctacgccgagcgaggccggcgacgagcgggtgctatggagcacgggcggcgacggcggcgagcacatggcgagcggcggcaacggtcggggcggcgccgactagctacggggaggctacacatgctactaccgaaaactaagggggagagatggagcgaggaggaagaacggagggaggcactaccgtgcggacggggcgcagtgacgagaggccgacggcgcgggagtaatctctccggcctcgggccggggaagaggaaggagagggcgcgcccggagtccccttccgcgtccacgaacgcaccggttctcccggtgcttggtgatgaacggcggaggcgagacagagcacggaaggcggcggcaatggcgcggtggcggcgagcgaaacgggagggggaaatcgatgggagggcgccttggtttataggacgacgatgtcggtttggaaaccgaccttgggcggtcaaggcgcgagctggcgctcggcgctcgcggccaaaacggtgacagaggcggatgacgccggcggggaggggaaaaggaaaagacggagagaaaagggggctt

SEQ ID NO: 40134 - DNA, 706 bp, Oryza sativa
ttcgcccgccgaccgccggagctccgtcgccctcgtgatcccgaaccgcgccgccgtcttcctgcgcttcggtcgccgttgccgtcgccgccgtcgacccggggtgagccgaaggccgtcgcttcgcttccctcttctctcctctctctcgggcgccgctccgccgcgccgggtcgccggcggtgaccatcggggcgcgggtgcgccgcctcccgtcggccgtgccggcgaggccgccttcgggcgcgccccgcggctgccaggtggggcccggccgtcagccgcccgcgcccgcgggtgcggctgacgcgtgggacccacggcgccgaccgccgccaaccgcgtgctcccggtccaccgtggaccgagaggctgacgcgtgggccccgctcccgtggacccggtccgcgcgccctctctctcggctgacgcaataaatgagatttttaattaaaatttaaatgaagaaattcgcaaatatgcatttaaagagcatataaacttcaaatggccatatcttggccatttgaactcggaattggaccgttcaagtctctaatttttccttatgaagtcaagaacccatttttgtgctttatttctgctgttatatggagttatttagtgtttaagccttttactttccgttggtcgtgtagacgctgcagcttcggaagatccgctcttcgtggaagttgaagccgtc

SEQ ID NO: 40135 - DNA, 1298 bp, Oryza sativa
ggggatgaccccgacaggtggggcccacctgtcggtggctcgggggaaaggagagaggaggagacggttggggggggacgatgacaggtggggcctcgggtcccacctgtcggagagagagggagggagaggccggctggggaggcaaagtagacttcggggaggagagaaccgagcggcgagctgggccgagggagagagagagcccgagagggggagggggaggaatttgggccgagcccgaaagcaaggaaggggaaaattattttcttttctttttattctaattggttaaatgaactttgtgctattaaatttacttcttgagctccgaaaattcacgggaaaatccggagagtattttagggcacaaagaatattgcaaaatattcccggccaatgatttttaagggaaaattttaattctcccattatttcacttgattaaattgattaactttttattcaatttctaggaaatgcatcattaaatgatttttattcccgaacgaaaatcggggcgttacaacctttaagctgatcaaacaaatcatcaattctgggcagcggatacttattcttgatagtcacatcatttagtgcacgatagtccacacacatcctctgggtatgatctttcttttccacaaaaataaccggagctccccatggagatgaactcggtctgatgtatcctttctgaagcaaatcgtctacttgcctcttgacttctgccaactcattggctgccattctataaggtctcttatggatcggagttgttcctggtaccaaatctattctgaactctatatcccttttaggcggcataccaggtaaatcgtctgggaacacatcaggatactcccgaactataggaatctcttccaaagttatttggttcagtcttgaccttaaagactcagaagacaatgcatgaacagttacaactcgaccaccattactggtgagagttacttttctgttagcacagtctatcacacctttatgtctggctaaccagtccatccctaggatgacatcaaggtctttggattctaacaggataagattggccagaaacggtactcctttaatttctattctgacagaggggctacgttgcaaagagagtgcttgattacttggggtactaaccatcataggacgtctaagatcttctacttccatcccatgatttcccgcaaaactcatagataagaatgaatgtgtagcaccagaatcgaaaagcactgttgcaggaactgagttaacaagaaacgtacccataatcacat

SEQ ID NO: 40136 - DNA, 2311 bp, Oryza sativa
ataaaaccttttcaactttgcttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattatttcttttagagaatgatttttatttcgggatgaatttatcaggacgtgacagtcaccaccgtcctcgtccgccccttcgccgtcgttgttgtccgccggagcaccgtcgccgtcgtcaagccgaagagcgccgccgcttcttcctcatcgccgtcgtcgtccgttgttcttccgccgccgttttggtcaccggtgagttcgccgcgtcgtcctctacgtgctggtgccctccgttcgtgctgaagcaccaccgttcgccgtcgagcgtgtgagcccgagccgccgccggtaggtgacgtcatcgccgacgtcatcggggccgttcgctgtgagccggtcgtgcaccaatcgatctcggccgtccgttttggatggattgatctcggccgtccgttcttgtgaaccgccgccgtgcgcccggtccaccgcaaaccctagccgctgacgcaataaatctccttttccttttcaaaaataattcattgttgcgtcataattcaattaaaatccatataagtgttttaatccgatttaatcttcaaaaattcataactaattcatcttagctcggatttagttggttcaagtctctaaatttttctaaaattgagatctacatgttaaaaatatccatactgttcatgtttgtttatgtgctgttttggtgtttttgctcttttctgtttagactccgacgtttccggagagtccgttttcgcaggagaagaatttgaagagttccaaggccagcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataattggactaattgagctttatatatattggttcagctagatattagatataattgcttagtcatgcttagaaacattagcacactattgggataacttatgactcactattatttaatgatggcttaatgatagttcacgatggtcaatcgtgattggttaattaattacttgccaactaaaacttgataatggtgggttgtgggcacatggttttgagagttgtgctcatgacaattaagtaccggttcacgagtttcggttgtgaaacattaatcgtgccaaccacaagccagcgtgggcaacggctttaccttttgtatagcatggtttattgcgggacaccagactgagaagtgacggagataagcccacgggggtcgctggggagtccatgccttgtttataagggggtgattatgatccaggaatggtgcgctgtggtggattgtgttatgcaaggggtattgtcatagctcctttccgaggtaccgtggtggtattgcgacacatggtgacatgatgtggggctgtgtcttgtgggtacagtggtacacctctaatcagagtaaaactattcgaatagccgtgcccgcggttatgggcgagtcgaacaatgtttttcgtgattagtctcacacctctcatcataattatggatgctataactggtaataatttgcttagctcctggtttggaatggataattcctggtttggagattagatctgtacagccgggtatggttgttcaggatggtcgggcttgtgcagcatgggtgtgctgttcagtgttgattaaaatttctgattaactactctactgttttatttcacttaaatatttggctaaacgttgcttttgcaaatgagcctatattatgccattctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttaatgcctcttaagtaagtatttatcgttttagtaaatttgatgaatctgtatattaaattgtcaatttgtgtacctcgactgattggggtgc

SEQ ID NO: 40137 - DNA, 8985 bp, Oryza sativa
  unsure (1)..(8985): unsure at all n locations
caaggcaatgataaaccaaggaagcaaattgaattgataaaaaatcacactccgttattatgatgatagcccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaaggcacgggatcgaacattgcgattatgataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcgacttcactcggcaacattgcttctgccccatagacaaggaaaaaaggtgactggcctgtggcccgactgggtgtagtacgcaaagaccaaagtactgatggtagctgttccacccatttgccggcatagggttttagccggtcaaaaactcgcgctttaatcccttgaagtattatgccattggctcgctccacctgtccattgctcatgggatgtgccactgaggcatagcaaatcttaattccaaagtcttcacaaaagtctttaaaaactccgccagtgaattgtctgccattatcagtgatgatccgattgggcactccaaatctatgcacaatgttgatgaagaagtctcgagcgttatctgctgtgattgtgacaaccggtttagcttcaatccacttggagaatttgtcaatggccacaaagaggtgcgtgtaaccgccgactgccttcttaaacgggccaaccatgtcaagcccccaaaccgcaaacggccaagacagtgggatggtctgcaactcttgagctggtagatgaatctgtctggcaaaaaactggcaacctttgcacgtgcgcacaattttgttcgcgtccgacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaaaggcttttcttgtacagctcagcttcatgcataatataaagtttgcttcgtcttgaaatccgctcggcttcatctttgtcttgggggagttcttgagaagtcaagaatcgtatgaggggctctcgccagtcgacttcaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactccttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagttggggaaattagaaccactcctgctccagtgcccgaaagtctttttgatccgtcgaaatgcatggtccagtgctccatcttctccgcaggggtatcctcctggcactcggtccattcggcgacaaaatcagctaacgcttgggacttgattgaaattcggggcttgaatgatatgtccaaagacatcaactccaaagcccacttagcaatccgtccgtttgcttcgcggttgtgcagtatatcaccgagtggaaatgatgtgaccaccgttaccgagtgaccttgaaagtagtgagatagcttcctggtagtaattagaacaccatataatagcttctgaacctgagggtacctcgttttggagtcggctaggacctcgctgacaaagtaaatcggtcactggactttctggacatggccttcttcctcacgctcaacgaccaagactgtgctcacaacctgggaggtggctgatacatacagcaacaacggctcctgcgggtgtgatgaggctaagaccggtggctcggtgaggagtttcttaaaatcttcgaaggccttctgtgcttcgggtccccattggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatacccctatgagacaccataaaaccaagcagcttccctgacggtactccgaaggtgcacttttcagggtttaatttcatgctgaaagcgcggatgctcgcgaaggtttcttctagatccgagattaaatcatccttttgtttggtcttgacgactacatcatccacataggcttcaacgttgcggccgatctgcgttgagaagcatctctggatcatacgttgataagttactcctgcgttttttagtccgaacggcatggtgacatagcagtatgctccaaagggcgtgatgaatgaggtcttcaagcagtcggatctgatgataccccgagtagcaatccaaaaaactgagaagctcacagccggcggtcgagtcgattacctggtcaatgcgaggcaacccaaaaggatctttagggcaagacttgttgaggtcaatataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgcaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttattagtcttggcttcgctttctccactttttgaagtcttggtagcgggcacttctccttcgcttgccgtggctgcagccagtcggatatcctcccgggcagacgccgtctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcccggaattactccgtgaaaaggcgcattgcttggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagctagggggccgccgaagatatggttgagctctttgcggtggtcttgaaatcctaccggggtgtcgccgtcgtccttcttcctcgacgtgctttgttcatcgtcggagttcttccgtgtagtcttggtgtattgctccgcgaattgcttgtagacgaaacaatctttggccacgtggttggagttaggatggtgcgggcattgggaattcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatacggtgacggcgtcttcggctttggcgtactcgttggctttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtgccttgtaagttggcgatgaagtggtcgcgtaattcggcccaagatccaatcgtaccacggagcaatccatggagccaagatcgggtggaatccgctaaagttactggtaaatagttcgccatggccttgctatctcctcctgctgcgcggatcgcgagaccgtagacggtaagccatgattctgggttggtggtgccgtcgtacttctctattccagtcggcttgaagccggctggccaatccactcgacgcaggtcgtcggtgaaggctgctactccatcaaggtcgtcgtcgtggcggtccgacgaatgatgatggcctcgagctgctcggcgctgtatgattgtgtcgcgaagatcgacggggcggcgacgaggtggtgagcgaggccgttccactcggcgctccctatgatggtcgggaggcgagtgaacggaccgctcgtcgtgacccctgctcctgcgattggatcctgcgccagtgatgctgaggcttggataacggtagtcatgagatcggaagtgggggagtcggctgccagtcggcgtgcggacgctttcggagttaactgggaccgaagccgcaatcatggtctttgtctggttcaagttgttgacgacgtgatcagattgattgagctcgttttccttgaggagggtgtcgaggagggtgatcgcggcaaccgcgttctgttgaggggtgcggaaaatcggtgtcccttcaacatcttgttggccgatgaaatcacgtgctcggcggcctgcttccaaggctcgctgccgtcggtcctcagcctccttcgcggttcgctcacgctcctgctgctcacgccgtagccgttcttgttcttgtgcttgacgctcctcctccagtcggcgacgctcagtctcgcgacgtgcttcggtttcccgggcttggcgttgctcctccgtctcgttatcggccatgaagacgccgaagtagagaggggtgtggttgtcatctaggcttccgtcgaagtcgtcgagatccgcgtcgttgtagcgagaactaaactcgtcgtactctacgatgtcggtgggacgcgagtcgacggtgggagagctgtagtagccatccagctgatccgtcgaaaccgtgccgagtggttggaggataacgccgacttccctgaagctaggcgaaatcggtgttgaagccgacttccgtctaggcctacgggatggagacgctgtcgtgatggagacggccgccaaatcgtcggggagcttcatcaggatcggtgggtaagcctcatcatcttgatctggtgacattggagaagatgcgatcccgcccgagtggtttgaagccaactcgattgagacggtcttgaagtaactttcagccgcgtttgggagtccaaacgggactgaaatccggttctctcccgactggtctgactccgagtcaaggagagagatcttgccgaagttgttggtgacgaagtcgaggctgccgaaccgaaacgtctgcccgggtgggaagacgaggtcgtcgatgccggagacagaacccattgcactgatcggcgaaaagcttgacggacccctacctggcgcgccaactgtcgaaactagatttcggcaataataaaagggggtggctatcaagctggagaagtgaatgggtttggagacaaaggatttatacaggttcaggccttcttattcaagaagtaataccctactcctgtccggggatgaatccgccgagtatcttattgattgtatgatttggggataatcaacacatgcccctagaggcacccggaccccccttatatatgggaaagagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagataccttttccttttttgcgtacatcgatcaaatctacgctagcttctgctgctgtacccgtaggtatatacccgtaaaatctgtattacgtattatagtacggtttatgtacacatgaatgaccaggtggtggtgatagaaagaaaaaaagagtagaaattttatcgggtggcgaatacaacggggagagatgggagggggtgtacataccagcggcgccgcggcggcgtgagtgcgctcgcgatcgcggcgtggcgagtggcgatagatatcgcgcgcggccgaagcggtgtgccgctccaacggcatggataagaggaagggatactgggatagcgtgtgaccgtaacgtatgtacgtctgtggcatggccaactttttttcaggtttcattccgttccgtggtctcgttctgtatacttcctggtttgtgggtgattactgtggcccaaagagattagtgactaataaactgatgaagcaatcagtagtccaaattaccaatttaggccctgtttagttcacaccaaacttctccccaactctcaactttccatcgcatcagatcacatccaaaactttcctacacacataaactttcaaaaaaaatttcaaactactaagaccttattcgttttgaaggattcctaaaggaaatctcaattcctttggaataagcactattcatgcattcggtttgtaaaattcaaagaaaaatttttcataggaacactatgccaatccttcaaaatgtactaattccataggaatgaaaatatccaatctatccacttttgtttagctcggtggaggaaaaattcatgtgttccaatcttttgttttgcatgtgcattcctacattattcctacgtttttcctattcctgtgatttgaaaatcctgtgaaccgaataagctcttgactttccccaaacttttttccaattctaggaaagccttaatagagagagtaactatttttcacaatccgaagaaagctatagggacaaatttctgtccggatcgaagttttcatttcagcaaacgcgtgaatccaaccaaaacagacacgctggttcccttgttttgctgaccctccctatctagctcatctatcaaatcaaatgccctttcgctgtaggagtactgcacacctgaaactgcacccaaagaaccatgatctcctcctgcttgtacttgagctccaggaggaactgctgaccgcaaacttctcaacttgtgtaccggcagcagtagcagatcgacgattctctgggattctgagcactagctactttcgacaagtaatccatatgttgccaaacactcacgtgcccctatggcaagaaagcgatatatgagtatacggttaacaacaagtgtaatactcactagcgccaaatatctagagacggagcgcggagatatttaaagctaaaaaaaaaagagagattgtatttttatctacgtactcgtagtattatggtatatgttctcatatagtcatcgtaaaaaaagaaaaagaaaaaaatgtactagactattactagtcgtttgcccactgctcattataagacgcagcacttattagaaaaaaaacaatttgtatgcaaaactttaatatatgcgttttactgaattaaaagcctacagtgaaaaataaactataataagaaacataaaatataattttaaaactgaactttcgatttttttttttgttgcgtctgctaagcgcgaaagattatggggctgacaaactctctcttaagcaacggaaccacctctaatcgggcggcctggcggctccatttgcccatgttgctattatgatattatattggccatacgtgtgaaaaattattgatctgcctagcaaatgctcttcgtcgtccgggcttaacaatatcagcggatctgctatattgactctctttaatcatatttaatgtttagaaaaaatgatttagtcaaatcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40138 - DNA, 2830 bp, Oryza sativa
  unsure (1)..(2830): unsure at all n locations
caggcccagaaccggaatctgctgctaattctgaacttccgcgcaacctgatattcaactgcattgccacgcttcttgcaatcaaggtaaaacattcacctgcttcactagcactaatcctccatggttactagaattattccaattcagtacatcttccttttcaattatgcagcattttagcgagggccgacatccacctcctaacatagcaggcgtcctggagcgtgcttgcttaatgctgcgaccaagctgtgcagagaacctgcccatctataacgaaatagagaattttatcgctgtcataaagaaccagatactagctcttgtgccatcggcatcaagcaatgccaggctacccatgtacatgtaaatacttccaggcttccagcagacgaagaggcggtgcctggttgcttgatgtcgagaagaattgatgaatccatagcgtctgggggaggtttgaaaatgtatgagcttggatctacagcatcagaagacggcgggtcatcgttgactgccagctctcttctaaactgtgtataaactctttagaggaataagctcttacagtttttagtttcatagatttctcaatatggttttaggaatggaggaatcgacattccagttgtagttaataataacgattcctacagtcatgaatacattgtccagttgattcacagagaacaccatcttgatagttaatagattttacttaaatgaaaaaaccatgtgtcacagaaggaaaccatgtgtcacagagaagaacaccatcttgataaacggggtcaaataagcccctagattttactatatgtaaataatgtgcagtgagtcctgggcatgcttacaaaatggctttgacaggtgagatgaaatggaccctattcctgcctccaaacaaaaaaaggtaagacaaaccatgaactctgttttttttttctgtaaaaatttcctgtgtctgcctacaataatatttactatccaaaaatccctgtagtatccgtatgtatcaatgctgtgatttcctgttcctcttgtactgtatatgtatagaaatgtacatgaatgtttgttagtacagactacagctttgagtcagcttgcagagctacaaccactgatcatcatcatcttcttgcttggtcttgttcttcttctttcaggacggtgaagtggaactcgatctgcagccggcggtgcggcgcgtcggcgcagcccttcctctccatctccagctcctccctcagcgggatggccgccaagaacctcttgatgaactccctgcagcactccttcccggtgacgatcacctcctcctccggcgacggcgacgacggcggcggcgacaccgagcgcatctccgacgtggcgtcgaaccggagcatgtacgccttgtcgcagccctcgaagagcctctcgccgagcgtgtccacgacgtggtagcagtcgccttccaccttgagcacgaagaagtggtcgttccagctcacgatgtacacgtcggcgcgccccggctcgccgccggcggcggcggcgatctctcgccagatgtcgtcgaacgacatggcgccggagagggaggcgaagctctcgggctggaagaagccgacgaaggccctgtcgtgctgcacggcgatgggcctcgccctcgccgcgagcaccgtctccaggtcgaagtgcctgttcgggaacgccgccatgtgcgcctcgtcgtcgcagagccgcctccactccgacgagccgtccctgatgagcgcgtccagctccggccgcgtcggcatcgtcgggtggttggcgtgcagcgccgccgccagcacggccaccagcgccgtgcacgcgctctccccgccggcgctgtcgtcgcgctggtcgatggacgcgaagaacaccggcgtcctcagcttcgtctccgagtccctgctcgtgaactcccgagtctcccagcttcccgccagatcatcatcctgtaagacacagatcaccatctcgatcaatcaccaattcaccattgccaatgcaaacatgattccatgatcagaaaaaaaatgctaatccaattctcaccatgtatttcatgggcaattcttgggagagcgactcgctgctcctcttgtcgaagtcccggctcttcctcctccacggtagaagccggcgtttcgacgacaggccgggctccgggctggcgccgccgctcgagctggcgctgctgatgctgatggtgctgctgctgctgacactgctcatgctgctgacgctgctgctgtccgaattcctcttgctcctgctgtacacagccaccttgtgctccctgtcagccagatcaagcagctgcttcaggtcaaggacctcatggtacgtccctgcctccaagctcttcctattgtcccgcattgtcggtgccggagtcgtcgtcctcgccctgctctccctgaatgaaacagtccttccgatgttctcagaaggcgtgttcgcgtccacaagctccacattcacctgaaatcaatcatcacccatacaactcattaaaaaaatgcacaccaaacattttcactagaaatatagtaattgggaggcaaataaaatggagaagatatttgcttacataaagcatggcatcacttgcccatccatctttcctcaccctgatggggacaaccaccagctgctgctgagttgccccccttttctgctgctgctgcagttgcatctcccagcagcattcctccaggcttatcatggctgtcccaatctcnnnnnnnnnnnnnnnnnnnnnnnnnnnnnnnnnnnnnnnnnnnnnnnnnnnnnnnnnnnnnnnnnnnnn

SEQ ID NO: 40139 - DNA, 7099 bp, Oryza sativa
cccttatatgccactagaatttgaccagttcccttatatgccacttaaaattggcttctctcttatatgccactagttcaatttttttcacacttttatgccactcccaccactatagttttagttgactgttagtcaaatgttagttttttttcttaaatgaccaatataccctctcaactaaaaaatgtgtaaacttcaaaaaatcataactatttattttaaatcctttttgagtaaacaaaattttgttagaactagtgaaaaatgctatttatattaaaaatattattggaaaactgcatatttcatgcttatattgaaaatttatttgtgatggtaatggctaaaattgcatgtgatgcagaaaaaatcaattttcatatgttgtatcaagaagctatattagtactaaaatacatattattggttgtatactaattctcaagggcaaatgtgtccttttacaataaagttaacggtcaactggcggtggattgacgggaatggcataaaagggaggagaaacttgaatcggtggcataaaagggagaagccaagttgaagtggcatatacgggagctggttaatttggagtggcatataagggattctctcaaacgtaaaatcagatgcatgtcgatggcatttcttggattttctattatgcatgactcttgttcttcgtatcctcttgtattagactagcacactagcataaagccgtcagagttgagttcctaagcataaaccatttgggatgaccacaattctcaccataggttccgttgttttgagctaatggacgagaaacgcccaggggtcttccggctagctccacaaggtggtggactagacgatctaggttcgaagcctcaccccttttaattatttgatattaggtctttccctaatattcgcgtttttgttttgagctaatggacgtaaaaactatatacattactatttcttagacaaccatttctaatttatttgttaactttatactccctcattccctaaatgtttgacgccgttgacttttttaaacatgtttgaccgttcgtcgtcttattcaaaaacttttgtgaaatatgtaaaactatatatatacataaaagtatatttaacaatgaatcaaatgataggaaaagaattaataattacttaaattttttgaataagacaaacggtcaaacatatttaaaaagtcaacgacattaaacatttagagatggaaggagtaatatattttatcagctagacagcttattcgaatagaccttaagcaaaaccttttttgacgtgactacttttgtggaaaagttagacaaaaacttcagaccattgaaatgttttgcatccccatcatcttagcttttggatgcacaaccagtaacctaaattctagagacagaggttgacaactgtattgttattggagatgtgagcccgtgattaagacagtacaaaaatcctctccggccgccgcaaaaagcccctgaaacttgcagattctccagtcaataatgtcttgctgcacatcggccgggtcagatcgatcgatcgaaaagtctctcagcaaattctccaagaacatatgctcgatcgaagtgtcgaacacctgtgcgctcgatcgaattattattccttcacacgcggagaagacgaagcaatggaggagtacaacgtcgtggaatcgatcgatcgatcgacggcgacctgacctgtcctgcgcatcgatcgatcgatcgctgcacgcggctcgcgatcagccaagtggacttacgccgtcagttcgtctccaatgccaaattgccaatcaaaatgcagttggatcgatcgatcagttcgtaactcaaagcattccagttaatggggcataataagccaaccaatcatcaatcaatcaatcatgcatatgccgtgctgacgctttacacgaccgtgcataatcgatgattagtgtacggttaagtactcaagggagcagccatctctacttaattggttaattatagttagcagcagctgaagctgcgctgtactgaagtttcccttgccgatgtttctcccaacaagatctcccaatgcgatcagacacaggtaattaagctagccatgcacgcatgggtagatgtgtgatacgcaatgcaacaaattaaactcgagatctgctgctactgatcggtgaggtttgcagtggttggggaggaacagcaaatatcaggccaacctggcaattcatattcaggcaaattggcgagacgagacaggggaatatatttgccgggttcctgcgttgcctgggtgtgcctacgtgtaactaacgtgttggtgctagtgtggttgctgcttgctgctgactggtcgggcgagagatctcttttggttcccgtgctattcttgtcgcgccatggtaggctggcatgggaaattctgtcgtctcgctgctgcaagctaggccgtgtcagcagaggttgagccggaacagatccaaacatactggagaaacacaagtggtgtggtgtggtggtggagttatggtgcatatgacttcacccatcaaagtttaaatcatggtgtccacagatattacgtgcatataatatgtacgtgtgcgtctgtactctatcgtataattttgtttaaaaaaattcaaacatactccccgtccaaaataaaaaggcttatctcttaaaaaaaattagtaagaaagaaagaaagtgtccagtattaataagaaattaagtagagtatcgatgggtactaagtagataacatatactcctattaaatagacaaaacttatccatttatatgtttcttctatccaaaagtattaggcatatttttagtttttagtttttctaaaagagatgattatatttatagactatagtttctatatgctagatcataacctaaggaatcatctggcaatattcatttgttgtatgcatgtataaagttctttgattttgttacatgaggttgagttaattcctccttgattttggtgacaaagaatatatgtcttgcatttttgtcgggagtactaattatgattaagagtgtaatcaacctgttttgagataaattttgaactctaaaaattaatttattttacgaaaaagagagtagagcggaactaccatattcattaggctaaactccaaaatttacatataatttcctactagcaattgacatcggaagtgaagtgttaagtgggtttattcggttgaatacggaatacccatgttttagaaaatagctctctatttaaacttaaaactagcgagatatatcttattttcatcactgatatattatagtataaagtttgaatagccaccatcaaaatctaccacacgcctctagccaagccgccaaggtaaggatggactcaacattcaggggttcataaatacagccacgcaagtcaccggagatgggaggggagatgccatggcagaaacattgttgggtaataggtgctcaaatttgtccctttttagtgtgtagatcaagtttgaacttgagtttttgtggagtgaagaatatcactctgcattgtcaaatttatttttgaaaattttcacagccattcattcatatttaatttaagaaaaaagaggtatatgagggacatgcactcaagtgactaaaatccattttatatccaatagtaaaattcattgacatggtcatactgatttaatatgatcattgccaggacactcggatttgacgttgtacatacatgatgcgcttccaaaattaagttacatcgaaatgatgatctcaaccaaataatttttcttatcctaacatgggtggttccttatagaagtgctatttattcgacgagggtgaccgattaacgtagggttgggttgacatttatatttggggctttattttccattcaaccatggacctttctggaaaggattcagaattgattgtagttttgataattacagttcaaccatacggtatataaatgaaaagaagtcaaagcaaaactgaaccacaaaagtcaatcaactaaaaaaatgtccagagtgatatgcagttaggatatcacttgaacaaccagatggggagcatggcaagtttgttttttctttttcgagggaatggcagtttgttgctgcaaaatatttttcaatttagaaatactgaacccctgttggatcctagtccttactgttactgtaacagtaatattttagagttttaaatttttttaaagcaataataaaagtaccaagtgtactcatgcgtagggaaaaaaatcacagcaagaaaaagtatccattattaacaaaggagttatgtaatttttttgtaggaattttacatgaattccctaggagctgagagacgatttgatctcatgatcatctaactggagcataaggagagaattaaccttgaatgagctagaccagtcttatctgtattaatttgtcgtctctccaacatgtgagagagacaaatttggttacaaaactaatggtacaatagataaatgaaacaagtgtatgtcaccacttaatccccataatataactacctttgcaactgataaatatgttttttttaataatttaccaaaaaaattacttatacttcctttaatcaattaactaactaattaaccaaattaactaaaaattattgctgttcttgctgctggcagctagcttgttgctttgttccattccacgtgtccatgaagcggcttatcctgtggagtgcaagatccagcgtgtccaagctcatgttggcgaagcacaccctgaaccagccggcctccgagcaatggcacgacgaccccggcgagatgttcagcttcgcctggcgcagcagcttctcccacagcctcagctcgccgccgacgccgccgccgccgagcagcagccgccgcatgtccatccacacgaacagcccagcattgccgcgcaggcacggcacgccggcgcgcgccagcccggccaccacgtgctcgtgccgctcccggagccggcggcggttggtgcggatgtactccccggcgaacgcctcgtcggacagcatcgccgccagcgtcttctgcgtctgcgacgacaccagcgtgaagctcgacatccgccgcgccgccgtcacgacggcgtcgttgtaggagtagaccacgccgacgcggaaccccgggaggcccaggtccttggagaggctgtagacgatgtggacgcggccggcgatgccgtcgccgccgcgcgcctcgacgagctccgccacgctgacgaggtccggcgcggcgaagacggagccggagtagatctcgtcggagatgaggtggatgtcgttgcgcgacacgaagtcgaggatgtcgtcgagcatcttgcgcctgaccgtggtgccgagcgggttggaggggttggtgatcaggacggcgcgggcgcgcatccccaccgcggcggcctcgtcgtacgccgcctggagcgcggcgaccgtgacctggaacccgttcgcgctgtcgcaccgcaccggcacgatgttcacccccgtcctccacctcaagtccctgtcaaacctgcacgccatggatgtcagctcagcctgccactctgctcgatcgatcccaagctagctagatgcatggcaatggcaatggcaatggaacagtggcttacccggggtagtaaggggtagggatgagcagggcgtcgccggggttggcgaggatgaaggtgaggagctcgttggcggcggtggcgccggcggtgagcacgatgtggtcggggtcaaacctcgccttgccgccgcgtatcttccccatgaagctcgccatcgcctgcaagcaacaatggtggccaagcaagccgccgccatctcgatcagtccaccatgcatggcgttcgagccaagcaaagcaagaattgcaaactctctctctctctctctctctctctcacgtaccttcctgaagctcttgaggccatggtaatcctggaacagcgcgttgtccctgaagctaccggcgccggcgccgccggtgctccagccggcggcctccgggtggtcacggaggtaggcctcgaggaggtcgaaggagacctggttctcggcgaggcccatctgtatgacgccgtcggggttatcgacggcgtggtaggggtcctcgtcgtaggccttccacccggcgaagtacggcgagtcctcgccgtgcgccgccgacgttgccacctgcgacagcggcggcgccgacccggcgaacgccgcagcaggcaacagcttgccacccatgatgttctctctcgttctctcagactgaattaatcttgcagtgcaaaatttatatgcaatggcagtgtaggaagcaacactgcagtacaagaggcaatcaagcaaattaaggtttttgggtgtgtgagatgagatgatccaaggttccaagtgtgggaggggtatatataggcaaatggaagtatatatacctatgtgaaaaccactcatgatcatgtgattgagatgtcagaggctgctcatagctgtatgcatataggagggttcactgttgagagatgaccggacttttttagctttcagaggattaaagaattggagctcgagcttgaccaacctatactaactactaagcttgatgattctttttgcccaatgattgattgctcactctctctctctttctccctgactgacctttcagtaaaggaggaagttagcaatacagacagtgtagcgtagtacagctgtaatcagaaattcagatcgtcgtctgcaaattaagacagcttccgttgtcgccattctccggctgatcgaagaaattcaacagatgcagcagcagcagcagctcaagccgtcaagcccgtgcgatcgtgtctacaggtgttacgccttatcttctcctttaacccaaccctttgtttaatccaggctaatgcccacgtcgtcatcgtcctcttcatcgtcttaacaaaaccagctaagaaaaaaatttatgactatagctctgttaccatattaagttttaatttatcgtctgcaggtttgatggttatgaatgtcactcggagtaaaggta

SEQ ID NO: 40140 - DNA, 5844 bp, Oryza sativa
agccaaaacgttttataacctgaagcggagggagtattaaacgtagactaataaaaaaacaaattacattccgcatgtaaactgcgagacaaatttattaagcctaattaatccatcattagtaaatatttactgtagcaccatattgtcaaatcatggaacaattaggtttaaaatattcgtctcgcaatttacacgcaaactgtgtaattattatttttttaatatttaatactccgtacatgtgttcaaacattcgatgtgatagggtgaaaagtttttatttgggaactaaatagggcctaggataaactctgatcggtagttttctggcatttatcaccatatgctacaagcacgtttgctaatacgtagtagtactacacacaaagtaaatactatatgttagtactttatgtgtgttatccgatgggcgatgcaaacattattattctcgaagaaggatattacctcacttttttttttcttacctcatgcatgaatcaaagagccaatgtaaggttgcataatctgacagatttccttaagaacatccgttgaaagaaaaatagtaattctggacatttaaaccttggtcggtagctttctggtatttatcatcatgctacaagcacgtttttattatgtagtattgcaagcaaagtaaattctatgctagcacgtaaatatatgttatccaatgggcagagtaaacagaatagtaagagttttttttgcggtcctaagagaaggatagtatctcacggtatctcttcatggctataaaatctaaaaaaacatcgtacaatattgtacagtaatacgaagaataaagaaaagtggtagtactatctacaaaatatatattcttcgtatttggtgggtagcagcctagcagggacgctgtgagatccattcaaaatttaatctaacaaaattgagcaactgaatccatacgtacataccaaactggtgcaagaaaaggcaaaagaataataataataaaatggatttgcgcactagccagtgatttgcctgtccttctcagtgtccactgcaaactgaataagtgaatatggtgatctcatctttcaccttctcctccccataaaacaaacacaaaccaaaccaaaaaccaactctttttgaatctcctttgtgtcaacataaagaagccaatcaaggtgatggctagagggagcatgtagcagccgttccttttattatttgcaagactagattagtccagtaaaagcttcacttcctaatagccttataaaaatgatacatggtggaagatggcattgtgtttttgccaaggggacacacacatacaccactagcaaaagcttctccttttaggcacaaataattcagtaatctctaagataattccttttcttcttcttctctctctctttaagttcaagtgaccctgattgtccccaaaaaaggcgtcctcggcgacgaactgggctgatcgttctgacggacagtcgagatcttgagctccagatcaggtggctggagttgcagttgcacctgaggctttgccaccatcagagaaggatggattgttcttggttgttcgctgctgctgctgctcactgctggtgatgaacagcttggcgtcagggttaaggatggaggaggcagcagcatggcttctggctgtgccatgctgctgatacccagtgacagtgcagggaatcccatttcagcaggcacagaggctgtctcgtgtctcagtttcagacgttcattcacactcggagccttttctgcatcctcaatctgaaagaaaagaaaaaaaacatcaaattttcagacatgttaggttactgtaactcactcatataaatacatgattcttgctgtctgaaactgtctgtgtagatattgttgcaaagatgtttgaagtttaccacgtcaaagaggctggatcttctcttcttctgcgtgaggctgctctgcctgaggaaatacttctgggcatggctggccacctgcgtcggtgttcttgtcgtgacgaagtgccgggaaatgccgcgccagtcgcctttcccgagcttctcgagccctaccaggaatttcctgtgctcctcttcagtccatggaacacctgatgacagttaactgatgagtttgacatgttcagaatttcaggtgtagaaaacacagcaatttagaggatttttttttatctgttgatatctgcaaaaacaatctagtgtttggagttcaagaatctagatgcaaatgattaggacgagacaactaggataaatcaggtctttgtttgtgataaggatgagagtttcaggttgcaacttgagagacagaaatctgattcttaggaaatttatgtcagtcatgcatatattcctgtaccaagttggaagcataaaaatgggcttgtatggcagacagcaactggtggcaaaaattggagaaggggacataacaaaagaagtcaaataacttctcatcaacaaaaataaattcagtcttaatgatgattagatcactgtcaggtggctgtaattagtgctaaaccacaacaaattagtgaagcatgcacaaaccatatgtctctcaagaactcacccttcttcctctcctgagctctcgccatgaggccatcggagaggtacccgttggccatcttctcgccggcctcctccaccgacaccagcgacgacgacgacgacacggtcggcgacgagttggaggcggcggcggcgaccgcggcgtagtacgccggcgacggcgacggcgacggcgacgataggcactccatgctgaagcacttcttcagaggcgcaccgccgacgtgcaactgcaccccgaacaacctcacgccaccggcgccaccgccgccataaccgccgccactctcctgcaggctcctttggccggtgcaagtcctggagttgtggccattgttcccgcagctggagcatttcctggccatgctcgccgccgatggcaggccaagaaccacaagaacagcaagaacaacaagaagaagaagttggagggaagcaagaagaacaagaagaagaggagtgggaattctaaggagttgagataagatggtgcatgtggagatgtagcaatagcagcatctagtagcttaataagggaggagaaagaaagatgtggtgtgggacaagcaactagctgaggagctaacacctggtgccaatggaaggggacacacacattggcatcatctccttttatggtattgacaattcaatccaaatgctggggcaccatgatacattgattctactatagatgctgctgctgctgccctatttaactgcacctggaatccacaggaatctgaaagagagtctctcctctttggatgctattagtgatatttaatattatctatgtcaacatcatgttgcatatgaaaatcatgtttgtatggttcatatcaggaatcttatacctttgcttgtgcatttttgccactgcacctgcctttttatcctggcaaggtcaactgattggaaaagagaatttgttttcttcatggcctgaaattgtttttaaaaatagacagagagtgagtttttttttaatgttgtgctgaacgtgtatgccatgccacaaaagaaattgggtaaaaaaaatgttttttgtttgatctagaagcaaaatgatggcatcgatattatcgaaattgtttcgagattagattggattgagtagctattaattgctttcttagtttggaccagaacaatttatagagaaactttcattttgtgatgtgaaactaagacctcagtgtccgaggtgtatgctgacgtcatcgttaagaaaagcatactttggtccatacatgtcctttcataacgtccggaataatattatgttattttgtttgttgccacacaaaaaaaaattctagaaacgtaatgagagcgatttgaagtggaaagtctattttgtcagctcgtctagatcaaataataaatcgataagaaacacactgcaacctcagctaacctcccaagattaaaaaaagaaaattcaagattcatttgagatactagtttgctctgctttgactaagaatattcagattgaaacagtataaaattgaggatgagattttaatgtgactggatgtgacaaaaaaagagggagaatatgaagtagttggttaaggtgaagatttcttgtgttgttcttcaatttgtcccatgtcaagaataaagggcattggccaaataacaagaaaataaacacagagcagagaagcccttattaatgcaagcaagcatacttatcaaggttaggtgccaagatccaggattggacgaaattaggaaaaggtctcgctataacaaccacaaaagggagagattccggtactttggaccttatgaacctgcatagcattagaaactatgtgctattttttttgagtttcatgaaataaaaaaatcaggcaactgttctatttgttcttctccttgtatataaatccaactggatgagttacagtctgaaattggtggattattaatttactagaaacatctgtactttgtgcacccaacttaggtatgggaaattcttagtttttgatgaactcatctttctccttatcaacagcaaggtctctctttagccttttaaattccatgactagatttggacaaccaccacattagagttagttgtaatccacaccaaacgaaagtaaataaaacaaagttgcgaaatgaaggggggcacatccaaattatcacttcaattgcattttaaaattttttgttagtatatacaaatgggcaatatcccagcttaactttactagtcaattaagcacagcgcaattgtgctttcctggcaaagcccttatttccgtgttcttggaggcttatgttgtgaaacacatggaaaaaatcctaccacttctgaattctttatttatattgtaaaaaaaaaaaagcttctcaatggcatcatgcaaatgctacaataccctactgaaccaatgatttgaagtggcacaagagacactccttcaaaggaacttattatagctgtgttaggtgctagaggatctactgtagtgaacaaaacatttcctgttgaagtgttgatcatctgtgcctgttcatgatagatgagatgccatttggatttcaatgcattattattattgttattattggattctactggtttaataggtctacgtgataatgatatgcttaattgatgcattgcaaagtgcttctagctccttggaataaaatgatattgcacaactgagaatgaaaaagaaacttcaacggcatgtcctcttgtacagtagattcatcatcttaaagtgaagagcaatgatactctgtgcaatgatccatccatcaatccatcacagaagcaccattgcaccaaccttgtttcttgcaaagttagagcatctccaacagcctctccaaatcgaactctccaaacacccatatagccaactctccatctgatttaactagtcaaactaggcactcactccaacagactctctattaatcctctccaaaataaaatcggacccacatgtcagcccctctcccctcttcttcctctctccctccccttctttctcttttcttctactccccttccttcccgtcgaggcggccgacgtatggcgcggtggtgcggcggcgctgggaggcgggaggtggaaggcggcgcggggaggcggccgggaagcggcgggaggcggcgcggggaggcgggaggcgcggggaggtgggaggcggcggtcgactaccccgacgacgacctcgacgatggcgcccccaa

SEQ ID NO: 40141 - DNA, 3904 bp, Oryza sativa
gaggtgggaggcggcgcttgacgaccccgacgacgaccttgacgaccccgacgacgacctcgacgacgaccttgacgacgatgatggcggccctgacgacctcgacgacgacgaccccgacaacggcgacctcggcgacgacgacgatggcgcccccgacgacgacgacggtggcctcggcactggccactgggggcggagggttgcgctggcggagggtggggaaaacgcgtggggcccacgattggagaggcgcttttggctggccaaagttggccagcgtggggagaagtttggccagccagttagctaggctgttggagtgtgtttttgatccaaaattgctaaaatttaacttgaagagtgggataaggaggctgttggagatgctcttactgctgtctttctttctccagtgattctgccccttgtgagtgacaaatccaggcatgaaaaggaagctgtgacaaggtaggaggggtatctatatccaaagcagatgttgagtgggggatgctattcttggtgaattaattgcaaaggaaccaaaaccagtacagtttcagatagatatccagcaccagaatcctgcatcttgtctggttctcctgcaagaagttgtactgaagaattcctttcccttctatccaactcttttttcggagaagaatccaatccgttgggaaaatccatctctttttctggagaagaatccaatccgtttggaaatcattaaggaatatcaatttggatagcaaaacactacggagcatgtccatttcagccgcactttatgtcttctaaattattcccatatttcctttttggctgaaacactttactgaatgtctgaaacatataaacacaatacaaaaaatgcagtacttcattttaagctcgagatccattaattgatagagaactgcatccggtcgcgtccaaattaacgtttgtgtcaccaactcgccatccttaataattctcctactcctcaatgtttttttgttggaatgtgatgtttgatctgccaagaacggcgcaaaagtcatcacatgcaccatcatcaatttattaaaccgcagtttgcccaacacaggactcatcacccatcaaagacataatgttaagatctcaactcccccaaaaaaatcttaactccctcgttaagatcgccccatgaaaattgaatctccggtctccaaattaaatagttgaatactactccgttccagaatataagaggttttagttttgtcataagtcaaagttatctagctttgaaaaaaatttgcaccgacatgtacatcataaaattagttttattagatattgtagatattaatatatttttctacaaatttagtcaaaactagataagtttgatttaggagacaaaactaagcctctcgcattctgtaacggaggcagcattatcttacaccaaacgtgtctccttgtttttctacattttttctcttctaaatattgtcacgaagaaaatgtgaggtcaaatgacctggtaaaaccaagtacctggttagtaactacgacaacactgttcatatcattcagtctagaagaaggccataggtgagaggtgacaaaaacacatgtatggcatgcatccaaggaccagctgtgaaatctacaggcaccaaacatgcacggcagggttcacaatcacatcacaaaaaattcctttgccatgaaaacaactgaacaggttttatgaaagttttcaaactcgatcgagctcagctagttcacaatggtcaatggatgcaaaccatcaggctcgtcgcttctctacgcgtttctttcgatacacctggacttgccgggcagcagccactgtttgacagctgaattgactgtctctgaaacctgaccaaacattccaaaaaacattcagagtttcagagagtttatggcctgagagatcatcatactaccaagttaccaaccgtgtgtttcagagtttcagtatgaaagaggcaggtttgatctgaagacacagagcatttcaacagtcggtggcagaactgaagacagtctttttttttttttttgatggcgaactgaagacagtcaagagcagaggaagcagatgaagaaatggttttcagttcaattgaatggatgagtggatagagcgagaccatgggccggtatgcggcgccatacatgggctgaatctccggcccacacagcacagcccacaagtcacagcgaactctccgaccgttgggggtcggaaaagaattctccgagcccctactgggtccaagacaaccgttggatggaggcgtacgtgcggctaggatcaaaagcttgtaatgtaggcccattagaattgctgcccggcacggcccaacccaacgccgcgcataggaataagttcactttgtgaccctcaaaagtagtcgaaatctaatctataatcctaaaccacaaaacaagatttctcgacccccaactctcaaaaccggtgcaatttgactccctcagcggttttactgatgtggtgcctacgtggcaatattgactcggtcttcttttcacgtggcgcttaggtggcattagaaataaaaaaaaataaatgtgggacccatttatcattcaccaaaagtatgggtgggacccactgacctgtggggcccacataaatcatcctctcttcatcctccccttctctctctttctcttcatcaaccttcgggcgagcggcagccgtgggacgagggccagcggcggacgggggccagcgacgggcaggagccggcggcggtgttgtcctcgtcgaagcgtgacggctgtggccggagctaagaagggtgacggagcaccgacatcggcggcggcatcgggtagtagcctccggcgtagtacggcgtcgcattcgctgcgaagtacgggaggtgaaccggcaccaccatggccggctccgcccagttgtagtggtggtggtactggtactccactgccaccgccgctggttcagatttgtcgccgtcgccgctgctcttggtggtggcgtctttggacgatgccgtcttcccaccggcgcggccagcctcgtcggcgcgtgtggcggcttccttcctggccgtgcacttgctgcattcctgcttgcacgccgccgccgtcgctggcgacttgttgcctttgccgtccttgccttcgtctttgcgcgcgctcttctcgtccgccggcgaggtcggcttctcgccgccattgctgttgctcttcttgccttcttccgaaggcgcagccggtgacggcggcggcggcgccatcacctcggcgatcttgccgaccttcgagagcttctggacgagcaccctgctgtccacgtcaccgacgacggtcaccttgtcgagcgacgggttgatctcagtcctcagcacgcctgcaaaatccatgcacacaaacacaaaattcagcatctctgacgaagcacaagattcatgcacacaaacacaaattcagcatctctgacgaaacaacaaattttcagcgtctcagatgaataacaagaacacaggagaagtgaatgatctcgatacctttcaggcttatggctttcatcaccttcctcccgcaagcatgagcaaggagacggggagtaaggggaggagaccgctggtgagaagacggaggcgagagagaggggattggaatcggtgagctcgagcttgccatcctgccctccatcttcctcccttgatgcctgcttgctccccaccatcggctcatggtggcgtcaccggagcagcgtcttccccgggagtgaggtccgccgccggctcccgctcgcagccgttcccctcgtcctcccactaggggatccggcccctcgcctgcccgccctcccgtcgccaccgtcggctcccacccgctgccg

SEQ ID NO: 40142 - DNA, 3364 bp, Oryza sativa
agagacagatagaccggaaagttgaggggggggaggataaagagaggatgatttatgtgggccccacatgtcagtgggtcccacccatacaatgacaaatgggtcccacacatatttttttatttttaatgccacctaggtgccacgtcaacgccacttgaaaagaagaccgactcaatattgccacgtaggcgccacatcagcaaaaccgccctccaaaaccaccgagggagtaaaattgcaccggttttgagagttgggggtcgggatatccggtttggtggtttagggttatggattagatttcgatcacttttcagggtcacaaagtgaacttatccccgcgcatatcatcctacggctgacggcccacggatcacggcccatgggcccggctgccccgccgcgccctatatgaagcgctcgagagcgccggttcacctcgtccccatccgcctcctccgccgccgccgcgtacatgaaaccctagcggatctcctctccgtcgtggccatggcggagcaggggtggttgttctgttcctgcctctagtttctcctatcttcatctacttgattctctcgcatcttagtgattttggtgattttgattttctagtttttgaatttgtgattttggtggtgtgttcttgatcgcctttgagagaaccgggtggatttattgctggtgccgcgtcggttccgttgcgggcgtagatgaatccttgtgcttcagattcatccgacgagctccatccatgtcgtctcctcgtgatgctgggtggcagggtgattttggaacattttctttttttttacttctctcccgcgagatctatgtttgtttgtttgcgtttgtgcaatggtgtttttgctgggttgatggccttcataatcccggattaactcgcttagctgttcttctgattcatgggaggccgagatcgatgctggcagtttcgctgatagccccttcctcttactggaggtgcttcattagtaactggccacacaatacacaaatgatttcaaaacttgttttctccgtttgtttttttgttttgtttttgcgaaaagtttcgcttgggatgcgttgcgcagaacgaacaaaccatcttctgaaatccaccgagatcaatagacagggtgatgtttatattggtagaaatacaagtaatcataaaagcagtaaatttggatatgccaaatttaacagaggcatcgaacgattgaacatataagaatatcatccaaagatgttcaactgttaccgcaagaacacggcaataaccttctttttagtgttgtgcggaaatatgttgaacggttaattgacaagcaaggattaaccttacttataggcctgttaatttgccattatgaaacgtgataaagacctagtaaaccaaagagaattacccctacattacgaacttacgattggtggcgtgcgtatgactcgaaatggtcgagcagcttttgttggagctctgaaacaaaggcaggacaacttgtggatagtacacgtcaaaattggaagtttggttgaaattgaaattggaatgaattggaagtttggttgaaattgaaattggaatgatgtgatgtaaaagttggaagtttgtatgtgtgtggaaagttttgatatgatggaaaagttgaaagtttgaagaaaaaatttgaaattaaacaagggcctgatgagaggtctgcttagctcatgcctgcgtcagtggaccatccctgacgaccttccaatcttcgccactactcgctccatggtgcagatcaaggtgacaagaaaccagaaacaaaaacagtggtaggaatctgcgagtcttgtgccaatggttcacattatcaatgtacaccgacagcagcgcacacagcctcaagtttaagaatggcagcgtgtttaaacagatgtaaaaataataatttctttatgaaactttttcacaacaaaattctgcttctatcattttctctcttctttttctcgtatggaacgatgtgatgagatatacatgtgtttctgactacaaacatatgaacaaacagacccacccttctcccctacaaactcactcccacctctgcctaataacacatcgatacagattatatcagttaaccacaatgaaaagaaaaaaaaaactgccattagctgcatcactggaggtaccaaaacttgctggcagtgaccatctgaattcagactagcccatgcagtgttccaccttcatgagcttgtattgtcaggccatcaaggattcattcatttgccaattgctaaactttgagcgagatccgagtcttgatgggcttcagcttcactcccatgctctccggtgacagaagttcaggcgatatacagaatgggttcagtgtgctccgggggctgctatccagctgggaaggtctgtagagcccatatcccatgaggaagtactccatggggatcaacatcgcgtgcggttgctcctcggtgacgagtgacccgcatgcctgaacctgcgatttagaggcgaaatgcacattcagaacttgccttactctgcgtatggatcatcaatttgctatgtcagctgttaaattgtgatatggtctttatacctcgactagggcgcaatatctccggtctagctttgtggtcatatggactgcgtcgtcgtggaactgtgagttctctcccacaaaaatcagtgtccgacactgaagcttcttcaacgcttccgtcaggtcatgtctcctgatggatggaaaaattcacttgagtatgttcaaatcctgtttctttgcatgttcaggcaatgcacagaagataatttgtccacttactcgtttatcgcctgaaggaatcgccatacattagatccctgtcgctcatgaagtaactgcataaaaggaaacctattgcttcagactaactttctataagtagacagctaccaatcttgtcaaaatcatatcagaaagctgacgaggagatgaactacttacacttctacaggcttgcacaatctctgattcagggtcttgtccattcccacgaacttcctgcacatagcatcagaaaactgttgagcgaagctgatatacataaaaggatgcaaataaaaagcagctaacagaagaccaagtataccgtgctaaaataccgctgaagcaagcattccttgactagcccacgactcccataatagtaaagcaagtttaataatacctggtacataagagtttgaggttaattcacagaacacattaccaatactgcagtaccgacagatttaaatgtatgttagtaccttattgtacaaccactcgctccaagaaggggctttgcatagcggcgaaactagcat

SEQ ID NO: 40143 - DNA, 4298 bp, Oryza sativa
taagaaaaagaaaaagaaaagacaaggcaagctttgaaataactgctcagagtaatacttactgcaaagagggtgagaatgtaggcaccggcagtgacacccaaacacatcacagatcctaatctgtatgagcaaagccagaagcacagcattagaggcgtcgatcaagcaccagccgattataaggcgcaatttggccagtgtcgtgatacagtacccgaagaaatcaagaacatccgcgacttgatccacaagctcatcaacagatggcacgggcacatcggatgaaattggagccgctcccaactgtaggacaaaataacacatgtaagtatcagagcaaatacgggcaaacagtgaatgcttacataatattgggtaagaaagagccatcatgactgacctcatgaccttgaggagtgatgtggtaaatacaaaaattgtgaagcaacagcgacgcggcctctgggcagaagaacaatccttgaaagcaagacatatctaccaaacaaaaaaaaatagcaacatcagctaccctgccatggaaaaattagcaagctttcacctacaaacttgaaaggtcatcagaaaactcacaatttagagctacatccgggtatgttatgagcgccggcttgtcttcatctccaaatacagaaacagatacagagccatatctggttcgcactcggtgttcctggtaaaaaaacacaggacacaaatttagcccattgggatttgacaatcctatttgaaacaatagtataatgaataatcaatcagaaccagcaattaaccaagaggtattgcttcccctcggtgaaacctccaccgacattgcttaacaaatagaagcaacataagagagattctcgttgtcattgcgttgataagcactaattggaagctgtagcgtaggggcttccgttcttaattaacattaaaagcaaacaaagatgctacatttttgcgtgtatttttgtttttcctctcttcctgctcctacggctcgagtaacattgcaaccataacaaaacgaggagctgcaagaactagctattactgaccaaaatcataggcatctaatctaatgctcctaatttgtgcaatgtccctgaacaagtgaacagtaacgaaaaggagctccatggcacccccaaaaatttgaagcatttgctgctctaatcaagaacagcaagaaaccaaaatcagggagcaggaatatccccgctcctaccttaaccaccatgaaaccaaaacacaaatccccaccaaaccaagcttgaaggaggggaatcaagcaagaaacgggagagaccgaaagcagagcgcacggaccttgccgccgaaggagatccgctccacgtcgatggacaccgaccggctcgagtcccccatgccgccccgctccccttctagaagcttctcctcctcctcctcctcctcctcctctgccaccaacctctcctcttctctctctctctctctcctcgctgcctaaattcctcgcatatatttgctcgcgtatatatacaaccgcgagaggagagagagagagagaggagagggtggcttggcttggcttgcccagaatgagcgcaaaccaccgacggcggtgagctcaccggaggtgaccagaatatggcgggagagagaggagaggagagggagggtggattgcctgtttcatgggatccacccgttgaaggtgggccccacctgtcaatgaccttcctcctcacgcgtttgaccggtggtgtgtggggttagcgttttcgcgcttgtgacagcttgggccgatcgtcgcttgctacgggcaccaaacgggttgaccccccgtggaaggcattaaacattttttccccttctttttcatgccaattttgacgtatttgtcgttcaagctaaatcttttatttagataatcgttcaagctaaatctagcacacgagatatttgtggccattatgaataaaaagtcgtttttcgaaactgtttttcataccatcatttttggggttttatttggaatcattttggtagacattatatatatttattctgtgaggagcctacgtgcaccttccatataagaataagttcattttttgttcctcctatttatctcgaaataagtttattttattaatcatatcagagtttgtgcaagtagactacaaatgcatttgagtagactagcaaactactcatgctttatatgggtaaaagaatatactagtatattataatatgttatagacaaaatacattttttatcacaaatgttagtatcacttgtttgcttattaaaatatatgatattcacttgtttgaaacaaatattggactctattccataatatcaaaaaatatcaatggctaatttgaactacaaaagaaatggtgggatagcggtgacagattcactgccagcaccactaatgttttttaaatgagtatagataaaagagaaaaataattatattgaggtttgataaaatagggtagtatagtctcttttttaatgtattggcatatgtggtttggtttgaaagttgtatttattttcgaatgaagggattatagttttgtaaagtgtgactgtgtgaattgtttgagggacctaaggaatggatatatatatatatatataatgaaatttagaaaaatcatttttatttgaaattggacacgggaaggcagacactatgagttcgtgtagtaaaacagggtgtgccttttgtgtgcgccagctcaggctggtggcggcccatcagatgctgagctggatgggggcccacacatcagtctaacaaaaggtgcggacgtggtacactcgagcgcgtcatgggtttctcctgattggccgcgtccggtgggggccacctgtcagtggtaagtaatgcgcccccatgatttgcctcgtgagtcgcgacaaaattaataacactcctactagtacaatctgattaattactactaatagatttttggagatacatataccgattgttttgggatttttgaatataaatcacttttctacccaaatggtttttgcactacttttattctgtttgttttttatgtgagtcaattaaaccagcgaggaaatctaaacggttagaaaatgtatgttatttcttaaaacttgtttttttatgcaatttcaacacgttgacccggagaagtatttttagccggcaaaataatatattccaatattatttccgaaaacaaaaataagaaaaatattagatcctttaattgtcaagttagtattgttttagagcctaacaggtggtcggtttggttgacttgccagctgaacaacgtttctcatacttcttttttttttctccctgccctaatttttaaacgcctcccctttcacacacaaacaaagcaagcttaattagattcttaatctttagctttctttcagtttgtttggtcgtctttgtcaaaccttttggatggatggtaaaggggagctcaagctaaaccaggacaccctaatttcattttcggccaatgctttttcattgctacgaaaggtggtcaatatttttttttaaaaatgtttttttatcaacttctaatcacatatgcatgtggagatgatctcacaatgccatactataataaaagatcttaatttttttattccgaatgtgagatcataagatggaagctagctagggtgcgttcggacgtaggtttcaacttctattcccttgttttccacgtgtacgttttttaaacagttaaatgatgagtttttttttaaaaaaaaacattagttttaaaatcatattaatttatttaaaatatttttatagctaacacttaactaataacgcgttaataagccaccgtgttttacatgtataggagagaagttcacaatcttctcttccgagggcatcctaaggccccgtttggtagagctcctaactccaactcccaactccaaactccaactccagtgagagctagctcctctaggagctgaggtaggtaaaaaagtgtttggctagattactcagctccatatttctacatcctttgtcgccatttcatcgaacaccttctaggcgtcgccttgacgttgccgccgtagccagtcagcccacgagccaccgccgccgagaagcccacgcatctccgccgcctcccaagccgctgcgcaagcgccgccgcacaggccgccgccgtcgcccaggctgtctcctgccgacgcccccgcacgcgagtcgcctgccgacgccgccgccgcgtgctgcccgtcgtggcca

SEQ ID NO: 40144 - DNA, 2428 bp, Oryza sativa
tgtggctgtcgtcggaggattgggaaaaagatgggtcgccgccacccggtggcccatcgaccgcgccgccggtcctcgtcccccaacagccgctgtccgccgctgccgcagccccccgccgccagcctccggccgcgcgtgcgtgccgcccgtcgtcatcccgcagccgccgccgcccgccgctgtcgctgcccgtcgccgtcaacgctgccgcagcccgccgatgccgccgcactagctcgggattgagaggaagattgggggaggagagagaacgggaggaaagaaggggtgaaagggtagttgagtggcattttcgtgtaaatacactaaaatattagaaggtagtgggtcttttggggtggagtggagctgtggagcagcaaaaacccagctccacccccgtagttcattttctaggagtagctctgccaactccactccaaaaaaaggtgaatctggaccgtttggcacagctcccgctccaggtaagttggagttgggagctagagttgtgccaaacggggcctaagacagtgatgagctcctcctagtaattagcaagtgcccataagccggtcataaatgtgatccacgtgaaacaacctacagatgccacagatctcaccaccgcacgctccattgaatcatttgcaaggtcgcaattaatcatcgcagatgcatctgaagctgagaggcagcagctagctagcagctgggacctgcaggtgatggattcaggattcgcatatcgatcgtgaatgaatgaatgattccctaattaacccaaagtgttagtgtcagtgtcagtgtttaatttgttgctccgaagaaaagctagctcagccttttgggagctcaattcgacttgctagctactaatgacggattactgttgattaattaatcttcaactgcagtaatgcttgctagctagctagtagtagtactgtactcaactggtaaattaattaactggttacactttgtaggcttgtggatggatctgacgaggttgattaattagtaatttttctgcagaaattgcaaagctagatcgatcgattgatcgatctatcgagcacgagtggcacaggggatcagtcggtcggtccaaggtcgccatcagagttcgtcggttggtctaattacccaactgacctagtagcaaaatactactccctatcattttttaatagacgacgccgttaacttcttacatgtttgaccattcgtcttattcaaaaaatttacataattataatttgttttgttatgagttgttttattactcatagtactttaagtgtgatttatatcttatacatttgcataatttttttaataagacgaatggttaaacatgtgagaaaaagtcgacggcgtcatctatttaaaaaacggagatagtactaatctatagttatttgattttaattgcagctgagatcgatcgagtggtgctccatgtctcctccgtgagagatcgaaagcttcttctttattaatccttaattctgctcggccatcacgtcgtgcgtgtgtgtacgtgcagtaatggccggcgatcgatctccctgtccatgggtggattaattactctctttaatcttcttcttcctcctcacgtcgttgctcagatgataataattcgtggatactacgataggaaggcttagaaattagcttgaatttttatctttagaaagttagcttaattttcactgttgcgattcagacgatcagtgatatgatatgatgcaggtgttgtgccgcagtaagcggtaaccagcaatggttagttatcagttgacttgcaattaagtaggcagacaccggttaaactttttcgtgtcaggattattgttaggtccaatgccaacaaaatactactccgttagttttgtccatatacatcatttcgatctcgcatgctgtttattcggtcaaacctgtcaaaattttgcctaaacatcgcgacaatgaagccaatcaaatcgagcaatagtcgccttgattggctcttctgtcaatggacagatggagagagagagagagagagagagagagtttcagtacgtgacagatgcagatcgaattcgatcactttcatggaaaaagtttttgctgtgaatcaaacagatcatgcaggaaccaaaggatctggaaagaaaaaggatatttgagcacaaggaacagcgaccccaaccttatagcacaaataaagaaagatgcaagaacatggataatggcaggcgcaaggcgacttgaagaattccttctaagttaaccacaacgtttatgtaattttgtatagctcttttttgcctctaggagatgtatttttttacgcctatatctaatgaaatagcacaatctcgtgctgattccttaaaaaaaaacagatcatgcagattaatcttgagag

SEQ ID NO: 40145 - DNA, 8324 bp, Oryza sativa
taaatttcaatgatagttatattcgatttttacaatcccaatgatactaaagagtacgcggcggacgggtcgtaaaggacggcagcgtttaaagggatttctaaaaattataaaaaacatgaacccaatgcgataataaactctaaaaactataaggtcaaatttttaatggttcgggcttctaaaaagtaaaaaaataaaccctaatgataatcatatttgattttaaaatctcaatgacaataaagaagagcggcaacagggagtcgtagaggagtacaatgacaaagtcgctaacgttttggcaaaacttctagaaggtagaaaaatgatcctaaacgataattatgttcgatttttaaaatagcaatgacaataaagagaagatgcagtggacggtcgtagaggagtataatgacaacatttgacaggatttctggaaattatacaaaaaaagcccaacaggacaataaactctaaaaactataagtcttaacatctaatttttaaaggtttctaagaatgaatagaaacggtgatagatcgagcaagctaataaagaataatatgatagaagtaaggggtagccactgatgtgacttttaaaaactataaaattagaaacacgggaatgataagttttggtctttcaaaatcttaagacaacgagataactatttaataatttttaagtaaaatcatattaaaaaatatataattttatatgggtgctagccgcgcaattgcgcgggccacccagctagttttgtgaaaaatagcaatgaatatactgtggaagaaagatgggcgtagcagttccgacctgccattgcgttttgcggagtcgtagtttaggcgctgatcgatttggatccagagctgtacatttccaccgctatacgttaatctctaattaactcgagcaaattagttgacgactgagttggagtcagatctaaacacaagcatgcgagaggagaaatattatcgaaaaatcagcccagttacagttacagctatgcatgcgcggaggaagaagatatttgtagccgcagttacgcaaattggggaaagatatttcttcaagttgatcaagttgcttcatcatccataaagccaattttcggtcgggtccgtaccttgtgcataataaacatagattagctgtgtttattactactcccttgcaacttttgtgtcgcaaggctctcaccacctgccactagtgccgtacgtcctgctgctagctttgccacgcataacaacaaactgaacattccgaacaaataattggactgaacattctgaacaatccataatcgccagcaaaattgggatggagatggcctaaatcgagctcacacacatacagtaaagagcgagtagggttgtgttcgaggagaaggagatagagaagattaggaacatatgcaaaacgaggtgagccattagcgcattgttaattaagtattagctattttaaactttaaaaatagattaatatgattttttaaagcaatttttctatagaaactttttgtaaaaagtacaccgtttaatactttgggaagcgcgtgcgcagacaaggaaacaaacaaactccctaccccagaacgaacgcagccacacgtcgatttccatgtacagtgacgatcgacgcgttggaacgcccgtgatatttgtcccgcaaatcaaaacctctcgttgtttttgcggtggaaaccaaagcaaggcctgatctagtttctaactttttctttaaactttcaactttttttattatattaaatttttttctacacacataaacttttaattttaattttaattaaacttataattttagtgtgaactaattaaacacactccaaaccaaaacagcgcatgctgctaggccgtactacgtgactggagcgttggtgatgattcgtgtcacgtggcggcgacgtgcggaggaaggcgatccatgcggctgtgtttgtgtggatggcaatggatggatggataacgtcgaggctagtccaaccctcgctttgagtaaggaagggggtccatgctgctggattggctctactcgcgtgtgtggactacagctgtactgctatactaggctctctccgcctctttttcttctcctagtttgtcggacatgaagcggcaactagtagtattattttcccagaaaatttttggcagcatatagtaatatcttcgtcaaattgatctgatcatttcccagaaaatcgtcttcttcttttatcctactacgtcaaatttgtcatcacgattacgagtataatacggagtataaagcaacacgaactgctttgtcagacaaacatatagggtccgtttgagggagtttttagtttctcgtcgaatcggaaactacccaaacaatgcattttttattctagattataagaaacggtgtagtatatgctcatagataactattatataaataagctactccctccgtcaaaaaaaagataaaccctggttttcgtgtccaacgtttgactgtccgtcttatttaaaaaaattatggaaaaaaataaaaagataagtcacgcataaagtattaatcatgttttatcatctaacaatgaaaatactaattataaaaaaatttcatataagacggacagtcaaacgttggcacgggaactcacggtttgtcctttttttgggacatagagagtattagattagctatatagatgaattggagctagtagttggctataaaacttgctctaagagcaggtacaatagcagactataagtcagctataaacatattttaagaagattaacagagagaagaacagctggctagctgtagtacggactctaagacacagtgtgtgtatgacatgtgagaccagttattaatagtgtagtatataactattgtatgaatgagctattagattggttatagatgaatttagagctagtagttgactatattattaaacttgctctaagtattcggtacagtatatatactgtagtccacgccatctttttttctacgggatactgtgtatggagcttgctggactgtgcgaggtcgtgacgtaaacaggaagggtcgaaaaggactagacatgcccatcaaaaaaagaaagtaaagtgaaagtgtacgagacgaaacggagcaacaagaagccaccaccaccacgcccgctgtctcgtgggaaccggacacacaagcacccgatattttctcccccaccccgaccccgactccgaccgatgcgttcgcgacccaacccaccaacccattcgtctcgagacggagtcgccgcgatccgatcgatccgggtcagattcgggtgccgccgccgccggcgtcatcgtcgtcttccccaactccggcgacgtgtacgggcgatgaacagtcgcactgcctgcaaaaggcaaagcggacgctacgctaccgggtagtagtacatgtacatactcgaataaagaggacgtgtctttttgtggccaagcagcggtgcggtggaagaagcagagagctgcagcatgtgcaggccaatcctgcaccatcgattccaccaaagatgacaacgactcgccggcgactccgccgccgtcgcactctccgccggtctctgtcacggcaggttccccggcaccatcgccccccgctcagctccacaaaacacatcgatttcgtcactaatgaacagagatattaagatgagtgttatttggatcaaggaagtaatgaaacatatagcaacataatattattggatcatttacttgaagcaggtgattacaatacattgaggggggcttcatcaccacatataggtagatgagtcagcaaaagattttcagatttaaagctaaggtacaaaatatgctgttgggggttcttaacaaaacaaagattacatcaacaaaataggaaatcaacaagagggggggcttgattgaaatcgatcgacgatcttcatcagctagtcgatgatgcaacaaacgatgaacagaggataaacccccagaaatcactgaaataggcagggccgccgccgcgacggcggccgaaatccggccatcttcttccgccatgatcttcttccttccgtgcttccttcacctccacacaccctatgcacacaggagacactgaatcacctccatttctactcctcttttttttttcacctaatttttttgtgggtaattttgctactacctcaaaaccccaaaacaaatccacccatctttccatacttgcctcctctccaccaaccatgaatattcacatgggagatagatatgtacaggaattagtagaaacttgacttgaaatcacaaaagaaaatgaaggatttttttgtcgtgccatcattttcttcttaccgccaccttctcctcctccatgccatcatccttgatgctcacaaaaggggcttccaatagcgacttggaagcctcagttgatgaggtcggacacccaatcaacgtcgaggccaacaccggcggtggcgaaggctgtggcgtcgccggagatggcaccatcccggctcagtcgctcgaacaccttctcccggagggctcttccggactccaccctctggaccggctcctcgtcgccgatgagcccgaggtccagtggctccaggttgggcatgaagctggaggcggtggtcaccgttgccgtggaagccagtggagtggtggggaggctgtagaggccggtggcggccttgggagacccgtagacggcggacgacgaagggtagctccacccgccggacggcgacgacttcaccttgttgaggcggagctggcggaacgaggccaggacgtcgttcaccggcgagccgacgccgggccaagatccgcgacggatggccgcggcaccgtcgggcgacaatggcggggactccgacgggggcgacttgggcggagacatgagggtgctggtcggggacgaggacatgatggtcttggtgaggtagctctcgaacgcctggcggcgcagcggcgagccgtcgtaggactcggccagcggcgaggacgccacgctcctggggctggactgctgcgccgggaggacgcggagctggtccggggtgtgggcgaagaagcagacgcggcggcggcaggcggtgccgtccttgcacggctgggtgcggtagcgcgccgggtggagccaacactcaaacacgccgtgggcgtactcgcaggcgtcgccgcgcttgcacccgcccttgcggaagtccgggcacgcggtgccggagtagtggtacttgcgcggatcgcggcggcgcgccttctcccccgggtgcgcgaaggggcactcggtccagtcatggctccgcccgcgcgcgcaccgccgcaccttgaactcgtacatccggaactcgtcgcacgcgtacgcgtccaccgccgcggccatcgccgcggcctcctcctcctcgtcagcccccaccccgacatcattcgccggcaggtaatcccgcagcgcggcgatcacgtacggcgtcatctcatccccaccgccaccaccgccgccgagtacatcgactccgctcacggggaggtgagaccacggcgggacgctgctgactccttcccccatcatcatcatggccaccgccggcggcaacacgacctccgatcaaccggtgtatggactacggcgagatctcgtggactcggcgtatggacgagtaagagagagtggtgcgatgtgtaaggcgaggaggacgaagccgaagcggtgcgcgcttataaactgctccactaaccacggtctcccacctcgggatagagtcgaaccatggttgcgttaaaccccaaccacggttccgccgtgggcggaggggtcgtagtagtaccacgcatccggtaactgacgccgtctctcgctccccacatcccggtgggcgcagcgccacgtctcactgacagcacgggccccacgcgtagtcgggcccacttccagcgagacgggggcgtcaagcaggaggtggggacacgtgccggtgaggggaggagggtggcaggcatgcggggggcgaggtggagcgagagggcagcgggggtaggacacgtcgcgcggtggggggtaggggtgccctacggatttgttttgggtaacgctagtacgtgaggctctctagactgtggtaggtttggggtccgtcagggattggacatattcctgtaggttctagaaaccttgggtagcgactgggagaggagggggaggggggggggggtgggctgtttggacgcatgcgtgtgggccagcggggccgcggattggccgatggttcaccggagatgggtggttttcccatacgtggatcactgtcgccggagatgggtggttttcccgtacgtggatcactgtcccgttgatcgttctttgtttcgcgatatcgcactttgtgattttgcattatcggtttccctttttcctttttttcgggtacctttctacggtaactcattgaatcgagtgattatttgatcatgttagtaatactccgtattttaatgtacgacgccgttgactttttaataaacgtttgacctcgtcttatttaaaaaatttatgtcattatcatttattttattgtgacttgatttatcatcaaatgttctttaatcatgacataagtattttatgaataagacgaatggtcaaacgttgattaaaaaatcaacggcgtcatacattaaaaaaatacagatggagtactaaaaaaataattttatagattaaaaaacactatcgatcgttaaacttgaaccaaactacatcatctgtctttcaaaaaaaccaacttctgatctagacatatactccctccttccctaaatgtttgacgccgttgacttttttaaacatgtttgacaattcgtctcattcaaaaacttttgtgaaatatgtaaaattatatgtatacatacaagtatatttaacaatgaatcaaatgatagaaaaagaattgataattacttaaattttttaaataagacgaacgatcaaacatgttttaaaaagtcaatggcgtcgagcatttaggaatggagggagtaatatgcctatattggtaattagaatttaactttactttttttaaggacatgaggagtatcaattagacaataatcttataaatcatgaaattaaatccgaactcatggttacaaatgttgttttggttgctccggaacattgatatggctctcaacgtaggccgaaactttacttccagacttctctataagcccctgcaatcgaaaattgaaatttgtagatatccattcttcgacccgagctcccccaccttgattccctcgtgcagtcgataaggaggatgatgataccgtggtgctttggacggtgcaattagttctaccatagattctacacccatgaccaatagcacatcgcaccaaaagcatctcgacatgctgatattctttgatcatcgcgtagacaacatgagggcttcgatgccctaggcaattacgattacatattgacatatgcaatttacaagattgagggtataaaactaacacatatacaaattcaaatactgttgaggtttatctgacagagtttcggctcctaaatttgaccaggagtgaagttcgaaggaatctgaatgctgttttgcttccctagttaatttgtgggaatatttcatctcacttcatttccttttgatagagataaaaccgtttgatcgagttccaatttgagaaaaagataggttacactttttcccattactgagatatttaactactctctgtcccaaaataaatatatctatgctatctactattaatcttaaaataaatttattttagaaaaaacgcttgtatcggagtttgtaaaaatatattaaaaaagttgtattggaagtagataaatgataaataattgtattatgatttggtaaagtaaggtttttctagttttaaatttttcatatttatatttttatatggatgtggagcatgggatgaatgaaaaatgagtttatcttaaaatgaagacaaatgagtttattttcaagtaaatgcatgagcagtagtcgaaagatacggccccatcgtttcgtttattcgtgtaataagccaaataccatatttttaaccgaagagtaactgtgaataaaatttttatatacgtgctcttagcgatctaaaagcaaatattaaaaatgaatttcgataaaaaaaccctaaaatcagctctaaatttaaagttaaaaatttaaaatttaactctttaagaataaggagaagcatagatgcccctcaga

SEQ ID NO: 40146 - DNA, 3642 bp, Oryza sativa
agcgttacactcctactggtcgtagcgtatggccaccctactacctctcgatctttctcccgatcttctctttggcagatcgaaaaactcttaaccgcgcaagctggatgtgatgtcacgtacgcgaccgatccagccgtacgtgacagtcacaaatcacagaaacgagagagcgaccgagtgaggcgacggatccgttcccttgccgtcccggctcctcccggccgctggtctcgccgtcacgcgtcgcgacaaacacaaacacacacacacggttcgatccccacgcgagcgagccacgtatagtgctccgttgtttcaattcggcgcgatccaggcgtgacggtttctttaattaaaaatttctgctcttggacgaaacggacgctgcagaaataacgcagcgggtcgcaattaatcggggcgtgaggtcagccaaagtggacgtgcaaccgcgcgggggccaaaatggcacgtatctggcccggaaatgggagacaccgctcgcacacgcctccaaattttggtaacggccaagcggatgcccatagcgcagcgcgcagtactactgattgcgtgcaccgatggcgacgttgcacagcgagagcggccaaattaacacagctgcaagataaagattttttttttcgcggggaaataaacgatcacggtgagattattatgctgaaaatctttactcctactttattgtgctatatttgttgctgtaaatggaacgggggtgggaggctgagattatggaggggcactgttacacgtgtacgctatcttatcctgattcacagtgataacgtacggcgtgcgattgagatctgggaggagagacgagggaaaaggagggtggaataatagcagcagcggatgggaaggaatcgtggtttgggtggagagggtgggaggtggtacgacggagctccacgcggcgtccgggggctttggctaatcacgagatggggcgcgcgcgcgtacggctcgcgtaccgccggccggggcgggggcccccgacgcccacgccgacgccgcgcgctgcgcatcatcactgcgtctacagcgccgcccggtccacatcgatcgatccgatggctaaaaaagtccaactcactccgtgtctccgtcgaataaaatttaaatataatttcattctatttttttctcataaatattcaggatgcaaacttttttttttacaataatataccgtcggtttgtgcggaaatggcgtagaatgacatcgcggtcggcatcgcgcggtgaaaatgctagactgcgcggactcgcacagcaacatcgcgagaccgcacggtcccacgggatgtaaaagcgaagccgaacggtctcggtcaagcaattagcgataccggtgccatgccgatttaattagttattaattaaatgctaattaggataattaatcactaattattattattatttaattgttaatgaagtaattaaccacaaatcaaatggaaaccgttggataatgtcgttgtttgatttggtgagaccgatggtctcgctcttccattcagcgagaccgcgcggtctcgcacttttactgcgcgataccgcccacgacatcacgtgtatgttattttcgcgcaacggttgtgcaagatcgatggtatattttcgtaaaaattttgcatcccgaatattcattttaaaaaattgagtgaacaatatattttcaaatttaattctatctccacctcatttaaaattgatttttttcaacatttgaccgccgttatattaaaaaaaattataaagaagtaaaacaaataaatcatcgtataaagtactaactataaaaaattaaaataaaatggacgatcaaacattagacataacaagatagaataaagagctcctactcacttccttcccaaatatatataaagttttggttaaataaaacacattataatactacgaatttagataaaaggtttattcagattcatactattaagatatatttcatcaatctaaaacttcttatattttaaagacggggaaatagtatatttgtggcagctacactagtcgacatggtcgtacgtgctgccatctttgtcactgcacagtagcacagcggctgtagtagcgccgcgccatctttgcccattccatgcgtgcttgacccgatcgatcgagcgcgaggccattcaacaggctaggcgagatatcagacgaatcaatgctttcaatgggcacatcgtgctagctgctgccataagccgggccgttcaagataagtgtgggtcgctggggagcagcacgcatgcatggccatcacgcacgctaagacaccacaccatgcttgatgaacgagcttgcttgcttgttcgatgggtctctccaccgtctcccggtgtggcgcgccatctcgcacgcgcgagtcacgtgacaatgtgacatgaagaaccctggcgttcctgtaggccgctagaggatttgtccaaagctgctgcctttggcttttccaagcggtctcgagaatggccaacagcacaagcaagagcaagggatgatgcacatagcctttgctttttgcttggtttgggttgggttgggttggatggctttgctccctgcctaggttgttccctcattccctacctagtgtgcacccatcattgcagcacatctgtggctctgatctctcctccatctcctttgcatctatccccctccccctgctctatctttaactgcacaaatgcagatcctcttgcatgcctgctgtccctgtagcttcagacccaaggttggccaggctagcgagctgcgtggtgactgacatgcatgttcccgtgcaggagaacgcctagtttcgggcatctcagctgtagcgggtggtgtgtgcgtagtttggatagttgcttgctcagttgctccgatctggaattccagaatcttctttgttttcccggacgtttctggaagcacaaaactttgtttagccttcatatcaatcttgcgtacagtatgaattttcgagaatgaacgtactaccagtatgctttatttctaagaaaaacagtgttttaaggtggtgtttagaaacgagggactaaactttagcctctctctcccaaacaccccctaaatttttttgtttagcatatgcaattcaaagcaagtactcattgttgttgactgctgagttatggcgagacatgccgcatcagtcaaaacaagcgtcgatcgacgccgacccacggctggctcggtggcctgcctgccgggttgatggtgatcgaccacatccacacagaaaaaattgcatatataccatcgcaaaagattggattcgctggaatgacatcacttaaacgggcttcgctagaataccactcctaaccaaatcgtgtacgctgaaatgccatcatggaccaatctgcccttgggcttcatcttcctcactccaactcctcaactttctcgtcactgctggctatggttgcggcgaggagagccgagggagcgagctcgccggccggcggcggtcgtcgcgtgcggccaacaggagcagtggtggcagaggcatccttgggtagccgtgcgaagtgcttggggcagagcaggcggagcgcggtggggttggtgaggaca

SEQ ID NO: 40147 - DNA, 8703 bp, Oryza sativa
cgctcccaccgccagtcgccgagctcgctccctaagttctcctcgccgcagccgaccactgagctcccttggttttcctcgccgccgtcggccggcgagctcgttccgtcagttctcctcgccgccaccatggccatcggtgacgacgaagacgaggagttggatggaggaagaagaaacccgagggtaaatctgtccaggatggtatttcagcgtacacgatttggttaggagtggtattatagcgaagcccgtttaagcaatggtatttcagcgaatccaatcttttgcgatggtacctatgcaattttctcatccacatgatgagggacgcgtgaaccgtgcgatcgagccacaccgcgtgaccccacccaggcacccacccatcccgtccgtccgtccaccatcaaaccggtaggcgcccacgcgaccacgcggcgccccgcctgccctgcctcctccacccggggcgcgcgcgacaccggcacagctcgtccggataagcgcgacaccgcgttttcgcgtagagtacctgggaatcgaagggatcggacggtgtgcgcggctggaccacgcaccggatccatccatcatccgtccaccgctcatcgctgcagcctatcgatccgtgctcgtgcacgtacagtgttcctctgtgcctctgcacagtaccaattactgctttacttaaaagcgacggagttggctataattgggacgaaagccaatgtgcacgactcctccctggtctggtctcccggtttgggttgggagatgctttattttgccaggtttgttcgtggttatctgctgcattggcttggctgcgtgcgctctgtacgacccggcctagagtacgtacgtacggcgtactgtttttgtttttaatgcagcgagtaaactctcaaatccgtagatggcgtacaccacgtttgacaggatggggacttggctgctgcccatgctgtccatcgatccctctctaagctagcgcacggcgtgttgcctgccggggggtgcatggcaagctcgatcggtttgacgccgtgtaagcatcatgtagccaagatgggaggccatgggggctagcatggtacgctactatacctatacgtaggaactgcctgtggtgtcaaaggctctaggagtatatgattggtggacctaaggcccgtcgtcgactttgaacggctggtgtttgaatcctctagatatgtagataaaaattactacctctgtcccaatatatataagtatagtcatggatatccgtgtccagcgtttgaccgttcgtcttatttaaaaaatttgtgaaaaatttgaaaatatttagtcacatatatagtactattcatgttttatcatctaatagcaataaaaatactaatcataaagaaatttcaaataagacgaacggtcaaacgttgaacgttaacagtttaaaagtgcacttattttgggacgaagggaataagtgtttcacgtaaaataaagtggtaataacgtgtgattaattgagttttaattattacaaacttaaaaaatagattaatatgatattttagaacaactttcatatagaaagtttttgcacgaaacacaccgtttagcagtttggaaagcgtgtcacgagtatccaaaatttatcctctccctacagaagaaacagatgggggtctaaacactactcccttcgtttcaaaacaaactaacttagaagggaatgtgaccattcctaccaatctggatgtcacttttctagatttgtggtataaggaggggtcacatccgtttttaggttaggttttttttatagagagggtagtaaatagtggagcatttgatatttaattatggtcttgttactagttatttaaaaattctataattaaaccttttatatctgttgctaacacataaataataggcaaatatcgtgataactgacttgtcaagataggtgatgaacaatatgtttacaaattactatagtaaatagtaggatgctagagaaaacggttgtcacgcataggctaaagaaaaccttgaacctgtggaccaaagtaaactccttatatggtgtttttacgtaaaacgaagtgttattaacatataattgattgagttttaattattataaatttgaaaaatatattaatttgatattttagaaaaactttaatatagatagttttcacaataaacacaccgtttagcagtttgaaaagtgtgccacgaaaatcttaatcttcatccaactctggttggagaaaagaatgggtagtcttacaaccgcgcacaagacgactaatcttctggagattgaaaactgtgctaatagtaactcagtagggatcaatccaatatggcttgcatcaagtcgaatctattgctctactgtactctaaattaagttgttttatataaacccacgttctcaccaagcccttcttctcaaattgaaatgcgttatgcctatgtaaccatataccttttactctatccgttttatattgtaagactttttgtcttatctagattaatctattgatcaatttatatgttttccatacgtctaaatccattagcatttatgtgaatttgggtaatactagaaattcttacatttggagaatggaggaagtattatatattaagatatacgtagcaacctaatactcaaaatgaagtggtactagtctaattaatcaattttgagtattacgtaggtggctacatttttgcacatggagagcagagaaaaatgacttctccttttactgtttgaaagttatttttagcctcagcgtttcgcttattcatatgtttatccacaccgcttattagaaaaagaaatatggtaatacttttacatacacgtctttagcgatttaaaatatctaaaagtaagtgatgtaaaattaactacgataacactacaaaactagcttcaaaattaatctttaaaatttaaaattttgactaagcatcagtgaaacaatgagaccctttatatggttatcatatctcttttaaggttgtgttcagattaagacttcgcacggatgtttttcaaacggttaaacattttatagaaagatatacatagaagttacttttaaaaattcatgttaatttattttattttttaaaattataataattaaatataacatcaaccatactaatgattcacctaaatttaggtatttttttaattttctttttccttctctcgaacgcatccagactctactactgctcttcgatacagggatagatgtcctaaaaggtaagcataggagaggaggtggtggattattttaggaggtctgacatggtgcttagagcctaaggtttgaccggttccttccttcaccttcagttccttccctccccgtatgcgataaagatcagtcttctcctgaccaagcgcctttatcctctttgtcctttgggtttgttgccctcacatggccatgcttattccacaaccgcattcatctctgcttaaacacacccaacaaagcaacctcagcactatcacaccagctaaataccctagtattagtagtttttttctaaatcgtgtactactaaattaattaaccattcgtctcggtcgcctggagtggtggtggtttgctttccacttcgagatcctgggcgtgtcctgcacgtgtggctttggcatgtgagctttgcctagcttattttagctttaccttagctaccttaattatttgtatctgtctgggcgtagcaccctgcagattcttccttatcctcctgtagtatggtctaactatatgatggtcatagctaacccataatcatcaaaataaacaacaccaggttagtacagttgctgtcgatctcctctttgattaattcttggatggtacgataaactatagtactcctatgtacgagtagcctggtatctctctctagcttttctttgtgggctaagctaattaaagcaatattcaaatgtccacccaattaacaaacccgaccaagtcgttaatctccccagactcaaccgcataaaatactgttctttaggcttgcaagttgcaacatctttccacccagaagtactgcacagggataaaaaattttgcgtcgcgatcaggttaagcaaagcccgtaatttgggggccgctgtatatacacatatatatggctcacggtttggggcaaagttagtaactccccgtctctaaatatttgacgtcgttgactttttaaaacatatctgattgttcgtcttattaaaaaaattaaaaaattattaattcttttcacatcatttgatttattattaaatatacttttatgtatatagatagttttatatattttataaaatttattgaataagacaaacagtcaaatatatttagaaaagtcaacgacactaaatataaatattaagggacggagtgagtaattaatcggcagccgtggtgacaaatcgacgcatccgaaacgaagtccaagttcgtgcccaatgggtggctggccctgtttgtgggcgcaattatatgagccgagcgcatgcaaaattttcctgcggaatcgcgctttttcagctgcacggggaggaggtgaggtgatgggggaggaggacccctgtgtgttgttaattgtggagcacgtaacagcgacgtgctgatgtggccggtttggtggtcgcattatcctcccccctgatctagcaaccgcgacatgatcaataattaattagtctatgtgctcacaaattaagtagaatcttgtgtgtgtggagcaagcagacaaacgtacatgacgttaacttcgtactagtacactgcaaaaacacgatcatttgctagccgcttacaagatgggacagctacggagtgagtgtggtttaaatgactattttcttctaaaaagattagaaataatccacctaaatttaaactctagacttaacacggttgtatttcaatgataagtgacgtattcgtgataactttatcaatattataagatatactagtccaatctttcgaagatgcttgtagagataagatttgcgtgcatacgtttataggagatgcatgtgcatgctgaacgtctttctatatgtaaaaaagatgagattgctaaatgaacgatcaatcagttcatggccgttgattgcagagtggaacaccctctgcatcgatcgatctcgccatctttgtcgtccttgatagaatgacacgataaccagtcgaacgatcgtacgtagcaatcgtaacgaaccaactgcttgacgtttccctgttttgggcctatatatacagaaatatcctcgtcagcctcctgatcgccaaaagaccggccctagctagctcaccggcttttgttggtggcgacggcgtgcctgccggttgaccatcgccggccagcaagccaatccggccgtcggcgtccgacaagtcaatcctacctaaaaatgaaccgatgcgagtaagaacggcccgaccggccgacgtggcacggcaacgacggcgtcacaatccggataagatcagttcccatccacggcgtggttatatgtggtggtcggaacatgaagctagctagttgtaataaaaaaaatttagttagggcagataattaattaagacgctataaaagcgtcattatggccgcattatggattgcaacccaagcaaagtatatacagttaagacaaaaggttaaggccagtaaaggttactccaggattacatctggttaactaataatcggagtaattaaattaaacagaaagcaggggagcttgatggcgacgtggcggtctggtggacagatgcatggataagaaagtgtgatcgatcgaaccggctggcttaatttggctaatgcacggctgcaggttaagctagtggacaaggtgcggatggaatgtttggatttcttttgtctcaaggctatagctttttttgatcgatcgatgcttttttagttgtgtggctgagacgaaaggctaacatgtgcccaactcgatgccggtcttgccacgtacgtacaaggagggtagattgtatatagacagatgctaaacaaaaaaaagggctgatcgatgagtgtgcgtttgactgtttgagccgtgcccctcctgccggtcaattgggagttggtaggggacagtttgggtttttcttttagagatgactgatgagggagaggcagcgagggcgtttggttagttggttggtgcgcgagaagattggatgatccgagagtcgaggaggtagttagttagtagtaacacgtaatgcggttgagtcatcgacggatcagatggagggtgggacaccggtacgcacccctacgtggtgcggcgcggcgatctcccacatgcgacggcatgtgcgcccgcgacgcggcgcatgcaggcgagaccccccccacacgtcgctgaccctccctctccaaggcgcgcgtcgcgcggggggcgtttgcacgtgaaacgcgagtacgtggaggtggagagagcggaagacgatgggatcgtggatggcgtgcggcgcgcccgggacacgtacgccgcgcgcgcgggggaccagcatatgccggcgtggtactgagtcgagaccgacacgatcacacgagtgtccgccgcatgcacgcagttactagtgccacccaacccaacccaacccaacccactgggtgtacgtcatggcccaggggttggttaggccgtttcctcggcccagcaaatctcattgctcacaattgtgggccgtccacgcatgggagcatatgctaacgggccgacttggtgctaagatttttttttttgtgcgattgagcataataaaatttgatgctgtcaaattgttgaaggataacagattaaacattgctttacgaatgacatcatatcaaaatttggtagtttcgaaacactaccaaattttaatttgaaggtatcaaactaaatacatccactctatcaaaaatttggcatcaccaaaacttaccaaaatttgataaattgacaacaaagggcatgttcagattgtagctaaaataaacctaaacaagttttgccaatgccaaaattttggtaagatggtaatattgccaaaattttggcagaatttcttatgtattgaccaaatttggcaacaaactaaacatagacattttttttggcaactttgctaaaaaaatgataggtttacaatactatttttgaaaactaaactaccacaaagcctatatatttaaaatgaatgtaccataaaaccatggattaagtaatagagttatcatttttcgctaacacgcaaaatgattgcacatcaatatatcagaagaaaagagttatacttacacaacgcaatcagccagaccgacttatgccaggggaagggagaaaagcaaaataaaaaactgaagcttaaaaaactactgcggcggctaaacctaaactccaagcagcgggaagggccgagccacgctacactcccaacaaatcccaaaaaacggcaacgccgactaaagaacacatatagttaatagagttatcataaaactacatgtttaaacgccaatttttaatcacaaaaatacaatatttgtaactcaacatcacaatagtattagcaatttgacctttaaaattctagttttatgataggtttatcaaaataaataaaatatttatagttttgtagattttactctaagacttttctttttagctgccatctagtaatgctgatgtcattgctaccgtcaagcaatttttttccccgagacatgtcattgattatgtcactgtaatggtcacacattgtagtatactcctatatgctgtactcccatgaaaagtcatgagacggcctgtgattggatctttcattatactttgtcaaataggcgagaggaaattcaatcctttcttcttcggacaatctacattggatatacatgttcatatccgtacattcgaaattcagggccaatttggattgctaccctactaaaatttgcagtagtaaaccaaacacctctactaaaactctacctatgccataaatttggcttggcctataaacttgtctcttatgggcaaattttggcttcaatccaaataaacattttcaactctaccctaccaaaattttggtagtaccaaaacttgcccaagatttggtactaccaaaattttggtagggcatcaatccaaacatgccctcattttgtactttgcatctagatgtctcatctcaggagtagaagattccaagtttcacagataagaatgtcgttgtgaactgctgaagcatccatgactatactgtatatgcaataactgtgtcacaataatttgatagtaatctgtatattgatatctggttgtaaaatattccaagttgcaacgatagatgctgtcacttcctgctgccaattcttgaggcatagatgactgtgcatggttactgtgtcacaattatttgacaataatctgcatgaaagcgcattacagccacagaatatatcctgtgttaactctgacgaaccaatcttcttttgtgcaacctacactatgcgtcctaccttttgctattcaacaacgatcacttatgaaacaacatgcagtagtgtgtctcaatctttgaaaattctccatgtttagtgcagaatcaaactatttactgatat

SEQ ID NO: 40148 - DNA, 1489 bp, Oryza sativa
ccacttttgagaacactagctagctgtctggtgtgccgtgtgctacccaaaaggcaactacgacagagaaccagctatgctacaactttatgtatgcataatgaaatttgacaattaattagcacacgttggtggagtagttgtttacatttgattgtgtattcagctggatcttacacactacagtacaagtgcagcacaccacttcagagtccagcaggcatatgatgttcctgcaaaaggagagacaaccaacaaacagagatgatctcctatagtaattaacaagacaattatacattattgtgctactgtcggcaactcggttaatttgtttacgtatcagacaatatgcagttcatgaacttggtcacttcccctttgcttggttaaatggaagtattcgaggcgttaacaagtgaacaagaagacgagcaccaagtgccaactgatcctataacttgaaacctgaatcggcgagaacttctgcaaattgcatcctcagctgcagtaaacatcgtaataatatttactgtaattttttatttatagataacggaatggaacctaccgtgaaagcagacggtcaaaaaagaaaaccagagagaaacgtgtcacaatacaaacagtatcagggtctcatcggatggtttgtttggctgaggcttgggcttaggcttttcagccaacacagaggggcccgcatggaagttggatcatatgtggtggctaattctaggaactctctagtggctgtacatggaaaataaaaatgccaataccacaaactaggagctacaagcaccggacataaaagatccctcatccaaccaattaaccaattaacccaaccgatgaaatggctttgcctgaattgaaaagggcttatttggctgatcagcctaagaatacaacttaccgatgaggacacacggtgtccttgtgcaatgtctatacgtcgcactccatctttaccgtgatttcagcacgaagtttttcccccaccttctgcagaaatggcacatccatcctaggtgttgtttatttcactgaagaggtagataaagttaggccatgtaaacaagaaaattattagcgtataattaattgatttttaattattcaaatttaaaaaataaatttatgtaatatttcaaaatgacttctatataaaagtttttgcatacaatgcaccattttacagttaaaatacgtgctaataaaaatcgaggtaaaatctgtgttttaatcagaacaactcactagactaaaaacagctatagagaggaggaaaaagaaaaaaaaaagaagaaatctatccaccacaaaagcatcacaagttgtctcctgtctttgtacaagaggggtttgcgatatatttcgcgggacaaagagacattggagactttatgttctctttccccaacttggccaagtggggttcaacatgtcggcgtaggataggaaatgcgatgtagtcctgtgtggc

SEQ ID NO: 40149 - DNA, 4548 bp, Oryza sativa
cgatcgacaacaaggccaagattagcttcatgtatgaaacttgatgattcatagatgagggacgttaaatgtactctttccatctttcgatgagtgtgggatgggtgggccgtgatgggcttttaggtcaatctgctagcaaattactacggtttcagcccaatacatataaatgacttagggctggttttgtttgaagctaaaacttatcacaccaaaatattggtatttttaacggtaattttggcaatgtttggtttgctgccaatactacacaaaatgttgtcaaaatggtgatgctagcaaaaacttgtctatgttttgtattgccaatattttagcatggttataaccaagcaagcctttgtagattttgagctcctcggatcgtattgtatgtgctagtagcccaccaccaccactactactaccacttatacagtagtcataagagtatgtaggccccatttgtttctgattatgatgcacattttagctcggtttttattagcatattttttaaaccgctaaactttacatttcatatgaaaatgttctaattgctataaaataccaaataagtcattttttaatttttataacaattaaaacttaattaattatacgctcttacgttaccctacttaattctcatcttcgtctgttttatcaatttagccatagtgcaatactcagtactcaatcatttctattataattgtagttgtgagtttatgtagttcactcctagtactctccgtcctaaaaaaacaaaccatgggttttcgtgtccaacgtttgactgtccgtattatatgaatttttttataattagtatttttatttttgttagatgataaatcataattaatactttatgtgtgacttgtctttttaaattttttttcatgattttttaaaataaaacggacggttaaacgttggacacggaaactcacttttttttttcgacggagggagtactctctaagccgagtccatgtgcgcgttcgctgacacacgtctccaacgcaaaaaatggagtactcctaccggtagaaatgtacagtactcgcagctactcctgcgatactgcgaggtagcgaaacgccatcgtacgcacgcgccggtcgggcggccgatcaggaggaggcgcgacaggatgggacgcgacgcgacgctcgcgcacctcggcacctgtatatccggtggtcggcccgtgcagccaccgcgagcgtcctgggaattcttaaacgttgccacgtctctcggacaagatgggaataaaatttttttagtctctatcatattcagaatatttcgacactaattataaatattaaacgtaaactattaataaaacatattctatatcttgaactaattcgcgagacgaatctattaagcctaattaatccatgagtagcctatgtagtgctacagtaaacatgcgctaattatagattaactaggcttaaaaaaatttgtcacgtgaattagctctcgtttatgtaattagttttataagtagtacttcctccattcctaaatgtttgacgtcgttgacttttttaaatatgtttgatcgttcgtcttattcaaaaaatttaagtaattattaattctttttctatcatttaatttattgttaaatatacttttatgtatacatatagttttacatatttcacaaaagtttttcaataagacgaatggtcaaacatattttaaaaagttaacggcttcaaacatttagggaatgagggagtatatgtttaatactctaaattcatccgatatgacatgggactaaaatttagtccctgatttaaacaacatctcattgcaacgatgttactactactcctgctgtaggagtactcggcatggcatatgcagtttgctctttgtcttgcaaacctggatggcctcctccatcgttgtgcaatcggtgctgcacacaactcactctgccgcgtcctgctcctgcatgaggtctgggagtgggagggagaggctgctgctgccgctgctgctgcagaggctgcagctgaagaccgggcactcaggggaatctgggcggttggcctcctctgccggtggcagccacagccacaggagtgcagccgcaaactgacaatttcctgcactccactccactgatccacagcatcagccagccgttgcccagtccaacccctgcactttgcactgcatctgcatctccatctgcatgccacgccacgacgtgcctgctgcttggcttggcttggcttctgttgccgtttctctctgctgctgcgacttgccaaacccaaaccccagagacagagagagagaagagagagctgtgagattggttgtatcggactttgtcagttgggcaggagcatatctgtacgagttgatgcctctccttccttgtgtttcatggcgtgccctgcgactccagactagctctacagtagtagtactgccctccctcttgtctgtctcccggcccagcacgttcagatcatttcagttaccactcgagtaagagcaagtttaatagtatccagccacatgctctaaatcatctatagttaatttaatagctaataaatacaatagttacctataacatatagtacacaattaatacatagtttttcttatcatacgcacatgtatcttggagcccatgctacagctggctataaatctatagcccgctgctcttctctctcttcttttatctttttaaaatatatttataactggtttgtagtctgctattaattgtacctgctctaataatcatagatcaacgttccttctatacgccgcttttaacaatacacagcgtacactacaggagtattactcatgtactccagttcaccattctgcatttgtcttctcctgctctggtgcccggttaactggcctaatgtattcctatggaaactaaacgacatgcactgctaaatcaatcgtggcatatctaatggagttcaattacttccacggactaaggccataatattttctgattgagacgtagatttcatcttgatattttagcatatgttttttagactcctatatatacaatgagttttagtaaaaacattctatataaaagatggaataaaaaattttaaagtctaatcatacattaataagttatctcgttttagtcacgctaaaattctactattatctttatcgaaacgtacgcttgcggagtacgcgcgggatgaatgtgggcaaaacacgcgattcacggtacacgtaatagccactcctcatggttgatgtatgtctattcgatcactttgagtactgacccctgatcactacttcgattctgacccggcaccccttccaatcgcatactacaccctacccaccgtgtactaatcgcggttgctctattaattcaaaacgagttttacacggtgctctgcaatatttcccatgtgattatatatatagcattttggcaagtgaataaaattgttctcttctcaaacacgtaaaaggtttgtacgtcaattcattaccaatagtaaaaagcaccatcagacccatcatttcggcgtacttgtaaacggaaaataatttgtgaataaaacttttatatacgtgtcttagcgatctaaaagcaaaaactgaaaataaatttcgatgaaaaaaaccccgaaatcaactctggatttaacgatcaaatattcaaattttagctgataaatataagcataagcaaaaagataaacccacaattctatagaaagagtagtaggagactaaaaataatgtggtattacttgtaatacacccatcatgttgttgtgatgggcttagttagcactaaactaatgacattgattgcattggcaatcaggcactgacacaaggatccgtatcctttgtcctatagtgcagtactcctagagaggtgaaggagagaagagaatcaaacactgatcagccatagctgccgcaacattctgcagcaacccaaccaacaaacccaccctccgctttgactggcggtttcatttcagcaaccctgcaagccgcaacgctttttgtcgccttcccaagaatagaagtccggaccattcaaacccagtccagtctccctctctgccacctgcccccacctgtccctgctgccacactgcgccgcgacgccatcggagagcagctcggagctcagagatgcttcttgtacatgtcctctcgctccatctcttccacttccacccaccttgtcttcttcctccacctcctactacttatttgcctcatcaccgagaacgccagtgccaagcttctttgtcttgttgcgtttcttgaatcttcatctcttcttttcttttctggtaatggaggtggcggaggggaggacggtggcggcggcggcggcaggtggtggaggattgggaggaggggcgaggacggaggcggaggggttggcgtgcccgaggtgcgagtccaccaacaccaagttctgctactacaacaactacaacctggcgcagccgcgccacttctgca

SEQ ID NO: 40150 - DNA, 16527 bp, Oryza sativa
tgccgctgcgacagtggaccccgaccgccgcctgctcgacctcggcggcagcttcacctcgctgctcgcgccggcccagctgcacaacggccacttcaccaccggcttcctgctgggcaccatgtcgtcggcgccgccgccgccgccgccgccggccacttctacaccgtctcccgcgccggccgcacacccgccggtgtcggacagcatctgggccatggggtggccgcacctctccatctaggatcgtcgtcgtcgtcgtcgagctctgatcaccattggcaacaactcgccactaatctagccatcactcccaagtttcatctggtgtgttcgtagttgcaccaaaagttatcttttttgagaggtttcggcccagtagaagaagtcattagcatagtgttaatcgcctaggttaagtaatcaaagagggttaattaggagggtttactcgaattaagatggttgatgcatgatagccatgtcaatccgtgtcgtctcttgtatcaaagcttcagagcttgggctatgaacatgatccatggtggtttttaattaattgccgtcccttttttttttttgtcgtggttgagatgatgcatgcagttcatttcgatctttgaatccatggaattccggtttactgcttgcgttgaatgctgattgcctcaggccttcgagcccatcagttggcctaataagccaaagcaaatatcaaaatgatgtcaaaatattaaaatttgaatttttaacttgattttaaatttgattttaagatattttcaatgtatttttttattgttgacttttaaatcgctacgaataaatatataaaagttttaccatgaattaatttatactctctaataaaatggcttattagaaaatatggacaacctatacgactttttcaatattgttaccactagattatttttggatgattttcttaagtttggggttagacttgtttgatgtacagggcaaaaaccgcgattcaaatctgggccggatcactagtatagattgcggcccagactgcatatggactaaaaatccttccaaaaaaaaaaaaaacagcacgagctgcgctatcttggtttggttcaaacagcacgatgattttagtggctttgttggcgcgagttgggtggtttcccgcgctcgtagcgtggcaatgttgcagcgtgacgagtcaaccaaaaatagcttgggggtctcgaatcgtaccgcactttagccgcaaacggccgaccgactcgactcctccctccatttcgactcggggctccggccggcctcttcttcttccggtgagccaccgacaattcgattcttacatttcgtgatcgatcgattgatttcgtgttgtaatcttgcgtgatcgatcatggtgtgtcaattaatggcaagggcgtggtcatggagccccagcccggctcgccggagaccgccgagctgcccgcgcctatggtgctagagccgccgccgccgccgtcagatgaggcggcggcggaggaggaggaggccggcgttaagcctgataggcaatcatcttcatcgtcttcgtcgtcgtcgtcggaggaggagaaggaggtgtccaaggacgtcgcggtagagaccagcgtcgtcgtcccgtcggtggtcgccgcctcgccggacgatgaggccgccgccgtcgcttccggtgacggcggggacgttatcaaacacgacgatgaggccgtggtcagaccggacgattgggcatcgtggccgcagcagccggctcagaccgtcgacgacgtagcggcggcggcgacgacgacgccgcaggcggcgccggagatccagacgatgtcgctgcagccggcggcggtggcggggttcgatccggagaggatccccaagtccatcttccaggcgaagcccccggggtcgtcgtcgcaggcggagtggagcgtggcgtcgaacgagtcgctgttcagcatccaccacggcgcccggccgtccggcgacctctgcggcttctacgccggcgagagcaggtcgcatttcgactacttctacgacgaggccatggccggcgccgccggcgaccacacgtcggactggaagctggccaccgtcgccgaagggtcgcctggtggcagcgcgcggtcggacgccaccgacggcggcggcggcgcggccaagcaaaaggcggccatcgacttccgccgccacgagagcggctccgccggcagctcgagcaacttctccttcgccttccccatgtacgccgccgacgacgccattgtcgtcctcttcatcatcatcatcacgagaaagaaaactaacccccctcatctccattgcagattggcggagacgacgacgtcgccgaggaagagggactacggcgggatgtaccatccgctgaagaaggaggcggagcagcagcaggcggcgtcgccggcgtcggcgttcgaggagatgacgccggaggaggagcggcggcggcggcggagctggtggtgctgctgctgcggcgagtgctgcggctgctgctggttcgcctgctcgtggtcgtcgtgctgctgctgctgccggtggcggtggtgcagccgctgcagctgcagctgcccaaccttctgccgccgcaactagtgcctctctgctcctgaccaagacatttttggcgggaaaagatgaagggaaaaaaccgagaccaactcggctaatcctgatacagccatagttaaattaattattgctaccagattaggcatcactgcatgagaggatcatatcatatgtatgcatgtgcagatgggtaaaaagatgaagatgatattgttcactgttgacaaggaaatgttatgctaacctgcagatgggctgaggtaacaaacaatatcctggtatccaagagaaaagtacatattctaatgtaggagtatataattccaacattaagtaggatgtacaagcacagaaaacaaccaaaagttagttatcttggcacatttgcgcacagttgctatgggcaaacaaagccctatgagcaaattgagcatccatctgctcaccaacattaatcagtactactagcaatagcaagcctaacagaataacagcttgcaatactttagaagaggctactatgttaacaaaaggtgcgagatgtagtgttagtcctgtcacatgtgatcctttatcttcatgttgatgcacatatgcagggattagttccaggtaccccactgccatctgatccccggataccttagcgtccaaactgatgtcgcggcttggcggatatcatcgctggagtcggcatggaaaagaatggtcacctcgcaagatggagcacagttattaaacaagggtgcaagatgaggaacatccttcaatggcggtagatgaaacaggagtctcctcaaacagcttctaaactggttgctggtgcataacatcaggcaatgcgtcatttcacatgaaaaccgaggggccaacttgacttcgctgatgccggcaaacagctgaagaagatactcgggcttcactgcttcaaaaagttcatatttgtttgtagaagtgggcagctcaagctctaatgtagtgatatcatgattctctgcaaatacttgcaagagggactttagatccaatgactctatccgcagatttttcaaactcacaaggccatcggcttggacatttggtccaagtttatcaactgttaacttcagagtaaacatggatggggtatccaaaatgagcatatctggtcgaacacatttcagctcaagacgaaccaagttaggcgcacggattgttaatgaccgtggaacatttgatacctcccagtggcaagtctttagttgatgaaggtgaatcttagggtccttgagccctccaactccaataagattgaggatctgaaggcaagggaagcactcattcaatttgttgagatcctcatcatctaatctaatgaactcaagtgtcagatgagtcagattaggcattatctttagcccgtcaacggatagccatgcgttcttcagacgcaatttcaaaagactatgacctgcatgtatagccgaagtttcaatctgagaccataccaaggtggaccaaattgactgttgaaatatcaagaactggatgacatataaagtgtatgcacatttactatgcattccagcatcaggtaagcaagatcaagttttcacatgataatgttatgagtacaatagattctactacttgtttctcatcgttcatggccatctttttattcaaacttccaaagtgggctggtgattggcgagcagcaagaataagctaaattttcggaggataataagccacactttcttaagcattatgcacaagtgaaatacaattgcacacacaaactaaaatctaatataagagcaacaggtttaaccataaatttcctttgtgcaagcatttgcttatgtgagaagctaactctaccacgagattttcaaacaaacagagcaatgatatcatcacaacaaggaacatgaaacaagcagtaaaaaaatgcagagataagagagaattacagaagtgggagatgacaggaagcgcctccgccttccgccagcacgactgcggccagtagtcggcgacgtccacctcccggagagcgttgccggcggcggtgtccgcccacgccaccacggcctcccgggccgtgaggtggaggtcgccgccctcgtcgaactccccctcctccacccacgtcgcgtcgtccgggtggccccacccctcggacgcgtcgagctcgagggagcggaggtgcggcccgaggagggacgcggcgttcccggcggccgctcggatggcggagccgccggggggcccgcccccgccccctccggcgagggcgacggagcggcgccgtgcgagcgcggcggcgcggaggtggacacgggagcaggcgtaggaggcggcgaggaaggcccgcgaggcgaggcagtacgccgcgatgtcggccccgtcggcgacgcggccgaggacgtcggcggcgatcgccgccggtagagaatcgaaggggtcgccgccgtctgctgacatgtgtagcccgctttgccttctcagtttctcatatgttcggctcacggagaaaacgaattccccccgtttttaaatatacgttattattaattttttatatgacttttattgattgtcctatttaaaatttaataaaaatacaacataagaaatgatatatatacagggttcaatttttcgttttcagcgtttctattggaaggtgccgatacacctttcggaagttttggtccgaaattttaaacaaaatttagtcaaatttaatcaaaatattaccacattcacagtaaatgaaaaaaaattaaaaatattgaccgaaattatatcatatggggaggggggggtggggtttcgaatagaacctttccagaattttgaacatgtacatatagtcttttaataagatgaaggggcatgaatggtcaattgtcatatccaaaagagctggtaaatactacatatgtctcaaaaaatagaaatatttggtaatgaatatggataaattcttgtccagataaaagttggtgtattttgaatggaaacatccgtttgttaatatttttatgtgcatatgttcactctttttatgtcctcttatggattgtagagttttgaacaggtatgcaaaatatatacataatcgcatctctaatttttttctagttatttccgtatagaactgttatccaacactatatggactcaagattgaatacgagaaaatatatagtatccaaatctccttttcttttttagttcatatattcagttattcacacttcaggaagaaaaaggtttgcgataaaacgtacatctattaaacttgttacttttactcagtaaatagtctactacaccaatttactccgtaccaacaattaaattataaaatcatccatatagtgataaaaggatactctgacatagaaatttatcatattgagcggtgctagcattacttcctcaaacaaaaaaaacaatcctgagtactttcgtagtatcaatcaatttatcaatgacacagtgattcgtgtatcttctgtataatgagtttgtaccttaaagcttcactaatttatcaatctggaaatttaggggattcgacaaaaaaaaaatgcatactttctcaaactatcctgcattttgcttctaattttgctccctacaaaagtttcaaaaactcttcggtatagccatcagtgatagtttgagaatttagcattagctacaaattttcacacaagaaaagatctgacaacatttcattgacgcatgggtagctccaatcacaattgaggatgaggaactacatcaactttggtagtttggttgcctcttcccatctgcttgttctttaagagaacctctcttctcttccgcatgagatatgtcaattgaagaactcattcagctaagctgcgtcctccacaactataaaacccaatgtgggagtttcagtaaatgaatactctatatcttgtaaaaacaccaacaacatggctttgcagactgcgatccaatttccgacctgcaagtctaccataaaagagaaataaaaacaggtttctcaatcaggtgtgcatcacgcaagtgttcatcatctatactactattaaaagaaagtagtggtggtgctgagtcttcaaccatcactgacatgtgggacaagatattgggatttgggtgagtatagtcgaactgcagctctttaattttctaagcatagcatttttgtttgttctttaagatgaaaggtcttgtttcaaccaattaaaaatattttcaacaaggacttaattttgctatttttaataatccgttgcgatcaaagggcatttggctagtattggaaatgccagaacaaatacatcagtatgcaacttcgtgctttatatcacaaaggtgaaaagaatgttcttttccagtatatgaaaatctctgcaatcaaaggacaaaggacaacagtaaatatagagcaaaaggcataaataatcacctagttgtcaggaaatgagggcaagatgaagcatttgaaatccttgtggtttcttttggatgaacagaactgacaatcaacacagctccagcacgcagatacattcgatatgaggagtgtgggggaacatatctacaggtattacagtcttcagctcgtagcatcctttcaaatctttttcctcctgtagacaaattaagtatttaattgaagtggctatgcactaagaactaaaataatatgaagtaatgggtatcttcaataataggacaaaaacataccacaccatgacataagtaatccaaatcccgtgcacaggtagctggattacatgaaacgtacactattcgaggggctttaacttctagtagccacttgattagcttcatatgcatccctggccgattaggatctgcaaatttaatgatgtctattaggatctagcaaagcagtgaaagcattgtagattctactcatcagggataactcgaattgctacaaaaaatatgtactaacagatatgtgccaagacaaacctgatatgattatgtcaggtttcggaaattccttcccaaatgtttcattgattttattaaggtctccctgaacaaatgtagcattgctgataccattcagcttagcgttctttttagcatctgcaatggcttcaggaactacttcatatccatagacatgctttgccctggtcaaatcagaagaacatctactaatcatgcttttcaataaatgggtaaccgaatgacgaatgctcaaagttttgtgctaagacttgaaacaaatgaaaaaaaatggcctcacatagtagcaactgctctccaacagcatgataatagtgagaaaatttaccttctagcaagggtaagaccaatggttccggttccacagaacaagtcaaggataatctcagagccatctcccttaagcccagcagattccccaataagcttgtacagaacatcagcctgcagtacatgcaaccatgcaggaaaaactgttggaaatgctcaagcactagacaccaaaattttagcataacgtggaaataactgatacatgaactggaatgtaagtcacatgacatagatatgtcaatacttcgaacctaacagagcattaacaaacctgttttgtattagtctggaaaaaggagttggcagatatctggaatgtaagtcctctcaacatctctgtaatggttggtttcccatacaaggtatattcttcttcccccacagatgtattgccaacagacgtattcacattattcatgatactgacctacatcaacactacaggcatatcaatattgtaggaagaagtaattaattatttatttggcttaaaacccaacgggatttctgtacagtagaactctgagtgacataatagtcagtacatgaaaagtattttaaacattacactgttcgacatagtacacttaaaatgagaaggcaccaattacataccacttctggtatttttgtgatattgttaacaagaggctccaatagctctggcttataacatgatgtgacaaaattaaccatgacttctggagctccagtggtgatatttctggaaaattaacaaaaaaccaatgttcaaaagtgttcatcatgcaaaaaaaaaaggtaagaaaagaaatgttcaattggtaacaaaaggttaaaaatttatttgtttggggagggaaacaacatgacttgtttggtcatccctgtcctatcaaataaatttacttttaactgaacaattatagagaatgtgtttgtagaccgagatatttggcagcagctaatgaagccaaatgcactaacttcagtaacatgtttaaataccaaaatgatgctgtaccaatgatcgaaagatttgctctgttgtaaaagaagttcatcaatatcctagtgctagaaatatagtgcccatgactgtaaaccgaataacatctgcatgcactatagtctttatagatatactgctacatggtaaaaatgcaggagggcatcatacattcataggtggaactcacaatcagataggacaccataccttccagttcttatcataagatgtttgagaaatccaacatgcttgtgcacatcataaggtgtgagaccaagagctggatccaaccatgtttcttgaacaatggcaagaacctgtaaaaattagcagataataaattaaacatcaaaaggaaagtcctcagaaccactctgctcactagtttgacaattgcttccaactccaaataattagcacgatggtccaggcaatgtatctgtgtacgtacttaaactgactctcaatatgtgtagctttatgcggcatgacacaagcaatttagcttttaaataattatcatgttacacagttctacttatatcattttgtgacaatcataaacaataccatcctagcaacacaagtgaatagtgtttgtttgtccaaagtatgttattccaatgcacaatctcgttaattggtgtcaacagcatgctgcctaagctgctcttgttgggaagttatacaaaggatgtgttgccaatgcaacttcaagctagccaaccaaatctaactataaatgttaaatagtggtgatgctgcaaccaccaagtaacacaattcaacaaaatctaaattttaaatctacaacaaaatggacataatccaatacatcattattgaccttttcttttttaccttatctgccggctcgctctgcagcaagcatttctcgacatgcagcaccttgtcgaagaaccctggcgcgtgcaatccaagcgaatagccatcaccttcaactttttcctccttcaccacctcatcatccttctcctccttccactctctttgcatccatctctttgttccaaaagagaactccatctggaaacaagagaaaaaacaactcatcttttgcgccaaaaaccccctcctaaaccctcctaaacccccacaccagaaattcaccttgttcctgtaccgaaatatctcgtcgcacggcacgatgggtttcaagatagcatcgggctccgagctctccatcttccggggatcgaacttgccaaagttcacgagcagctcgcggacctggaggtgcttgtggcggatctgcgcggcgtacgcgagggactgggccttgcagccgccgcagtcggcggcgagcgggcatggcgcgtcgacggcgtcgcggtggggctcgagcgtccggagcttggcggcctcggcgaaggcgccccggcggatgcggcggacgcgggcgaggaggcgctccccggggagcgcgccgtcgcagagcaggacgaaggtggagccgtccaccctgcagacgcccttccccttgaacgcgagcccctcgcatgtcagctcgagcacctcgttgcgcttcgggaagtagcccttgcggggcgggggaggcggcgaggtggtgggggtaggcgcggggggttccggggagagggcggccgcgacggcgagaaggcggcggccgcggtggtgaagcgggaggcggcggcggagcggggagaaggcggcggcggcggcggcggcggccgtggccatgagggcggcgggtggtggcgcggttcggatggagaatggacggtggagatggcgcggagggagagaaaaccgacgatgatgctggtgtcaccggtggtaaggtgctctgtccaagagggcccacttgacagaatcacagaagtcacattatggccatgaaccctgctgtttagcaaaatcattactactcggagtactaccttttgaaatggggaatcttttcaaatactccaatttggattgtttaacgtgaagattccatgaagttacttgctcaagttttggtcacgctttctagaaacctctgctccctccatctcaaaatataataatttttaactctagaatttatcccaaaaatataacaatttatccaccaacattatcttcccaaccaatcgcaaccctccaccattcatttttcccagttcccacctacctccactactcatttaatcacaaccctacaccattcacttctatctactttcttaataacggtatccaattctaaaacttcttatattttgggacggatggagtaagtgagtttgagaggagaggaaaagagaagattgagaagatacgcaaaacgagatgagctattagcgtatgattaattaaacttcaaaattagattaatatgtttttttaagtaactttcgtatagatttttttttgcaaaaaatacaccgtttagtagttcgggaagcgtgcgcgcagaaaaacaaacaaactttctcacaatctccttgggccgaacgcagtagatttatcactaaataaactatcgtaaaacttcttagatttctcactatcgatcatgtgagaatgatgttactagatttatcactaaataaactattgtaatatgctacaccgtttattaaaaataattctctccctcccttcccatacgcatgcacgccagcgacgacaaccgaacgggagaggtggtggcagaggcggagagggtggagcgggagggtgtggtggcggcttgtcaaccaccatggcgtcgcagccacgctcgtcaccttcgtcgacatcaaacgcccatgtcgcacactctgctgcggtgtcctcgttgtctcatcctgcgtcgccaccgccatgctgctagcggtttccctcgatgaccacctcactgatgccgccatggagacggtctacactccctcctgcaccttcgtgtgctgctccggagctattgtttgtgcacaccttcggcgccgacctttccctttgcttcttccccgtgacggttggttggtctgcaatggcgttgtcgtagcgattcttggacggccacaatagccacgtcctacttgcagtagctcaccatcgccgacacgttggctcgtatcctgaggcgatgtcgctgctcggatttgacatcgtggagaaaggggaggacgacggcagtggccgctctacctgctcaccatgtgctgcttatgtgtcaaggtgtgggctggagcggaccgtcctcgcggctgtgcaaatccggcagctcagcgaaggatccatgctgcggcggagaaggaagagaccgggagattggccgctgctcctttcccgtgggccaccgcacgtcgctcctcttccacaggtcaccgtgcgccgctacctcttctcccgtcggccgcctgcgtgacgcgccctgtcccctcgccgatgaagagccggaggaaatggaggtagagaggggagatgtggaggaagtgggactcactaactattttttaaccttattagtatttgcctgacatgtgggtccagatattttgttttattttttaaattgttaaattttacttcatgtgccacgtaaatgcaatgtcagatgaagaccgagtcaaattagccatgtagataccacgtcagctgaaaccgcccttcaagccgtcttaagacttgttagagcaggtacaatagatgcttcaagccggtgatagctgtccaccgtggcttaaaaaactgagttaaaagcaaaagatgaagagagagagagattcagccgacgactaaattatcgtcaactcctcacgagctccaagacagtgcaaagcttcagtgattggctagcaaataggtgagcagcagttggccttgctatatgcaaatgaagaacgtgcaatgcaataaataaaatgaaaagtaatattcagaaatgtgtttactgcagcttacttttgtataatacgtctctaattatggctgtagatgacatgggattttttggagccaatagctagctatattattgaccttgctcttattttgcacctattttatattttaacagttgagaaacccgctgtatccgtttttccgattgaacgacgaaattcgaaattcggttttcgtaaaaaagaaacctgcctattacctgcgcactgaaacctccgaagacccacggcccgcacatcagcccagcaaggcccacgccacgccgcgtccgggattaccatcctactccttcctttgctcaacctaattttcaaaaagcacatttacacgtagacccctagaacaccacccacctcgcaaatccgtcccccatccccctcgtcgtcctcctccctctacttgtatccagcgcccgccaacgccaagccaccacaaaggcaaacgcaaccgaccaccaccacctccacctccgatccacccacgccgcgggaaaccctagcgccccgtcgacgacgccctccacctggtgcacgcgcgcggggtggcggcggggggcggagggacggacggcaccgcgcggtagagggagagcgggagcgggagcgcgcgcgtcgcaccggtggccgagccgggccgagctgcgtcgcggtggtgctcttccgcgggcggcgagattcagccctgatccgaggaaggtgaggggaattcttcgtcggggtgggggtttggtgcaatctgtgggggtgagatgcggtgcggggggatgaagaaggcttttcggggtttgggatgtcgcggggatttgggggcggtgggtggtttttcggctgggaattcgcggatttcgcggctgctcgtggtgttcccgtggtttttacgagcagatgtatgcttgatctcgtgcggctttcccctctctctctctctctccatggtttgctcgcgttggggggtttcgaaaatttttcctctagtgttagtcctcgagagaagagtagtggatgtggatggggggaattgagaactgcgaggtgcggctttgggtgggtggtttgttttctccttctccccccgagcagatgcttgcttcgtctgcttggatttcaggatttctggaagacgatttggtttccctccccaagttcatcgcgcaaggcgttcttctgctgcgaatctgtctgttttttttttggtgcgccgtgatccccgatgcgacgcttaccggatttcatctctggtagtatcccttaagatcgtggcttcgattttgcttggccttcccctcctcctccttgacttgtgctgcggcggcgtgggacttttgggggttcttcactgtagcttctccggttggcgtcatacaccacctttacctcgctaatcgggtctctaattaggtatctgctgcagagaattttcatttcccaccatatttctcatctcgtggttggggatccgtaattccgttatctactcactggcttgtctaacttgttccatgcaatgctttgaaccaacacgagtgtttgtttggttattgttggttctgcaaagtccaggctttcgctatgacttgtcccctggaaaggtctatttacttggatgtggactgagcggcaattttatatttcttgatgtttggatttgttggcatgtcaaatatagcttatgtgtaaatttcgatgatttttggctatatttataatgttctactcagagtttatgtgaagattttaccaaagtttcttgcttttctactggctgcccggaatctttttctttatgaagtccttgtcacagttgatgacttgcttaatctgattactaaatgggccgcatcatgagttttgttttaatctgacccttgtttaaatttcgtacttggacaattgacattctctttgcagcctggcattagtttagtttgcaaagtcttattttgcattattagagttaggatgtgaaacttagaagctagattaatataacttactaggagtaatatagttcatgttttagttttcgttgtagtctatagtccaatgtatatatgctacactaattattgtgttagtgagctttctttgtttttttgttttttttgggaaacatagtgttagtgagctttctctctcacttgcagcaatatttgttgggcctcaagtcaaggaagtctttttctctctaaaacaagccaaggaaaatttccatgggtccagcaaaaggttctcgcacaattaccaagatcacaataaaggggtatgacgatcgacagcatgacgaggatccaaatagttcaagcaaggttaaactaaaagtaagatgaattgatactttttagatgacacccagtaattgtagtctcttaaaatatcatccaactcagcaacaatgtgtagacatgatctttttccgtttcactaaaatgttttgattttgcagaagagaaaaatgtcagatttaggtcctcaatggagcaaggatgagcttatgcgcttttatgaagcctaccgtcgacatggaaaaaactggaaaaaggtttgctattcaattttccgaccaccattttttgtgttcatgtttcattggtgtctttggtgccaaagtaagaaagttgtttgttgactctgcaggtcagtgcatctgtgggtggaaaatcagcagatacagtagaagccctttacagtgtgcaccgggtgagtttgtgttctataattaatatgccctagctatttgcgaactttaccaccttgcatcctctacagtttacttggttttgtgaactaaagttgataatttgctcatctagaagactagaacaggacagtatattgatgatatattatttatgcagaagttcaagaatatttagttataatatataattcaccttgcagccatgcctagataaatgtaataggttaaatttgataatagaacctaaagtatttacacattgccatttcttgctgtagactttcttatctcttccagaacgtgaaggtactgccatgggatttgttgcattggtaactggtcatcacaatgtttcggtaagcttatgatgggtttacttgttgaatgttttattgagtatgcttctggtttctggatatgccaaatttcagttgtttctttttgagagttttcaatcatgtgcgaatatttgtactatttgaagctaccatgcataggtcagtttcgttatagcaaaaggccaagtgtgagcactcctgatcattgtggttcttttggatttagttataatttttattataacagtttttgccatatgatgatgcaattagtatattgtgacataagaataactatatcatgatgatggacgttactaacattgaaagaacaagctaacagccaatctagagtgcgttgactattgatagtggtgattgttttgcatttcctacatcacagtctctgaagaatgatgagtaccaatgctttgttcttcttatgttcgattctgaattaacctatttactgcaaggtctgaattatctgaatcgacatacaaattgccctactttttccttaaatcacttgaaattcttaaaatagcaggatgaatccaagagtcataaaggaagtgatcaaacagttagagcatctgggaaggtacggaaacgtgaagctacagggcagaaagagaaggaagc

SEQ ID NO: 40151 - DNA, 1651 bp, Oryza sativa
taaactaaccagagcacctaactacaatttgttatgtttaattacccccccaaaagtgcaaccatatatggcaacaaggagacatcatacattcccgaaatctgccatccattttctagtgctaccatcccctgggatgcttatggtgctgacatgggggtaaccacttaatttttgtcaatgatttgctgatgcttttcaatcaggcacggcggaatatttaaatatacaacatgtcaatttcccaaaaccgtcgaagaggttccgtggttttctcttttcttctgccaaagctgatttgcaaaaccaccgcggtgtttccattcttgtgccaattccagctgctaggttttgaagcttttctggttttcaattaggttcagtgttgtaataaagtttcgtactccttaatgacaggtttggtccaagtaagctactccatcgattttaaattaattatcattttaattttatcctaagtcaaacgatatatctttgaccaattattataaattcgtatagttaacaacatgaaatatatttcttttagtgaatctaaaaacatgaattttatgatattaaactataggaatttcgataaactaataaagctataatgacaagcaatttgaaatggagggagtagttatacgctgcattttccaagcatgcaaacaatatttcaatgttgagaaattttacggttcaagtagtaccggaggcatcacattacactataaatgtaatgcgagggtcatcggttcaaatccgatagtcggcttttttctctatcaatattccatgaacaaaaatacctctttttctctgaattaaatggagaagccaggatctattatgtcgttctaccctacaattttgctagatacaaaacaataaaataaataatatatatacaaaaattcagatgttgatgaaattccatttttttgtggtacttttagtagattttactctgtgttggctcaatccgaaggaaattatgcggaagctttgcaaaattattatgaagctacgcgactagaaattgatccctatgatcgaagttatatactctataacataggccttatacacacaaacaatggagagcacacaaaggctttggaatattatttccgggcactagaacgaaaccccttcttaccacaagcttttaataatatggccgtgatctgtcattacgtgcgactatctccactatagaaagaaaaataagaaaggatcaaattttctaatatttactagaaaagggtgctttctacatagggatcgtcaaaacaacgattttaccctatcagctgtaggaagaaaggacacttcacgagaatcaaaataggaagaaagaaagtatggcctatactactctatggatagagttctcaaacggactttcccaaacacaaaatacctccttgtattcgtactctcaaatgagagtggaagaaattcgactttcatataatatcttaatagaattccatgtaatgatcaatgtattttttggattctatattattcgcatgtctagaatcctaccaagagaataccccccatttttatgtaattgaagtaggattgacgaataagaaataaacataatactgtttattagtgtcgcataaaacccgaa

SEQ ID NO: 40152 - DNA, 6142 bp, Oryza sativa
agctagcatcccaaggtggaattagtggagatgaagaaggactaaaatgctcttattgaaaaaaatagtaaaagtgataggtaggtaaagggtattgaagaaataaaacttctcgttttacacactgagagtaggtaggacaaaattcatactctagaagttgagttttttttacggagggagtatatcttatggtactaaactatataagtttatagaaactgataggtaaagtttgaaatgtttgacataaaagaaacctaaaacgataaataatttgaaatggatggagtactgtattttcatgggaaatggagcttgtagactagtagaaatagagtctcgatttaaacctgaattttgaatagaaaatggcccacgcaatagtgtaccaatagtaagctagagaaacccaaggtaaatatggttgaagttgaaagtgtaccaaacacaaccttgtacaaaactgcgtgcggtgcataattaatcaagccggtgatgccaagcgtgcaccgacaaccagtttgtttcttattttaagaaaatcaacacggtcgtctcagatcgcatgtttgatccgtgttataattaattaaggggttagctagctcattaattaacaaccgcttgtttgcatgattgttgcatcccctgtacaatatactccaactttatcatattttaacaaaacaattagtagtattacttagtactaaggcactagtagtaattatataccatcagatatatagacagtactttgatggacttaagcattaattaagacatagtagtacttaaaaagatgtaatgatcttaaacgagctcatcggctggcgcggctcgttttgaacatgagtttgagctggcctaactgtttagaataaaggtcacatccacgttgacaagtcagaaaagggtaaaaggcagctgcgcggccaagattgcaatcaaattaaggttaaaactggataaactctcccaggctccctcaaaaatcatacagtactatttcagtggctgcaatgttttaatttctagtagcaattataagtggatacgatgttcggtttcaaaaaaaaaaagtggatacgatgttatatacagtagtgttcctgtctgaatagcgattttttttttgaaataatgaatagcgacttttccgacctgttttggcgcatgatgccaattcaattggtgtcaccggagtaggttccaaagtttacctccccagaattattgtaacaccactaatgtatgtgaacacacatgtttttatagactcgttagaatttctactagtatgacgaagctagaaattcttgtgggaaaatgtccgttttgagaatatacgttcataagtctggaaacaatcctaactaccggaagaaaaaagggtgaatgttaaatagacttaacgcctttattaattaatatttattattacaaaaaggcacgcatggtagttgaagaagaaatcagtgtagaaagcgaagactaaattgaggaaggcaagtggtttgaggaatgctacgagcgaaaagatttggagtataaataaacagagagcgatggagccggtcgttccaagctgaagcctccactcacttgctctgcccaccggcgccggcgccgtcgccgccctatcctgtcctacctatggggcacggcctgagctgcagccgcgacaccgacgagtacgacctgttccgcgcggcgcagctgggcgacatccacgccctctccgccctcctcgccgccgaccccgcgctcgcccgccgcgccacagtctacgaccgcttcaccgctcttcacatcgccgccgccaacggccgcctccaggtactgtccatgttgctggatcgcgacggcgacgtggacgtcctgagccgcaagaagcagacgccgctgatggtggcggccatgcgtggcaacaccgagtgcgtggtcaggctcctccgcggcggcgccaacgtcctgaccttcgactcgccgcgcgccaggacgtgcctccaccacgccgcctactacggccacgccgagtgcctgcaggccatcctcggcgccgcggcgcaggcgcagggccccgtggccgcctcctggggtttcgcgcgcttcgtcaacgtgagggacgagcggggcgccacgccgctgcacctggctgcgaggcacgcccgcgcgtcctgcgtgcgcctgctgctcgacaagggcgccatcgtgtcggcgccaaccgccgtctacggattccccgggagcacggctctgcacctggcggcacgcgccggcagcatggagtgcatcagggagctgctggcctggggggcggaccggctccagagggactcggcggggcggatcgcgtacgcggtggcgatgaggcgggggcacagggcgtgcgcggcgctgctgaacccggcggcggcggagcccatagtgtggccgtccccgctcaagttcatcggcgagctggaggcggacgccaaggcacttctggaggcggcgctgatggaggccaacagggagagggagaagaggatcctgcacggcagcgacatcaacatcaagggcggcgacgaggaggaggagagcgaggatgaggaggaggcgtgcaacatctgcttcgagcaggcgtgcagcatggaggtgaaggagtgcgggcaccagatgtgcgcggcgtgcacgctggccatctgctgccacagcaagcccaaccccaagaccctcctcctccacccgcccgcctgccccttctgccgcaccaccatctcccgcctcgtcgtcgccaccaccaactccaacaagaccaacagccgccgccggtcgaggagcagaagcagcagcttcaagggggggctctcgtcggccatggggtcgttttccaggataggccgcggctccgggagattggtggtggacggcagcagcgtaggagagctcgccgacaagcctgaccacgacttctcttctgtcgccgccgctgctgctatttgtgacacatgaccctccctctattcattttttgtgcagttacaccttactagcactagagctttgggtaatcaatcaatcctcccacaagctcaagctaggttattcattatagcaaacaggaattggatattgggattggattgcatttgtattgtcttgtgttgcattcaatttgtagtatatacttgtttttggcttgtcatggtaaataatatttactccctatttattgtacgattatcaaactcatactcaactacactaaatactgcagtagtataacaaggccaacaccagtggatgtgcatggttgcacaaacattgtactagtactaccaaagctatgagatctccatagaggtactatatatcttaatgtttccctacaaatcagcaggtgagtctatcacccacctcacctgtactgtactgtacttaacgctaattacttctctaattagtaccatgaccagggatagctagcatgcatgtgtctcccggcgttggcttttgtatcatgtagagtagtataattaagtttatgaccaagacagatttcctcctgaaaattaaattactggacaaacttgacggtttcacacagaaactgcaatacacaatgtgcaatgcaatcgccaagtgtcaatgcagtgtaagcaacacgttaaagctcatagaccgtacctacttgtgtgcctttccggtgttataaaaattaagaagccttcctccttattacacgttccattaccatcatttgaccagaaagattgatgagccgatcaaacaaagatactgctgcggctgctagccaagccttccatgcataagatggataggaagttgattcagggaaaacttcaccagtcaatttggcttcaggaacgtggtgctagtgcttagaattggaattggaattggaagaggaagaggtcgagtggagtgccaccaacctgttggtctcggacgcacgcacgcacttccacttccacatcaattagttagggaaagggcagtttcaatttccggattacgatagcagccggcaagtacacaagatatttacaaggcttcctcctatcattgagcaatatagtatacaatacaacaacctacaataatattttactgaaagaaagaaagaaatatgtcacctttgctagtggaggcagaggaaaggaaacaagtgtatgtgcaaatcttccaacaaattgcgtgcttagaccggacaacttacctgtcaagaggacaagcagacagcaacacatatgtttgacataatcccaaccaaaccaatggaagaaaaaccggctcaacgccatcaggtgtacttgccagtcttacgttccattccagcttcatctaacaaggacaaacacactctggtcactgccaagttgggcatgccatacccatatagtatggccttgtttggatccttcgggctattaaatagcctgaagcatccaaacagggcctatgtcatcaaactgatagaggcatcaacacggcaagatcttgtcaatatttctatgtttgaacggtcctcaagaggtgcactactactagtgtgtgtcccattcaactggacatactgtatctgagagccccataggggtgggtatattctgcttcaaatcatcggtaaactacaacggcgaagaaccacatgtcagccttcctgatagggttgttcaagaacaacattgaagcatgttgggttgcacggatattcacagtctatttccttcacctctctccgatcaaagaaccagtcgcccaccgcttcagccacagtctgttcaccagaattgaagcagatgtgagtatatgacatgtcattgatcgcagaagcaaatgaatcagcaggactgcaaagaatataaatattggtcgacaaccagtaagttaagtactaccctctgatcagacttgatttcagcattctacatcttgctggcattcagaagccatgacgacattgcaataagactacaccatcaaactctaaaacgatgcaatatctaaccaccaaagtctgtaagttcaaatcctacgggggacatgccaacctatagttctataaacaagatcatatcattccgcatgtgttaccttattgtttattctcgaagcagatggggagtgccaagccaaagacttcatggattggcaatgtataaagcatgaatcaatgaacatgccccagccccttttcttcttgaattcacttatagcatcaagcagtgattttctaaaacctgaaaaaaatatttctcgagatggtaaggtgccaaagtgacagcggatggaaggtaaagtcatccagaaggcatgaagcagtagagcacatgtcatgagtttatcatattacaaccttgtagaatttcaagctgtttcgtattacacttggtaatatccattctgcaatcttgccacagattttgagggtcagatccgtctggagtcaagacatgctctacctgaaaaggacaacaaattttttatcacactaatattggagctgctaacagaacatggaacctgccaacagatacggataatggtacctgccaaacatcatatgctggattgagaataaacattggggtggtgatgcctttcgccacttcttgtgggaaaaagcactacaaggcacgattaaggattgctacttagcacataacagcttgaaaagtactgaataaaaaaggtgatgatattaatacaagaaacagtatcataaaaacaactaaaggattacctgccctggttccatatctgaactacaaccagggaaccgtttccgcaaatcctgcaacaaatcaacagcaaacataagaatcatacaattaaaaaaaaacaaaaaaagggtatacgcagagaaaagtgcagacagcgacctgttgacgagcaacatcattatagaagccccgcatataccttctcccagaaatgtcttccctgtaatgagaaaagttaaaggaacagtaaaatgcaagttttaagggctggctatacttgtgttttgctaatggccaatgccccagaagaagtgataagctatcctatgaatatgttgaccccaaaagtggaagtgtgaattatgggttattgggcacattgttggatgatcagcagtaaacacatg

SEQ ID NO: 40153 - DNA, 3337 bp, Oryza sativa
aattcctgcagccctcccttcgctaacttgcaagtactgtaaatgaatggttaaaataatatgaaacacattaaaatgaggagatcaaaagatcaaagcataaaaatcataaaagtgggtgtaaatcatccacaataagggcttaaagagattggttgtcagctacaggtacaagatatagaaaaatgacgaggaacacttgtagtacattattttagaggaatattgtggcgatcaggtgagcatgatcaataattgacagggctttgcaagtgaagacaacattcatgctgaaagtgaattattttccctgtatcaatacatattctagtgtggtgcgtaaaagcagccagaccgatccaatactgcgacaaacaataagatactagtaattcataagtcaaaaggttctagcagtgagtatgaataataatcgggcatcctattttaattggaaggaagaggaaacctgtttagcacgggctagacccttgggtagaagttcagccatgacggcctcccagatgcgctggcctctgaagaagaaagtggcgccatactgtagagaatgacggcgcagtacagtagaacaagtaagaaaatgtggtgaagtgaagtggggagtgtagggtatggtgactagtacagtgtataggaataggaggttggttggtgcaaataaacctggtgttcatcttggacatttccagataaggaggcaccatcacaatacctgatcttgaccttgttccagttgtaaaaatctgcatcactatgtatgtgtgaagtgaagtactccaatagcaagtagtagtaagtagaagtgcaaagaggtgagagagagcgattggatttgacctgggttctgggccttgtcgtcgctcaggatgccgacgaactcgacccgggtttccatgtaagcagatgagccaagactggttttcttgcgatgatcacaggacgtgcgattcctgcaccagctcccgccctctaggtggaggagccatttgttagatccgtcgccgaagcctggcagccagtggtacccaggcggggtcccgtcgaggcagacagcgcccttctccttggcgccgtggactagggtgaggtcgacgagcgtggggaggcggtggccgtaggacggggaaggggaaggggtgccgagcgagcgggggtgtacgaggaggaggaagaggagggcgacggcgaggagcacaagggcgaatgcggcggcgtggcggagaaggcggcggcggtggagcgccggcgcggagaagagaggcggcatgactgagactagttgttgttgttggatctgttgaggattccgtcgtcgtcatttctaatttctaaagccagcgggatccaggatccgggatgtatacaataataatcgcaaatgtagtacaaaaataaataatctcgctggtcttctcttccttcgccgactgatcgaagcgccgccgcctcctaagccaccgccgccgtctcctccagtccctccgcctctgatatcctcccttacagatggggccagccgcttggtggagctgaagcccaatcacatgaatgtattccttctgaccctttccttttttttctttttcaaaatttgatatcgtacatctaaaatgttgtccacctcttaaaccaaaacggtttattataaaatataaattaatttatacgtaaaacttttatatatttattaagaaagatttgggaaataccatcacaaatatacatgagttgcaagataccattatacgtgacaatgatatgtggggcttcaatgacacatacgatgatttttccaatttcgtgattggccctatttattcttagcaagttaaaagtcaaatataaaaaaactacgttgaaaatatatttaaattaatttcaaattaagattaaaaattcaaatttgcttttgctcattaggcctaccgatggagccatgaaattttggttatttgctggtggacatttatcccattaaaacgagctatggaatcgtctcgtttctcccgaccagttggattgcttctgcctcatcccttcttgtcgtccacgccgccatctccttggtcatccgcaacaacgaggagctcgagaagctgctgtctgggggtgaccatcgcccatggcggagtgctgcccaacatcaacctggtgctcctcccaaagagggccgcggagaaggccaacaaggaggccaagtcgccaaagaagaaccccgccaccgccaagtcccccaagaaggccgtcgccgccgccgagtagagtagagtagagtagagtagagtagagtagagtctgaatcgggtttcttcttcttctgctgtatgtaatgctgccgttagatctgatagtggtggggtggtattggtcctagctttgtactccttgcattccttggctaatggaagttccttccttacttttgctcccacatctgtcttgttcttggaaacgcattccgtgttctatttctgcaaaacgggattcttatgtgcttgcttgctacgtccggagtccctggactagcagtaacactgtgcttgagattgttggattggacaatttattaacagtctctgtccgagtccaaaatatgtggatttcacagggttccgattgtcaaaaacgacccgcttctcaaatcagtatttgattcggggatagatctagggtttaaagccaatgctgaataggagaccaaagctggtgccttacgcggcgactcccttcgggattctgtcccatccttcatctactgcccgtgcccgtgcctcttcctcctcctgccgctccaaactcttcattggcggtgcaaatttcctgcctacctgcttcgaattcgatatacattattgtgcaaacattgtctttggttgaattagtgttagctctaattcgctgcaaccacgcaagcctagtgctaatacttgtaccgctctgtcttgttttgatttgcaggtctttcttacgatacaaatgagactgctctcaaggatgctttctctcagcatggccatattattcaaggtacatctcaaaccatctgttcctttccgatgctatcaggtttctgaatctgtgtgtgtgaaccgacagcgtcctctccctgattgattaatgtgttgtgcagtgaaggtaatatgccacccagtgacagggaaatccaaagggtatggctttgtcaagtttgcctcagaagatgaagctgctgcagcattgcacaagatggggggtgaggtaggtttgctctcttgtggtgctagacaggcacaagtcaggatgttttgctataatatgcattactggggtgcaggaa

SEQ ID NO: 40154 - DNA, 7585 bp, Oryza sativa
  unsure (1)..(7585): unsure at all n locations
tgctcattctatgcaccagtaaacgcgaagcctattatgggcatatcaattaacaaggaagctcgtacttcttgatgcacacatgattcatccaaaatttccaaagcatgtcatattttgctcaatcagttattcatatcacatatatgagctgggaaaagaatatttatcggtcgggcgtactgccatcaaggctacaaattatctatagtaagaaagaatggtattatatacgtatataatgcaatgtgtccatgttttttcgtcaacatcttccagcagtgacaaggcacctcctatctgcgtaggccctcaaggatgtaagtagcatatagatccctgtagaacaaaaaccagctcaatatttggcgttgcatatcgcccaaggaacatatgtaggaattgaaactcacatggaatggcgtatggtctcataagcagaagtggcaggcatgaagtcgttgacagccacctccttattctcattcttcttgtctattttaccccattaaagaaaatactcaattcaagaagatagtagcactgtctaagtacatgtacatgcactaagtggccaagatgcagtaatcaacgaacttctgcgagagatacaattactaggcatccatccaaaaacacaaaccatatatgttccttgtcctttcaaacttgagaagctacaaataattcatactgcagtgataaataaggcaatgggaagctagctgagcttgtttcagtagagttccatgaatattttatgctctatgaatgcaaatagaacaagtacattaagagcaataaattaaaaggatacagtcctcgaagaaacgcctgatttcagctaagcggtgaggtgggaggtccttgatatcgttgtaatgcttgtactcaggatcatcagcacagactgcaataatcttatcatctgcctctccctggataaaaccttaccactttagaatctgttcattcattctgaagaaagcgcacttgttgagtagggaccaaacctgatcgatcattggcatgacaccgatggcctttgcccgtaggaagcatcctgggataactggctcctgtgtgcagtaaacattagttcaaaaccaccagatacgcaggaaaagggatcaattgttaaggattacaaaaatagacttgatagtggatttattctattgtgttgtgtaacaagtttcagtgaagggaccatgtatggatgggctatacctagatgaaagacttattgtattctgatttagcaacgtgcaaggaaatacacacctgcattatgaccagcacatccaaaggatcactatcgtcgcacagcgtgcgaggaatgaacccatagttgtgaggatagacgactgaagagtagagaactcggtctacctgagcatgttgcatggtacagaaaaggaaacataagcttaggaaaactgcaagtgcagaagaagatgagtgaaacatgtatctttacttttacgagcccggttttcttatcaagttcatacttgaccttgctgcctctcggtatttcgatgacctgaaaacaaaagtggctgagtattgctttgtcacataatgtggctttgtgagacagaacatgggtgggttgttgagtcagtgtcaagatggccatcatcagaagactgaatatacatagctagcaggttttgcatgccatccgcatgaactgtatggtgtagttaaacaagaacatttaagtgatgagagaatcggcaaaggcaagcagcagtgtcttacacagttgaagatggtgggtgcctcaggtcctgcaagcaaagcaaaggagggaaaatgatgaatttttgaacctaagaaatataatagaaatctgaagggtaagcgtgtaccccaagggaattatcactactagtaancgaaatactccaaagtgaggtggttgacagcagttagtagagtagagtagagaatagagttacgagtattttaccaatctcaaggtcatgccatgggtgtgctgcaacagatctcttgacatggatgagagtatcctctcattgagagctggtgccttcccctcgcgggtggaggagctcgcggtggtcgcgacttggagagggggagccatggaaatggaatattgaatcaaatcttaaatggagcttgctgttgctcgatgaaacaagcctgcatgacatagatgaaccaaatcaaacagagtactatgaatgaagtaaggaaggcaggaaatgacttactagtaagttgcaggctagcataggcatagcatggacaaaataaattaagaaaaagaaaacaaagccgagcagatcatactaggaactctaggagtagtattattacgtagagaggggatgggggcagagaaggttgcagacgcaccaagttgagacgttgtgtgttgtgttgctgcttggattggatgagcttgatctcctaattaggctgtgtcaggacagggaagaagaagatcagatggaagcaagcatgcaatggatggtttgtctactctggcggtttttatagagaggcagaggcagaggcaggcctaaaagtgttgagtaattgctgagtcagcatgggaagacggttggaagagagaatgatcgatcgatctatctatctatctatctatctatcttcctttccttccttacctacagggcagggcgagagagagagaccaagtctagtcagttgaatatgtatgtatcggaagttgggacagagctgtattgtatagaaactgaagttgtatgcatgtactgtatgcactgcacgtccgtccgtctgcgattaattgacctggaatcagtcgtccccgtggatctgtgctatgctatgccgcatactatcatactactagttgtatgaagtatgaaccgattaattgggttgggttggcttgttcaagcagtagctgtgtgcattgcagtttctacttagagagcgagcagtttacccgatcaacatgtcggccaccacggcatccaaatgaagaagatgtcaagatccattgttccaggccaggcccagtgttaaatgttactccaatgtttgcgcgttgaaccgtaccgtagtaggaggaaggaaggagaaggacatgaattaatcgatccaaaaccaaaatgtaaatctaatggaaggtgtgagcgagtgagtccatacaagacagtttaatactcctactaataagctgcctgaatccaacaaagcagcaaactacggagtaggagtatgtaagaagcaattcaattaggcaggcaggcgattcatcaaacacgtagtactcgttttcaacgatcattagctactacggagtactactacccatcaagtgatgaagaagaaagtaagtactactgtagaggggaggagctccactactggggtagtacagtaagccctagatgggatggaatggaaggagtagctgcctagctaggagtcggcgccggcgaggtcgtcgtcgtggttggagttggaggggaacttttgcttgaaggcgtcctggcgctgcatccacatcatgtgcccctgccattcaattcaatccatccatccacagatcgatctgagtgagtctgagagagagagagagcagccaccgcgcgccaccatggatgggatgggagtaggtgatactgatacctggagcgcggcagcccagacgaggaggaaggaggcgacccagaacctcttctccttcaccaccctcctcatcgtccccatcttcttcaattccaccccttccttccttcccccttgttcttcgatctcgatccgatctgatctattccaccccacccttcctgaagaaacaagacatttctctctctctggcaagtttggaattggaagtgtggggaatcaaagaattgggctgacgagccttgttcggcccatgcatacagattcattgttgttaaaaggaaggaaaaaggtacacccaaggtcccttaacttgtcatcgagataaaaaacatcctcgaaccgcaaaaccagatatgcggagtccctcagctgtacaaaactggtcacctgaggtccctcggtggttttcagcccggttttatctgacgtggtggctgaatcagcataggactcacgtgggccccacatgtcagacagtccacgtcatcacctttctctcccctcttttctcacctcctctctctctctctcttcttcttgggcagggcggccggcaagcggggaggaggccggcgggccggcgttgcgaggcaggagaggaggtgcggcaaccggcggaggcggcgggagcacagggggaggcgaagggggagcatggggagggccagctgcctgtctgccccgacaccgccgtggcggcgcgggccgtcgtggttgacgatgagcttggccctgatcgatggcagcgtcgatggaggcgaacaccgagaggaggaagacaagagaggggaggagacatgctccgttgccgctctcccctgctggccgccggccgcgccgttcacctctggtccccccccctgcccgctgcccgtcttcgccagcgagcgccaccgccgctcttctcccctatcggccgccagtcgcgttgcacgcctcccactcccccccggcctcttgcttcgccccaccctgccctgcccgctcctcgggcgcagcgccgcaccccgctcctccgacgagccgacctaaccgcgcctccccaactccaatgagaacgacatggatgccggcagcgaggaggcgaagcaggagcagcaccgggtgctagcccacaagctcttcctcctctcccaccccgacctcaacgacctcgccaaggttgccctccgctccgacgccctcgacgccgtcaagtccgatggcatggcgctgctatttgagtcgttggccgtcaacggcgtgctggagccggatgacgcgctgctcgtcgagatgcgcgtgcgaatcgatgaggaggtcccccaagccatcgtcgtccgcgcctagctcctcccccgccacccacgcccgccgcaccgaccggccgtgcccagctgcttccccggcggccaacgattcgatccaatccggcgagagagaaagggagaggatgttgctggggtcggcggcgcttcttttctttcttctatcctcttctcttctagtcgccggcagcagatggggagaggcagccgttgtcgcctccgcgcctctcggccttgtcggcagcggcggcgtcgtcctccaccgttgttgccctcctcacgaaggcctcggtggctgacgctgcggctggtgcccgccgccgctccgccggccaccgccctttttccgcgcggcctcgagcgcgtgtgtcgttgtcgggtgcagcgacgtaggtggaggcggaggctgacgctgcggctggtgcccactgtcccttctctgcccagcctcgcgcctgtgcgccatcgtcgtcatcggtgcggtggtggagcttggtcatcgacgtgccccgcctcgcccgcacagagaagacagagagaggaggaagggagagaggggaaaagagaggtgacgacgtgtcacctgacaagtgggtccacgcttactcagctgccacctagaccaaaaccggggtcaaaaccacagaaggacctcgggtgactggttttgtagagtcaaaggaccccgcatatctggttttgtggttcgatgatgttttttaatcccgatgacaagttaagggaccttcggtgtactttttcctaaaaggaaacctgcattactccagtatacgtaaagtaaagagtcgcttcccctggctccaagcctccaacaccaccatctttgtttcattaaaaaaaaaacagcaccatatatattctcaggcatcaataagatcatccacagttaaatcccccacaatccattccatgaagacctacatactcctttctcatgcctttcttttcttttaacaaaggaaaaggataatcaattggaatacatgttatcgccatgccatcaattcctcctaattcatcgacggaacaaaggcgaaaaataaccaaagtcttaattttgatgcattcgattgctggctggtacgttgtggttggtaagctgagtgctagtacgaagcatcatttgctatgcgtcggtactcaggcatgtgctgggtgacaatcatctgacattgattgattcccttaagttaataaaagacgagattacacagatgtttttatacgtgtgttccatcgttttcgttttcgttttcacaccaactgatcgaatcgcgcgctcaaacgaacaaactaacttgttgaaatgaaaaaaaaagggaaataaaataactaactagtgtagtactagtaacagaagaaacattttggtatcattcgatggatgagttgcctgacaagagcattagcttagcttagcttagcttgctgatcccctcctctatgatctgatctgatctgtctccgggctgtccatgcgcgccgccgtcgatttggcgtgcagctgttgcctcctcgggacgccatcctgatccaccacgccaagcctactactctgtcccctgcaattcaattcaataatataatcaagagggattaatttgttgatcaaattaattaactagtaatgtgttacgcagtatatgtaaataaaaaaaactggtacctgtgggcattgcaagaggatgatctcctgagggtgaggtcgatagggtgggtggttgtgttgttgtccagcaagcttccactgaagtagtcacggtggtccatgatgtccggcttgttgttatgccaagcagtagcacggcagcgttgtgattgtgcttggccctgcagctccttgatggaggaggcgccgcacgagatgagcttcatcagcatcgccgacgtccgcatccgccctgccggtgtcgtcgccgcttgttgctggggcgtgcagccatcctcctcctgttgcttctgcttcagggtaacaagctgggtggtggtgtcgtcggggctgcttgaagacggtggaggtgatatctcatcaatgccaattaaggactgctgcgccgccgccgggacagggacagggtcggtggtgcggtgatagtcggcgaggtcaaaggatgtcatgcacctcctgtgctgcgggggcgtattggagttatggtggagcagcggggagcccttgaggacatactcctcatggttggttgatggcgcggggatgaggtcgtcggcggtgaggtcttgccagacgtagccggcgttcctcctgtaggtggtcttggcggaccaggagtaggcggcgggcatggcggcgccgcggaggtcgctgaggcgggcgatgaagtcgcggaggtggaggcgcggccgcggatgatcggagtcggagtcggaggggacgtggacgtggacgaaatgggggtgatccagctgcccgtcttgccggcacaggtagtacaccacgcccaccacaacctgcttcatctgcttcttcttgagctccgtcctccacaccatcgtccgctcggggctagcccaaccattaccatcacctgacctgctatgacgactaggatttgccatcaaccaacactaccgtgggg

SEQ ID NO: 40155 - DNA, 9778 bp, Oryza sativa
aagctagctagctaatccatcattctctctctctctctctctatatgcaactctctccgtcgctcaaacgcgttcgatagccggaatattttgggagtaaaaacaagtgtgaagaaggtagtcagcagttcacatgacgcatcacgaccacacaagccacatgcatcaatggccgtccgtctactatactagtactagtcaattccactccacgcgctcccatcactacacatgcatatgtacgggcggcacaaccggtcaaacatactacacttagtccacacctactactactccctagtactacagatactccatgcagaccagtgggtccagtcatcaatccgagtcaaacttgacaactggatggtcaactaacttcccatcatgtgtgtccctctcttttagcgggccgcggagcccatcaaccatgcatctgggctaatttatcctcaccacattaaccaaccgctacctagccctatcaggaattttttttattaaaagttttacaaaaataattttcaattttgaaaattgacataagtagtcgcccgccaccctctgggaaaaatcgccctcccagagggcggcaaatgtgacgtggcagacggccgttcgctctcgggcgacggccgtcaacgaaatttgcaagcggcccccttgccgccctccgctagggcgattttacactgtgcggggggccgcctgtaaatgggtggcgggggactggaattttgcacgcggcccccttgctgccctgggggagggcgattttatactatgctttatttgagaaatatatttttttattaatatcaatagttatcaaatctttttgtattgaaaattgcacgcggcccccttgccgccctgggggagggcgattttatactatgctttatttgagaaatatattttttttattaatatcaatagttatcaaatctttttgtattgaaaattgcacgcggcccccttgccaccctgggggagggcgattttatactatgctttatttgagaaatatatttttttttattaatatcaatagttatcaaatctttttgtattgaaaactatacaagattaaaatctccaagattggtaaaatacaattttattatttttttagggcctatttgaattgttaccctacaaattttttggtagtgccaaaatataggcaagttttggcactgccaaatctttggtaaggtaaaattgcatttgatcatatttggtttgctaccaaaatagagccaaaatgtaaaattgtagtgaagaatgttctacatgatcccaaatctagattaggtattaccaatgaataggcttcaatccaaatcaaacacaagtactattcaaattaccaaaatattagtagggcatgtttttggtagcaatccaaataggcccttagtcttacgcatacaaaaattcaccaccataattaaacattgtaatgataagatagataagaagtgccatcgatacacggtacaaatttgttgatcccgacgaatctagcctgcggtaacctatcggccccttctaggtcggtcagaatgcattgcattctcgtggtccttcaatcgttgatactctacttgtgtttctgactctgttatcttctggccatgatatgatggagtgacattgtcgatctatcgagtaaatccacacatccttggattgccctgaaaaaatagtaatgttattcagtttgggtagaaattttgtgcaaatcatagcggattttggaaacggttagacatacaacgaaatcgttgtctacattggggaagacaaaatatctccttccaaatgtttgttcagcaaaggatgtagccacctggcagcgatctctgcacccacactttggacgctcggaccatttaggtaaccctaatggattgttcctccaatctaagcttgcaatttccacccgatgttcgtactccatccaagcatgaatgaactatgtggtcggttcaggttgcgttatcggcccgccactggaagtaactcggactttgtcaatccattgtacgaattgacatttccttacatcctcttatgtacatccattttgggatagttaagttaatgatagtactgaggagtgatgaaaagaatagttgtaattaccacgaaatcatcgtcgacaatgtttggacacatgaaacacctttgtcctcgagttcggtgccttacggaccttatgacctgacaacggtcaccacaacgacactctggacgctcacgccacgtggggagtcctaggggatttacctgccattctaaagcctcagcagcaattcgacattcatgctcatccttccgccttaggtagtccgatcttgtttcactacgtgggtatgcacgtgttccgtcgttttgtgggttctccatgtctacccactcgatgaagttgcacattggacgatatgtctgcgtaagatgttacaattgtgtacgaagaagttagtttttttatccatttgaactttgaatagatgaatcatacctgatcaaagttcgcacattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattctcgttagttgtgtgctagttggaaagaagatatgaagaggttgccttcagattgtcaattatatagcatcgttttcagtgcaatatatgtgcactcaatgagatacattattcattagatgtgacaagacgagcacgcgcgggcgtgattcactttatgtcagcaggcagcgccgaaagttgatagtgactactcgagctgccgcttttcatgtgtgccgtgctggactgtgcgcgctactggatctgacactaccgtgaagcgccgaaagtgtgttgtcgtgagcataagttgttctagcaccatatgaatgaaaagaactatgtaggcgagagaaacacaagtagtactgcagtagtaatagcaaaagtagtattgctttacaagtttgtaagccaaaagaaacggtcacataaggactgaagaggtagaacactactgacgagacctcttacccctgtccctcctaccctgcgccctaacgtgcccctgggagtacgtgagtcggtccggtggtatggcacggccaacccgtcctgcctgtacaggtgtgacctctggctgctcctgagtgtgcacctctggagctcctccaagctgagaggagcctagtacgttgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagcatttcagtaattacccacatattaaattaatcattaaatggtctgtttttaatattgttaaatactttgggtgtccaagtatgttcaagatttttcttggaattatttgagcataggaagtatttttaaaaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcgacactgtttatcttctacctctagcagccgaactgagaccgatttggctcggtttttctcctccaaatctgacctttccccttgtgtttttctaaaatttagttgaggggaaatattcctcttatcctcctctatctttacccccaaaaatcggtgcaaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtcgccgtcatcgccgtaaggtgcgccgaggtgtgggcaagctcggccgctatctccccgaagccgccgaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcatgtcctccaaagtcgcagccgaccatccaatctccggcgaggtcgccatcttggtccggccattgatgaggtcatcatcatgacgtcatcattgtttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtctttttctttgttttgcgtgttagcttgtcgtttccgtcgttgcgaaggttcgtgagtgcgccggaagtattcaagaagattaattgaagatcgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgtgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtcacctctggagctcctccaagctgagaggagcctagtacgtcgtggtggtgcgcaccgtgcaagtcgtcgtcatagaaatggctagtaggaccagacctaccggcgtgagacgaagaggcaccagtacccaagatcccggctgcaaatcctgctggacaaggaccatcagtttcatacaggtatttaatagtattaataaaaattaaagtaccatgtgggcgagggatcgacgctccgtgagaggaagagctggcgaacgcgcccgaagaggtggcgaacgcgccggaagtgctggcgaatgcccctgcagagctcgcggaagcgccagtcgtgcctgcgaacgcgctcgaaggcagacgaggtcctgcgatgatgaaacgtgcagttaaaacgtggtgacgtattcgtgcaaaagctgaaacaaaaatgaactaacctctgggctgagctgtaccgtgcgaaaccggtgctgtaggtcgcactgctccgacgctaggggcgctcgaaggcaaacgaggtcctgcgaggatggaacatcaagttacgacggggtgatgttttcgtacaaaaacagaaacaaaacttaagaaacctctgggctgagcagtactgtacgaaaccggtgccataggtcgaggttctgctccgacggtaggtgcgcgaggccgtggttgtactggaccagctggaggtacaatgtccacggcgctgcgacaggagaagacgcgcatgaccgcacgcatcttctcctgcatccggtcgaaggtcatcctctgctcaacgtcagtcaagtgcaaacctctgttcaacctcacttggactgcggtgatatcggcactgatatctcgtgcggcatcggcctatgcaagatggaaataaaaaattcagtaattgtcctatattatgcaagataattgaaataattgtaagaactaatacaaattcgacgtacccccacgaagtagtctcggtcatggtgcatgggatacgcgtccgtgacagcggcaacgtgcggctctggggcgtctggagtgaaggtcacacacgcacgagtgcgaggaaggtaccggcgaaggtagtcacggtagttctcctctgtgtgtgggaagagctcgttgatcacctcctctgtagctaacacccagtcgtcaacgtactgttgtacacgtggagcccaaagtgcgcctgctagctgtccctgtcgagtcaacttgtgaagagaggtaaattatatggctcgatgaagtaattagcataaaaattttgaaatgaaccatccgaactcacgagtggtcggcagggaggacggtcggctgcacgttgcccggaaacacctgcctcagtccgaactgtctcatcacacactgcgggcagtgaggctcgacgaaaatgtcgaacaccatcggcaggatggggagccagtaagcctggtcgcatgtgcacaaggacgaaagtcctagcggtgctctcgcagcgacggcctcttctgtgtacggctcccagatgacgtcgctcggctggagacggtcaaactcaaacacaaagtccgggtaacctcgtctcacctggacgtgagcgtaacgacgctgcaataaacatgatcggaattagacatgttatgtgatgataaaaaaagaagacgattgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcaaccagcgaagatcgctcccgcgtcggtcttcgtgcacgcctcacagagggcacggtacatggctactagcacggcagaaccctagctccactgcggcacgtcctgtggctgagcatccgcgatggaccgtgcgtagtggaccagccggcagtccacagcgtgcccgtgggtgctagtgaacatcacccacccgaacaaccacaacaggtacgcctcaagggagcgtcggaccgagtaatcatcagcgtcagggtgcagaaggtccgtctacaattaagaatgaaatgttagtacaaaacaatctgttgatcgcaaaataagcatgtatgataataacaagttatttacttacagtgaactgaagcaaccaagccttgctaggcccgacggtagagttagggggaagggtgtcggccggtcctaggtgtggaaggcgcatcacgtgctcgaagcgcgcggtgatatcctccttccacccaaaaacaccgtccacgggaccaactggggctcctgccagtggtagcccgagcaggtacgacacgtcctgcagtgtcggagccatcttcccacagggaaggtggaacgtgtgcgtctcaggtctccagcggtctaccagagtggcaaggagtgaccggtctgcatcccaccgcttcgctgggtcacggtcgtccgccgccgcctcaacaagcctacaaagttggtagaaggcctgccgcacgcaacctgcatagagcaaactttaaacataagtacaagacaaagcaaagttgagttgaaatgtgaacatacgcgttccaaggaatgtgacgggggtcgacacgcaaccactcgcgcgacgtgcgtggacggaaggtgccgagctgtgcaccctcgactgatgacaggaacgagcagtggctcctgtcaatcccacggttgaacagcgccggtgtgtcgtacgccatacctacatccaatagatcgatcagaaacataaaaataattagttcaacataagtaataaatgttcataagtaaattactaacacatattaaacaagagtacaaacaaacaaaagtgtcacaatacggaatatttctgattacaataataactgcagttacacgatatgagtacttagtccgaacactcatcacgataacattatgatacaacaccgaataattcacaatactactagtacaacaatagtcagaggtactcattacaacaacattcaattgaaattacacgatagaagtatttagtccgaacactcatcacatcacaatagcattttatttcctaaatcgatagcattgttacaccatggaatcgcctgctgcaagacgacgccttggccttgcgcgcctgcttgttgttccttcaccaagtggtcgccttccatcacttgcctgtccagatggactagcatccgcgccgcttggaacttctgcattcttcgggcatttcttgtaagtatggccacgcagatcacacttgctgcagcgtaaagtcctcccacctgcttctgactcatccatatcatttctgatgcgtctagtttggcgtcaaccctttttcacccttaacttagatggatctggaatataaaaaactttgccactcagcgttgtgtaagatcctgagatcccgaacccatatatctcctcactccatgtatgaaagattgcttctttcctgaaataatttgagacgtaca

SEQ ID NO: 40156 - DNA, 8006 bp, Oryza sativa
gcttgcgatagataccacgcctgctcctatcaacacaaattatttcataccgatgcacttgtgtgccttgagcaacaactctatgtctccgtgcctttttgattttatcttccatgtactttgtcactacgttgccaaacactatgttgtatcggccatggacggaccaattttcttgtatcgatccctaaagtaggcttgcgtgccgtgaaggatgaattcaacaatagcaaccaatggaagtacccgaactcctcgcattacccagttgtacacatctgccaaattggttgtcattatgccataccgagatcaatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcgtctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacattaggccacttagctggaagtcccttctcatcccaaccgttctgcaagtagtcaatagcccgcaacatacccgcatgacaatcatgtataaggcaaacgttgggcctcatacgcaccactgcaatgtgcactctctctaggaaccagtaccagctttcagtgttcccactctctacaaatgcaaaagccataggtagaacctggttgttcccatcacacccaattgctgtcaatatctgacctcggtatttacctgtcaaaaaagttccatctatgcatagaacaggtggtcaatgcacaaaagcattgatgcaagcacccaatgagaaaaaggctctttgcagcacactctttattcgatcatcaaccgatgtaaatgtatgtaggtcatagtaagtattattattcctctgggcaatggtggctaatagacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcattggtgctcggtcacaatgctaactttccaataatcattccatttacccttttatgcatggacacgccacggacaatcttccttcatgcacctcacttcatacacataatttgttgacttgaccaccctaaactctctctgcaaggaaactgcccaatgcttcaccgcctccttcatctcatccttatgagcatacctagcacccttaattacctcgttctccttatactcccagggtacatgatcaccctctgatataacaagtccagagaagtcctcatttgcccaatcagtggccattacatcaccttcctcattggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatatttctcttgtaccgacacaaatataacgaggggccatgaccgttcaaaagccatttccacataccgtctccaagcaacagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataattacgttaacctcgcatttctgtactacaccctaagttacattctctacaatattgttctccaaaattctaaaagtaggttacgttctccagatcaaactaaactacatcttacaattaacactactatctatgtctcaattcatactattatattctgtgctctggatctacacatgtgtgctgtgtgctatagatctgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgtcctcccctctctctctttcgttttttttggatttttagtgaatataatgaaatttgagagaggggggacggggctatataggggggaggcaaaaatcgccctcccccagggcggcaagggggccgcctacaaaattccaggccccccgccgcccatttgcaggcggccccccacacaatgcaaaattgccctcccccagggcggcaagggggccgcctgcaaatttcgttgatggccgtcgcccgagagcgaacggccgtctgccacgtcacattcgccgccctctgggagaaatcaccctcccagagggcggcaggcgactacttctgtcaattttcgaaatagaaaattatttttgtaaaacttttaataaaaaaaattaaaaataaaaaaaattcccttatctgcaggttacagcgagtaagcgacactactattctactataatgtatgcatgcttaattccaaacaagtgtactagtagtatttatttactaaacgagcataaacttcttttttcaaaataaatataattatgcttgacagttgttgtcgattgacaaacacttttaccaaagggtaagtttcacttgattatgtgtaaaaggtaaatggtaaatgtaataatctctccaaaattgtatcccctattacataacccttaagagtttatttatagcttgcatatctgggtttagaactctaagtagggatgaaaacggagcggatacggacggataatgctcataccatattcattttcatattttttaccggatacgaaaacgaatacggatagctcgaatacggaaacaaatacggattatctcgaatacgaataagaatcgaatatgatcggacacgaatacggaaacaaatttttctcggaacacgaaaaccaactcaacttctaatataaataaatatcaacatatataattagctcattttatataaaatgaggtataatttataaatattttttaaaatttaaataatattaatagtatggactagtgttaagagataaactactattaaaatctataaatgtatattgaaggttatagagttagaaagaaatggggtatgtctcatgggtcctgcggatatccgaatagcactgttcaccggatatccgaattattatccgtatccgacggaaaccctgatattatattcgtattcgtatccgggagaaaatatccgtattcgtatccgtatccgaaatatccgagaattatccgatccgaaaggtatccgtatccgtttttgtccggagcggacggaaactatccgctccgttttcatccctaactctaaggtactgttagtgagtttacacaaccgtctttgtgacatgtatgtttataagggtaatactagtcttttggcccaacctaccggcccactggccctaaaggtctcccctcctgggctgcttattgggcttccttgaacggacattttctcatactgtaaaattacatcaaattttagtatcctctagtaaaatttatctaaaagttttttttaagcataacttatattttgtgtttatagaaccttttgaataatgttaaaaattaatagcgtcatatattagaaaacggaggaagtaatcatcatcgatgattcatgtatactattcttttcatcattttaattaacggtgaatatcagaatatagacggtcctctaatccaaatcggccatcactgacgatgatggatggtgctaattaattaaatctttaaaatgtccacatatatatgacgtcgtagggcacgatagtgacatctatcgcagtgaatataattgtgacgacgctttgtcaaaaaaaaaaaaaggttgtgacgactccgatcaatgtaatggtggagtatatatgacagatgggcacgcatggagagacatatcatatgtttgtgtatcttgcgtcagcttccactgatatagtattatgtttaggagatggattttcattcatcgagagatatccctcgcttttttgtcataaaaacaatttttaaaaattgaactatatatttgtacgtagagtcatatatatatatgtctcgttaatttatcttgtccattcttttttttttgactgaaaacatatttccatcatgtcatctaaatagtcataaaaaatttaaaaaatttaaagttacatgtgtacggagtgatatgtctcatactaatctatcttctcaattctttttaaattattttgatggaaaagctaaaaaccatcgatagtttttatcgatttcacacatatttcacgcaccacacgcctggaccaactaaggaatgaacattttctgatttgaattgaaattacactttaattaccttgtaattatactataattacatgcaagttatattgtaattatgtttgacaatttttttttaaaaaaaactatgggtataattttagatgcacccttttttggactgtctatgtagtatttgacaaaaagaacccctaaaaaatctcacaatttttcaaccgtcatattgctttaatatttgtgtgcacctacctaatgaaacataacctaccattcctcatctcctctcccccttagcggccccacgacacgagcttgagtacttgatgccgctgccgccacctagcctcaatggcttgcgggaaggcgtcaacggcgcggcgagccccaccggctggcttctcccccttacctccctccctttcctccctctcctactcaagctggtgtctccccgtcatcggatccatcacaacagctgcccataaactagctttgcccttgccaccaacaccggcccatcaccctcctccatccccatggctccagtgccgccgccaccacctcatcatctgcccgtgtccaccgcccaccgtcggcccgcgtcatccctctaagctcagtgatctccctcctcttcccctagccccccctctcctcatccaaccctcaccctaacacgggaccctaaaccttaactcttctaccttcgttggggttgctgaagctggcggagctagggaagaaggtgttgtcagagcttgaggaggagaactgggatcgccggagcatgaatcataaagcaagtatcaaggttagtaatttgtaagattttggctccccaaatctatcgtcagctatttagctattttttattgattattttaaggtgacatgaggatatggtgagagggatgaaaatactttcccttaaatgtatcgatcgatggctaggaaatatgaagtattttctctatctcaaaataagttaatttagtatgggatgcgacatctgttagtactacttcctctgtcaaaactaacctcatattaggatgtaaacatttgtatgtccagatttgttgcactagtatgtatgacgttgactgtttttttaaggacggagggggtacgtactactagctagctagatgccgacggatgatgatggattggaaaggcaagtaagctggagtaggtggtactagctagctaggtgtgccacgcactcgcactgcacggagtagtactgctgctgcagagaggcgcacgacgactataaaaggagagtgcaggtatcttcctatagtagctagctaattgtattatactagcttgcttgttcaattcaatcgagcagtagctaattgcatagtgatcgatcgatctgtatagatggtggtggccggcaagaagcagggacggcattctttttctgcatcatcatcgtcgtcttcgtcttcttcttgttcagtagtgcagctgggtcatcatcagcgcccacagggtgaggaccctctcatcggcatcaaagcagcagcagcaggaggaggaggaataatgagaaagggcccgtggacggagcaggaggacgtgcagttggtttggttcgtgcggctgctgggcgaacggcggtgggatttcttagcaaaggtgtcaggtttgcgcggcggcgggtgatgagcatatgcgtgcgtgcatctaatctatcgattaattgttgatgatgtcgatcagatggatggatgcatgcatatgccgtacatagtagatttgatgatagtaactgacataaatataatgtatgcgtgcgatcaacgctggttgttggatcgtccgtcgtgtgtatgggtggtgtgtggctgatgcaggtttgcagcgcagcgggaagagctgccgtctccggtgggtgaactacctgcatccagggctgaagcgagggaggatgagccccgaggaggagaggatggtggtgcagctccacgccaagctcggcaacaggtggtctcgcatcgccaagagcattcctggccgcaccgacaacgagatcaagaactactggcgcacccacctgcgcaagctcaagctcaaacagcaaaagcagcagcagtccgacgaccaccacaacgacaacgacgacgacgacgaccgcaactcctcctcctcttcgtcctcctccaacagcaacagcaacctgcagcagcagccgcagccagaggatgagtcgtcggccagtggcagcctgcaggcccaacatcatgaggaccagcaccaactgttccttcatcctctctggaacgacgacatcatcgtcgacgtcgactgctggagcagcagcaccaacgtcgtcgctccgccgccgatgcccgcctcgccgctctgggatatcgatgacgccttcttctgctcggattattcgctacctctctggggatagtatatatcatccatcagccgccaagacgatgacgactacatcaactcgatcgatcgatgcctcctaatcatgtgggagtactcagctcatctcaattgttacatccttgctacagctgctaattactgtaattactagcttgcatatagggatcgacggaggaattaatatatacatgttagtaactcgttctatagcgcaacttgcagttgcatctcaatctctgatcagtactatataaatatatatatatgtaacagctgctagctatagctagctgcgtacacatccatatgaatgtgtgtgtgttcatgcttgtactgcctcttgtagtatatgcacatatacgtgcaagtgcaacagacggctgctggctgatatattttgatcagcgcgccacgtgcacgtgcatacgtttcttcatttctggcaaattcatatgtatcatgttatacactgaactgaatactgtattatgcttcacgtaccattttgtatatatacatatcagataataattttatggtggcttggtatggtaccgagtggaattaacagatgatcatcgttattcttttcgcacgcgcgcgaagcaagcatattagggcagtagagaatctgaatttcgcaaatagcttgcttacacagaatctgaataaatgcattcatgagatgcaaagccaggctgattgaattgatacccgcccgccgcgtgaatcttaat

SEQ ID NO: 40157 - DNA, 2316 bp, Oryza sativa
tagctagctgaaggtcagccactgccactgcccctgcaagttggagaggaaaagagaggccccaattcaactgcttccaagctagatagcttctgataagccacctggtttttattcttttcttttcttttctttctttctttctctccggccggccggcctttaaaaaggagatcgatcatatcgatgacgatccaacaagatgaagagctagctagctagaaggtgccaagattaaagtggtagagcatatagatatcgccgtacgtgataaggagccagcagcagcttggtacctttgtgcaacttgcctaatttgctgtaattctctcatattacctagcattatcctgatgattagtttactccaactagctagatagtgcttcatcaccatgtagctagcttgcttgctttagtgctgttgtcttgtcttctagcgtgctgatagctaacctcacgcatgcccagcctcatctcatctgatattgatcctcactttcttcttttctgacccccacaatgctagctgctgcttgcaatctcttgcaattttttcttttcttctccttcctgccggcctccaattcgatagctacgtctagcttgacatgggatagggatatgatatatgcactgcacaagaatcttgcggccttcctgtttcttctttttatcacaacatccataaagtcgctttctgtggggaaagatggttgcaaaagtattactactaccctctgtccttcttagcttaagcttagggtcaaatcttctctcatcatatattccaaaaggaagaaagaaaaaacatatggatctagtgacacgcgcactgaaatcatacaggggatttaaggttccttgttttgttgttcacaatatgtgttagtagtttggatgtattttagatatagatagatgcttgttaattagtattccctccgtttcatattataagtcgttttaacttttacccacttgaacttatttagacttgatcgaatttataaaaaaaatagcaatatttacaacatcgaattagtttcatcaaatataatattggatatattttaataatatgtttgttttatattgaaatgttactatatttttctattagtcaaacttataaaagtttggcaaaataaatcaaagtaacctataatatagaacagagggagtagcaagaaagaaaagttcgatatagtgtataccgcaattctgaaactagtatattatgcatgcatgaggataaaagggaggaaatggttctaaacttcgaaggagcgtcccatcgttgtttgctgtgaaaaagctagttaactatttcatctgtttataactagtaatatgtccgtgcattgcaacggatgagatccatataatataggctaggaaggtggattaagatgactagaaaagtggactgaggataaagcactggaggcggtggttacatatacaaaaccgtagaaattaagatgtgtgcgggtggtgagaggaggagataaaaggatgacgactcccttttaaatagtagagatttctcattagtgaacaaaaagctgacgtcttgaggattcagtacatagctgacacttgtgtctctagatgtcttagtgaaagtagaagtgcacttggaacatactataagatgcatccatgataggcagcattgacacagctttcagtgcaaagtcaaacaacatactccatatagctaggctagccctgcatttgctttcttgttccatataatcttacaccttgatgcatcagtggcctatggtctgatcatggcaaaagaaaagtacagtatattccattcccaagcataattcaggttcacctttttctaggcagaaaattaagcgattaataatagttaataagtgtctgacagtaactagctagctagtagatagagactggactgaactaatcgtcaatatatataattgatttgtcagaattaaggagcaaaactggagctgcaggtacatatattacaggtagatgtgggcctatcctaaattctaatttcggtatgcctgtgagtgctgatcaaattaagcacttaaagattactttattgtggtgccatgcacgcagtaagtagctaatcaaaagtgagcagagctgaggaatcagccatcaggcatatcatgatggatggatggatgggttagccttgcatcgatcattcagttaacacttaacacccacaaaggattaattcaggcagacactgattcaacaagaagcaaggcatcagtagagacgacatgcactttagccactaatataattact

SEQ ID NO: 40158 - DNA, 7291 bp, Oryza sativa
ttttcacatatggacgtcctaaggaagctgcttggaaaaaccgatttttacaaccgaccaagcaagaacaccggattgcaattttttttaaaaataaaaataaaaaatcaaatccaaaaccctagccaaggtccccgtaaggctaccgccatcatcgagcaccgccacaacagcctgctgccatcgcgtggtccaatgtcgatgttgttgttgcgtggttgaggtcctcgtcatgctgtcgaggtcgaggtcttcatcgcgcgctcattgacactgcccttgtgcccgatggtgccgtggatccgccgcctccggccaccaggagacggatccgccatggctggagccctctcgactgatcttcctctcccgccatcagaggggtagaggtgtcgccgctaccagatccacgaaatgccatcgtgggtttgccgccttcgggctagcaggagacagatccaccatggctagggccctcctcgatggttcttcccctcccgtcatcgaagagggagatgtgccaccacctatctctgttgtcgtcgtcaccgctgtcggcctccacagtcgccgccaacctctatagcgatcgctcccatagttagccgctcctggcaccaatgctcctgtcattgctcgatggggaagagaggagaagagaaggagaagtgaagggggagagagaagaagtgaaatggattgataaggagaaaagaaagaaaataaataatggggaatggagccggccagtcgtgcctcaattttcacatacaaacctcttaagatgctcgtctgggaaaataatttattattgtagacggatctgttaagagacctacttgtgaaaatttaaaatgtgggccttgatcaaacacctctcgcacatttttataagcgggtattttttttcctccttagtaaaagtaaaagggacctacacatgaaaatcctttttaatagtgcttgccactgcttacgatttttaagatggaggttgttactacttcattgcagggccaggggatccaaaactaattttcttgtttgggaggggcaaaaatgcactatgctgaattaaagagcatgcggttagctatatactagtggacgacatagaaaaaaatttcacgcggttgcaatctccaagtgatatttatcctttactatagttcgaaatgttagtgcacacatgcaatgcactaacaaagctttccttgtcatactagtgttgatccgcttgcgattcttcttgaaaaaaaatgtagcaaaactcatatatatataatgtaaaaatctgaaaactatatccatgtcatctagctagagaaaacttttactctcaatttttttacgcatgattaaatttaagggtaaaattttactcttgataacaagaatatatatagaatgatttacactgtatattttacttccttctagtccatatataactctctgccgtttcgtttcgattggggaggggggggattcccacatagacccatctgaaaatgatcagtgatcgatgcctagttaattatcctattgcaatactgctttcttttcttttgaagatgaagataaagattaaatttttttttgcacaaaacgaggtggtattaacgtatgattgattggattttaattataacaaactagaaaaaagattaattaatatgatattttagagcaactttcatatagaaagttttcgcacaaaacacattatttagcaatttgaaaagcatgccacgaaaatcttaatctttatccaactcttgttggagaaaagaacgggacctaaagtagataattcaaaattaatacatgaattattcattctttaatatgctcgaagatcgaagaaataccactagtttccgtctatttaaacgtacattacgggatgcatttaagaatgtgtgggtgcgctccgttctttttaaaaaaaaatcaaactaagaggagatatgacccctcctagtataacgaatctaaacaaagggctatccacattagttgtaccagaagaggtcacatttcctactaggttagcttttttagggtggagtgagtagtgatgtgtgtgtgggtgcgtcatataataaaaaaatcgttagatactccagaaaagagtagcaactaactagggagcaccaaggcatatttagtacttgcactagtagagtagtagtagggagtggatttttatctctcgaggggacattctctcgttttatgcatggtgtttaaaaagttatcaaaaaatttagaaaaaaatattaagatagatcaatatatgatatatcttttcgcaaacttgcaaattaaaattcgacttatacaattcaaaacaaaaataacaaatttgaccatgaattacgcgttctattaattgtcaaattcgttatttttattcctacttgtataagttgaattttaatatgcatgtttgtgaagtgatatatcacatattgatctatcctattattttttaaaaaaaaatttgatggctttttaagtgacatgtaaaaataaggggatatcccataatggatgaattgagttttcggtagtactagtagtgtagcctgtagttcttttttcccccttgaaaaggagaagtaacaaggtgaacaggcctcctaacacaggttgagagtaaaccaacattatcccaccaaagttttacggaataagttcatacgaggtcccttaactttacaccgaatccgattttcgtccttcaactcaaaaaccagatacaaccggtccctgctctatcaaaatcggtgcaaacgaggtccctcggtggtttgaaatgcggttttggctaacgtggcgccaacgtggccggtttgacttggtctttgtcccacgtggcatttgacgtggaacttacgtggcaattcgattccggaaaaataataaaaatagtggccccacatgtcagctacacaaaaaatataaaaatggtggggcccacgtgggccccacctgtcaacctcgcctcccttctttcctctccccctctcttcaccagccgcacgccgccgcagaggcgctccacctccggcgccgacgactccctcagtctgggcacgtcggcgaccgccaccgccaccgagaacgcctcccaccacagcacgtcggcgaatagcggcgtgtacctatcggcgaccagcaatgtcacgcacaggcgacacgtcgtcaccgtcaggcaccttcgtggtcttggattgcgaacaggacgaggaagcgcttcgggaggtggagcgcaaccggaaccacaagcggcagtgggctgcccaggggctggcggggcggcgctgggcgctaaagatgaccgagatgaggccgctcacgaggacgacagcccgcgtcattattcttgattctggccaattaattcttgattctttctggatgcgatgattttagcttgagcaagcagtagatcttgatactgtaatggttactcggtcgctgccgtcttgcttggcactgctcgtcgctgccctggtagcagcagcagcaaacaatatgcgagattcttcagggaaataccaagttctggtgctgataggcggcgccatggccgtaacggcagcagtggttgcgtcggtgatgagaagctgcaggggtcgagcatagggatctcgatcttgtccgcctcctcctccttgcttgtgttgctctgcgccccggctgagttgccgttggagcagttggccgtcgcgcggtggaggacgacaacggcgagggggacgggacgagcacgtcggtccaggtcgtcttcttcttgctcttgcccccacccttcttctgctccggcaacacccgcttcttgaggtgcgtgctccacctcgccgttggcgtcctctcggcctcatcccgtcgccatctcccaggagctcgccgccactctccactgctccgcccgccgcccctctctccgcccgtcacccctcggcgccgcggtgccgtcgccccttgcccctcgcctgtcccggcctgctccagccaccgccgcttagctccgctggcctgctccagccaccgctgacatgtgtgtagctgatacgtgggtcccatgatttttattttttaagattgaattgccacgtaagcgccacgtcaataccacgtgagatgaatacctagttaatggagccacatagacgccacgtcagccaaaaccgggcataagagcaagttcaatagtatagccaactactagctccaaattatctatagccaatttatataatatttgcttactatactataatatctggtcccacctatcatacacacattatgtcttggagtccgtgctgcagctggctacagatctgtagcccactgctcttctctctctttatttatctctttaaaatatgtttataactggcttattgcccgctattgtacctgctctaatactgccaagggaccttgtttacacggttttgtaagttgaaggatgcgttgtatccgttttgcactcgagggacgaatttcgaactcagcgacaaattgagttttactcatcagctccaaatttccagtaagtggacaaaggaatatgggcctatgggccgccgaagttctggcccatccgtccaatgagatagatgggtgaccagttaattgggcctcccgtacgttgaaggcctgaaatatttaggccacggaaagtgctagcatgacatgcgtgggtcctccctatgaactaattcacatttaacaccgtctattcgtgagtatgttttacatgaaagggatcatctgagggggcgtctagtatgcggatattcgcggtcagcgaacgttccaacagcctctcgttccaacatccgcacctggtttctgacgcgcgtgcaacactgcaagctagccaagccagcccatgggctttaacctgccttttctctttgtaccatgccttagcccaagaatgtcttgatcaacccaaaacatatttaggaaaaagtacaccgaaggtccctcagcttgtcatcgagttacaaaatcgtcccctaactgcaaaatcggatacaacgcatcctccaacttacaaaaccactacaaactaggtccctcggcggttttgaccccagttttgtatgacgtggaggctgagtcagcgtgggacccacgtgggccccacatgtcagaatgccacatcagcaaggtctctctcccctgccacgtcagcaaggtctgtcttccctctcccttcctctctctaatctctatctcactcttctctctgggcaggccgtccggtggtggagaggaggtccgacggccggccggcgatgctggagaaggagcgacgcggcgccggcaggccgggagcaagcaggcgccgcggcggtaggcgcggaggcgggcgccgtggcggcggttggcgcaggggcgacggaggatggaggaggacggtcggagcgaagctcaacgatgcgagtcctgtgacgagtggccacttgcgataggggcgacgacgctcgggcattcccggattggcccggcgtgactgccgctctgattgagaccagtggaggcggttgcgctccgatgtgatttggtggcgagtaaagacggagcgagctttgcctctatgtggcggggctagggtcttctagcgacgaggcggcttagggtgagcagcccgcgggcggcatcatggttgggacttgggggcgcggctaggcgagggaggaggttgttgtcgagcttgtatgctgttagagaaaggagagagaaaatgaaatcgtgtagctcgaatttgtatgctgttatttgatagtatctgcaggtatgagtctcgaagctgatgagcattcgatgattaaattttagttgcattgcatcttcaaacagtcccctcagttcgtgcttatatgatttatttacagaaatgatattgtagtgtttgaatggattcaggttctgaagagttctggagcttattaagagtgcgcttctggcagcactagaaggttactgttttgaacgcttgaaacttactgaattattggttgcttgaactgcgaattgtgagcgagtataatttatgttgctcctcagttgtctttttctctgtgcaacagctccgattccaggctccctgtttagacagtatgatgtacaaggtccaattccagttataaaagatgtttttatccctccagacacagaagaagatgggctgcctgctgcccttgaagatgccatgcctctaatttcttttttggcccctctatgtaagaagtgttacagtttgtttagtcaatttgaacatgtaataatgacaagataaatttacgagcagatcgacacatgcaaagatcgaattgctgctgcccttgataaattgcgatttacgacatacatcttcgtgggagcgaggtgctgcttctgggcaggaacctgatactgttttacttggtggccgaggttttggagcagccatgtctgctctaactgacgccctcccccgacgtcctgcttctctccgccggccgcctcctgctctgctcccgccgtcgcctcacccgtgtgaagccgctacacgccgctggcgtcgctgccgctggagccgggtccacgtcccgccgccgtcgaggtcgcccacaagccacatccggcggagaggaggcgcccctcctctgcccttttgctgcctgacccaggcgtggtggcctcctcccgtcgcagctgccgccgccgccgccggttctcctcctctcccgcctcgtcccgggtgacctcctccccaccccacccgtcggccggcttgcccaaaggagaaaagcgagaaagggagagagagggttgatgacgtggcatcctgacatgtgggtcccacgctgagttagccgccacgttggataaaaccgggttcaaaaccactcaaggacctaaagcgaacggttttgtaagttgaggtatgtaatatatctggttttatggttgagggacgattgtgtaactcgatgacaagttgagggaccttgggtgtactttttccaacatatttatacctagactatatacttcacatatgtaaactatatacaaagaaagtttgtacatgtaaatttttttcatgtaaattttgtacatacaaatttaaacaatgcaacagtgtgcaatccctttctaaaagaatatttatacgcgaaaaaaaatctatacatagaaactttatacatagatattttatagatataaactttatgcatagaaaatttctgcatataaattttgagcctataaactt

SEQ ID NO: 40159 - DNA, 2280 bp, Oryza sativa
attatcgaaagcaaaagcagctagtgagtagttaacctatataaccgattcatgcatcccgtttactctttccgtcaaatcatcctcatcttcttcatatatatgatagtgttcctataagcactggcacagtagactagagtagtgtggaagccttcgtaggcacagtgtcacttctatctctatatcgccatctccgccaatgagttgtcgtcgttgcctccgaatactagcctcatggttagcagttaagaaaatccatccttgccctctacatttggtggttattacgtacttggcggttggccaacaaaatatattgtcttgatggttttgatgctatctttgaccctttttggctaccaagaaaattctggtttcttgtagtgagcctcgaaaaaacttaagtaacgatatcaacggcagactttaaaaacgaggctccaaatcaccgcctctataggcttgctatcggcccagatcgctgtctgcgctgacgtgttgtcgccgctacctttgcaagctagctgtcactagggtttaatatttcattttcggcatttgtatcgggggtgcgatataccaaaattttggtctgaaattatttgaatttttgaacaaaatttgatcaaatttaaacaaaatattgtcaaattcataaaataatgaaaaattttcaaaattttagccgaaatattatcgtatcggggggaggggggaatccgatagaatcgaaatttcattcaggaattttgaagccgtggcacgagattctacctccacggctttgtctttcgtttattggcgagatggatcggtcgaggaagactagaagagggcggctgttttgcagaagtcaagtactattgaaggtgggcggttgtttggaaaatgcaggcttggagatttattaaccgtaggattgatcggagggcttcatgaagtcgtgtcgtgtgtacatagaatgcgtagtacgttgctctactttaactgatcaatagatgcacctctcctcatctcaacctctcttctacagcacctgatcgatcgatcatatctcagccccactaaatctatcgtcctagctagcttgaccaccgctaggtcatagacgtgactagtacggtcagttttcccctggcttgtgcccaaaaattttggtcattgagctggttgttgagtttcatcaaaaattttccttgatgatcgaagagatgatacgtacttttctctctcctccacatcagcaacttatctttagctagctagcacttctacgggccaggacagcacattgttttattaattgtattaatttctaaatgctgtcaaattaaatgtgcactctgatattcaacttttatacagcttggccagtttaatttgcatgattaattttgacacgaggaggaatggctggccctcgagctagctagctaggtagagaaatatgtgtgtgttcaagcaattaacagcgctccactggcccttaattaattaaacctgttatatatctgtgtagtgtacgatcgctggcgatagataggtactagataaatctattatataattaaaggaatagaaaaaggagcctccacgttcgctctcatggtctagaaattctcacattaatcggagaaaaagaaaaaacagagtccatttagaaatacaacttagaaatagttgaaattcagaattaaaaaataaggaatattagaagaggagactagagtccatatagaaatacactttagaaatagttgaaattcagaattaaaaaataaggaatattagaagaggagtatagagtccatatagaaatataattaggaaataatataaattcagaattaaaaattaaaaataaggaatattagaagaggagtatagagtccatatagaaatacaattaggaaataatagaaatgaattaaaaataaggaatattagaagtagagtataaagtccatatagaaatacaattaagaaaaaaaatagaaattcggaattaaaaaataagaaatattagaaatagagtatagagtccatataggaatttaaaactaactaaaattcagaaaaaaaaaaaggagcctccacgttcgttctcatgacctagaaattctcacattaatcggagaaaaagaaaaggcagagtccatattaaaatacaatttagaaatagctaaaatttagaattaaaaaaataaggaatattaaaacaggaccctatagtccatatagaaatacaatttagaaatagctaaaattcggaattat

SEQ ID NO: 40160 - DNA, 8039 bp, Oryza sativa
ttcctgcagcccaaaagaaaaggcagagtccatattaaaatacaatttagaaatagctaaaatttagaattaaaaaaataaggaatattaaaagaggagactatagtccatatagaaatacaatttagaaatagctaaaattcggaattataaaataaggaatattagaagagaagactagagtccatatagaaatacaatttagaaatagttgaaattcagaattaaaaaataaggaatattagaagaggagactagagtccatatagaaatacaatttagaaatagttgaaattcggaattaaaaaataaggaatactagaagaggagactagagtccatatagaaatacaattaggaaataaccgaaattcggaattaaaaataagaaatattagaagtagagtatagagtccatatagaaatacaattaagaaaaaaaatagaaatttggaattaaaaaataaggaatattagaagtagagtatagagttcatattggaatttaaaaccaactaaaattcggaataaaaaggagcctccacgttcgctctcatggcctagaaattatcacattaatcagagaaaaagaaaaagcagagtccatatagaaatacaatttagaaatagctgaaattcagaattaaaaaataaaaaatattagaagagcagactagagtagttattacacattagtagttttgaaaagttattgcaaaatttaaaattacgttgtcattgtaatatattttaataatataatgagaaaacatatatgctattatatgagagaaaatataatgatgctagccgcgcaatctgcgcgggccatcatgctagttagatataaataaaaataaccggtaatgcacgtcaatctggatgtgtatatatgtgcacagcaacgaacacctcgcgaagtactgagtgataactaaagtatacagcatgcatgtaccgagaaatgtatacgatcgatcgaccttagagcagacgtctagcaataatatttgtatacaagatcctaatatataaaaatacttactcaatatatatatgcgcagtcagcagaaaagaatggacatagctaggtagctagctgcaaaacaatatatatgtgtgtgtacataaacgtacaaaattggaagatgatgaatatattgatgcgcgactagctagcatgagagtaaatagctagctagtcgtaaaacccttcccaggatgcatgctcatacatatatagcgtgcattatttaccagcatgacagacattattgttaattaacccacaccccatattagcaagcttgcaaacactagtagcgagttaattctgtaataattttagagatatgcatcatatcatatccctcctccacacccaaattaaagctagtgacaactcacgcgatcgatatgatggagcctggaggctggagctgtatatatagacatatgaaccacagatcgatggagaggacacctgcgctatagctagtcgtagttgtgaagatcgaagttggttgtgtgattagatagatatggcgatgcaggtggcggcgccgtcgcggaggaggccgagcttggggcggcagaagatcgagatccggcgcatcgagagcgaggaggcacgtcaggtgtgcttctccaagcgccgtgccggcttcttcaagaaggccagcgagctgtccattctgtgcagcgccgacgtggccgccgtcgtcttctcccccgccggcaaggcctactccttcggccacccctccgtggagtgcctcctggagcgattcctgccggactcgtcgtcgggagcggcggcgcgggtgcggcgaggagcgaataataatggtggtggtgggatggtcggggagctcaacaggcagtacggcgagctgcgcgcgatggtggaggcgcacaaggcgcggcgggagagggcggacgagaagatagagatggagcgcgcggcggggaggtggctgcccatggacgccgatgtgcgccgcatgtcgccggaggagctcatggctttcgggacgggcctcatggctgtgcaggctgccgtctccgcgcgcgccgaccagatgctgcgcgacgcgctcctcattggccgcaggccgcccaccaccaccaccgccggcttcggcttcttccacatgccacactactgatctgaataatatctatctatctatctccattcatccatctccgcaatataatctgctagagctagcctcctcttcttctttgatcatttcatctcatctattattaattagttgctgcatgcatgcatatcatacccggcctcatcgttgtatcccggtcgatcgatcgctagctagctttttttgtttccatcacacattcattcgattccatggagattggagatttgtatccctgcatgttattatgtcttctgctgcagtatgtatcgtccttagcaagcacgcgcaaacttatatgcgccactgcaaatgacagattagtagttcacctccaatgtattagctgcagccacgcggatgtaatatcaccctttttattactaaaaatatatgcattagctacatgatacatgtcttcttgttgttattgttattgttattgttaatatatttttctctctgcgtgactctgggatatacgccctgctagcccacatatatatgttcagtacgtaggtatatataggcggtggaataaatgtatggcgtttgtgagttgtcgttcgtgcacctatccctagtagaagaatgagtgatccccctgcggatcatggccttaccactaggtctccgatggtttcttctcgtttttctcttcgtgaaatagaaagttgttccacgaaactagaacgaacattacgaaaaataagattagagtcctttttacaccctacgcgctatttctatatatggcaagactgtttctagctagctagaaaaggaagctattaatctaaaatggcaaagtaaattagctagagcccgacatctaggatacgtttggaacaacttgcatgtttgtcgaatgatttatcatatactaacctatcttgttaattttttttaatttttttataactatttggatgacatgcaaataacgaggggacatcccctcgagagtttagaatccactcatctctatagcccttgctcagctaggttagctcaccaagccatagcccaccaaagcaaagttgctagttcgatagcttgtcgacaaaggagaggggcaaggattttcaactaggccgggcgtgctagtttcccaagcaaagcaaggtttctaagcagttacccaaatgcacagcctagcatggcaaggagtggaagtagctagcctagcatccaaacgttcccctaatctcttatcaaattatgtcttccatctgtgtgctacctctcctatctccgtgctcccattgtgccagggttcaagaggatgaggcctttcttcccattgccatgtctctagctaatcctaactaaatacactgctaccctcctcgttatgcatgcatgatgatgtgtgccaggaggacgcagctttaaaatatagatggggcagagaacggaaatgttcactcgataagagtagttgaacacaacatatatcatatttatagttcaatcgtataactatctcgatcattgtttacagcgtgcgtgtgttgtgaagagacagactaatctgttggacgttcgcaccttgttatacctaattttgatggtacgataagagggtaggagggtttttttccgggggggggtgtctagggtgacacgggtcgtagctgggtccatcggcccaccctaactaatagatagatccgcctctggtgccggttgtgtgttagccccttgtccaacatttctaatggacctctataacaattattgatgcatatctctatgtagaaggccacacactctggattagcaatgaagtgatttgcaatacgtatggtgtcatgctgaaacaagattgtcaatacatgatagaaatttgatcgttgctaccacaaatatatcctaccagtgcatgactagggtcaagaagtaatccctgttatgatctttttttttgttcgatttcaaaccagtacataactaagaaaagtgggatccaccaattaaagtagcagcttctctatataactttaacataactctacgtaactagcaaataactaggtatcgttagctcgtctataccaaataaggaggcgattccctcggaaacagggccgaagagagagttagagataactcccaatatctttgcctctattatccacattcatgtgttcggttgattttgcatcctagcaccctctttctagaagtgaaaggcttctttctgatctctactctttctagtggagatgttaaagacagatgattcaaatcagcttgcctctatctccacccacgaatcaagttaacccaataattatccgtagttggcaacccagatggcagaactagtgatttttagataattgaattcatttcggcctttgcttcaaataagttacaaccattattgagaacatgatggttcattttctacgtacatcccttaataatatataaataatagatagatgggatttatttaggtcctcatttggaggaagcaaatggatcggagcgcataaactcgtttcaatcatgaagtgatggtgcaaacgcagcatgtatgtatatatctttccaccaactcaaacaaggacgtgaagaacgacagtgaagagagctttggattaggatgcatgggatgtgttgacattatattgcagatgagacaaccgatggatggacgacgttacagctgcaatgcatggttggcttggttgacagcacagcacagattttggaattaaaggagatttacgtaatttgtttgtacagaagaagagagtagtaattgattgggggtggaagacgacacaggtagcagctgcatggagtaattaatattctagctatatatggatcgagacgggggacgaattcgattattgagactgggagcagacgatatgatatgatatgatcagtagtcggcggtgggcagctggtcgtgcgggcgctggccgatgaagatgatgtcgtagatgagcgcggcgatggcggcgccgacgaaggggccgagccagtagacccagtggttgtcccagactccggtgacgacggcggggccgaaggagacggcggggttcatggaggcgccgtcgaaggcgccgccggcgaggatgttggcgccgacatgaagccgatggcgatgggggcgatgacaccgaggtcgcccttcttgggatccaccgcggtggcgtacacggtgtagacgaggccgaaggtcatgacgatctcgaacaccaccgcgttccaggcgcccacgcccgccgacagcgagaaggcacccacggcggcgccgcccgtcgcgatcttgagcagcaggcacgccaccaccgaccccagcagctgcgccacccagtacaccaccgccttcaccaggctgatgttcccccccacgaacgcgccgaatgtcaccgccgggttcacgtgcccgccggagatgttggctcccaccgccaccgccacgaacagggccagcgcgtgcgccagggaggcggcgatcagccccgacggcgtcgtgccgccgccgtccgtcagcttgcctacgtaccattatcgatccatcatcatattaattactcataattaaacggatgaattacttggattcaatgcttgcttactgaaggccatgccggatcccgatccggcgaagacgaagatgagcatagagatgaactcggcgacggcggccttggccgtgtccgggtgggacagctcgccgggggcgcccaccgcgatccggctcaccggcattttcttcttcttcttctgctagtacgttcgtctagttacgctaagcgcggctattatattgctcccctccacactctctcccatctttgtactactatatatagggaaggagggagagtgagtgattcatatatgacctcttcaaaccaaaccaaaccaagccaaagccatgcataaggcatccatatttcattttattaattagtttcttcaccgccctttgcgcgcctatttttgtcatcaataacaaaagttgcagacagttccatggataaggacgtgttctatgattttttttatttgtatttcagagattttctgagactagatgcctatccagaaggaataaaaaaacgtccaaacaaaacttcttccagaacctggctgagagtatcgttatatataacattgcattttttttctcatccgttgggtcgtcttgagatttgtgccatgtgagaaaaaaaaaccactaagcaggtacctcttttttttttgaaaactcaatataatattatagattaaagacagagttcacatgaagtaaatccatgatacatcgtccgaaaataaaagatctcaaaagcaattttccttatgaaaaggaagggaaacttgactacgaaaaacaagcaggtacctgaagctaggatttaaaccctcatcgtcgtgagcggatgcattcgctcttagccaccaggccacactcgagttaattcaataacatacgaactacatataaattgctctatatgttgtaattggaatatagttatttttactatatttacatttaaaagttttctgtaaaatatatcaaataatgtataaccactcccttataatatactgtactaagcaaaagatgctcagaaattttagaaaagaaatgcattcatacggagctagagaaattgtttggactaatataggagagtaccaacctgtaaaataaataataactgaagtatttttttttcttttagaaaggaatcgtccattatagaaaacgatgagtgagaggaggggagggagtagaaacaaaggaagaaggcgatgtgtgccgcccagccgttgtccttgctgataggccgggcctcctggccagtagggacgcgccacgaggacaaacggttggccagggtcgcttctgaggcgccgaccgtgacgtggctgcatgctctctctggattcaataatttatctgaccgtctggctataataatgaaatggaggctcgtgttgtggttgtgagagctcatccatggaatttgcagggtcatgtagtactccctctatctatttttatagttatattttatattagcacacaaataaaagataagtaattctacttgtcatttatttaaacatactacgggttatttctcgtaaataagtgattcattaatatttacatttctcgatgtccatgtagccaatcttgtatggaagaatgaagtcacgcattaaatccgagaaagtaattaagatgataaattgttggattaaaatatgcctatcaaaaataaattttccagatttaaaaatatacctatcaaaaataaatggagggagtacatcttttgtttcaaaataagttcattttcagtttcttatgtttgtcccaaaatactatcccttcatcctaaaataagctaatactctcttcgtaccgaaatacttcctcatcacataatacaagaatcaggatcggatgaaacattttctagtaccacaaatctaaagaggctagaaaatatctcattcgattctaggttcttattatcgaagagatgtataaatttatttttaacccatcccgtttgtcctaaaataagttcatttagtttttgagtaatcattgcatcaagttagtgaaattagaaaatcaatgtattgagagtaggtaaagtagaaaatcattgtattgtgagttgataaagtgaggatattctagtcttcttagttttgtattgatttatatgggatttgggacagaggaagtatcaaatgtgacatatccaaaaatgggaagcaaaatactccctccgccctataatatataagggattttgagcggattcagagtaatatgatgcatcacatccatccaacatccatccaggg

SEQ ID NO: 40161 - DNA, 1978 bp, Oryza sativa
cccaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatactctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagagggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttccttgcgcgaactagagccaagtgctcctcgatgtaaggagctaccaatgaagagtgttgcagaacagtgaaatgggctttacggaataaattgttgtctaccgtcgttcttgctttccttccgagagttccctttccccgtagtctcccttcatggcgtgattcaggtaccccgattgggcgaaggtcttcgataaattctatgcaaaattcgatgacctcctctgttccataacccttggcgatgcttgcctctggacgagcacggttacgaacatacttcttcagaacgcccatgtacctctcgaaaggaaacatgttgtgtaggtacataggcccaagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgtccggacattgtctggaaggataccccttattacaactggtagcagttgtgtcatcaacacgtgacagtcatgagactttaggtttgtgaacttcttctcct

SEQ ID NO: 40162 - DNA, 1154 bp, Oryza sativa
ttcctgcagccctggtagtgtatgtagcagtttcctccttaaaacttaagtgtttttcccggtacttgggaggcaccaataggtactgataccacctaatgttaatcttttaaacctcttggcacctcccaagaatccttaggaactcaagataaaaaagttaacttataaaagtttgcagaagggaatcagttttttttagacgtatgagtaacattataatgcttattgattattttgctgttccatgttattgattgctgctcataaagtttgaatttagaatggtcaaacctcctcccgagcttgcagtttctgtttgtcaagctagtacttttttttttctgttgttagatgattcctaattatattctttctttcttttttaagtggtggccatattttgtcagtagcatttggcagcaacatacctgctcggttgattagcttattttgcagttaaaattagattcttacagccaatattctggcatataagaactactgagaaggatttggatgaagaatcatgaagatacagctaatcgtaaccaatctaaaaatttttcaagttcaacttttgttttaaataaaaatgaaattagctaattttgtttctcctcgcccttattaactgcttaaagtcagttacctctgtggtgccctgtggaatgagctgtttaaacaaactagtattattgagttctatcctctctgatctgtagtttcctcatgcagatgtgtgatatgttgttttctcaattatgtctgagactgccatcttcaaatgtgatgcatatgggtgggcttcaatcccttggtcaactttttggttgtacaactaagaacatcgagagccatctggaaactcttgcgtcgcatcaaaatgttggaaacaagaacttttgcaggagtgagacattgcaagacataagcgtaaatcaaactgctcaaaccactttactctccgagacatcaatggcagcactacttctgagaggccttgcgatagctcctatgcagcttgtagcacgcgtaccaacttcattgtttttctggccattgatgcaacttgaaggggcagctagcgatgatattgcattgggtattgctgttggtagcacaggtagaggcaatctccctggtgctacgtc

SEQ ID NO: 40163 - DNA, 3049 bp, Oryza sativa
gacttgcctgtgttgatctgcttgtattagaaccgtagaacttggcatggtgtactttatgaggttactaatggttttgaaaataactacagatattagtgcaagtgcatggtgtaaattccttcgtccggatgcatgcacatgcctctgaagttcttaattgtttattataggatctgaatcacctgtcacctgcaagctgattacaggatctaagcgttgtggctacctcaatgaagtatgactaagtttgggcgaggtgcgcataaatgcgactctgcaattttgtagccaaccattaagattgagccagcgcaagtttttgagagggatgctgggatcaataatagtatgtgtgtttatttgcagcgttgttccaacgaaagtaacaagggtgtacatgtttgcatgctagtgttatttgctacctggaagaaaccaaaccttgcagatatcagtgaacttccagacaacttattattgttttcttctttttttttggaaaaattaacttgtgattcttagattcgtattgagagttaacattgtaaatgcgtagggtgaaacagaaaaattttgcttatggtaattgaatagtacatctcctgtacaatatggagtgtaaaatttactgctaccattttgttagttgctagtattatgcacacgtgtcgcactttttgagatatatttgatcattcgtctaattaaaaaaattgtaattaatacttattttgttgtggcttgatttatcattaacatttctttaagaatgacttatatttttgtttgtttgtaaaaaatattgaataagacgaatggtcaaatgtatgaaaaagtcaacggcaatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgatttatacctttacttatcaacaaaacaactcaaatttaactttatttcacaatccatgattacatacctaacaaattatatgtatggatgctatatacctagaatcaaaatctaacaaaaacaagttcaaattcagttcaaacttgctttaaactagttagtaaagtagttaatgttaatacctaagtaattgaaaaagtttcatactaatttgaattgggtatatactcaatttcaacaatggtgcccgggcaccatggagcaccaaacaaatttactatatatatatatatatatatatatatatatatatatattaaaaaaaggaggtatttcatgaatgtcagtttggatgaaatcgtaggaaaaacatatgaatcaaatgagagatacagtcaaagaaaattttccaataagttaaacttattcaaacttcccttcacattctccttgtatcgagccatcctaaatggttttcacatgagacagtttattttcttcaaatttttgttaaattcctctgtttcgaagaaggcatcaaatggtgtccaattttatttcaaagggctatcttagaagagaggggaaagaattcctatatgattcaactcatacaagcatcctctataaattatcctttgctccagggaggtagcacaagcagcaatggtcagggtgcattccctttgcctgtccaacagggatcccctgtaatactgcagaggcagtagcaaccgttataccgcagaggatatgcatcatcaatacctgtctggcgctgaacttttgcgtgtagtaattcagtttctcaatattaggctcagcttgtttcacttttttttgagatcgaggttacagaagtatataagcagccaagttaatatgaattaataagatggtaggattagaattacgtactctctcgatcatatatagcctctgcttgcatgcagcaggagtatagtatatagttaagacaaagaaaatgtatataaataagattttgcgattaagtaaggaattttatttaggggccaggcggcaacatgacatacatgagacgctaaggtaggtagctagctagctagcagcaaattaaggacttgcatgcaagctaggtagctagtacatggcatatgtagtggtactggtagctcgttgatcaggtgatgaattggatggagataagtttcttctagttgcagttgcagcaggagcagccgcagctggtgccgcacttgcaggtgttgcagccgcagctgccgttctccgcccccatctctgatcctccggaagcagcaccagacctgcaatcgatcatgcattgcccatgtaatggatatatagtgttcatacttatataaaatctatcgatcggagtatgtataattaatcaagcatgggtatacgtacataccccttgttggttgcatcggcaaggaaggtggtcgtggtcgtgggttccacctcagagtacttgcatctgcatatatcgatcgtcaagtttgaattgcatcgatcgatcgatctgcatgtaatatacgtacccgccgcagccgttgccgcactggcagctggagccgcatccgcagttgccaccgcagcacgacatggtgatgatgatgagagcttcttcttccttctctggccttgtcggcaactagctgctgcttacttgtatggagcttctcagttgctggcctgaggagcaatggcaaccgcaccctgccctatttatagccacccacactacacccacggatcatcagtagtgaatgcaatgcatacgcccgcgcgagagagatcgatgtaggagtagcaagcatctaactgcagttgcagaataatcaacagtagtaaaaagaagaaaaaacaatactcagtagtagctagatcgaccactagaatggatgggattggagatgccgcgcgcactagatagcgatagcagctgccatggaatggaaataaggaacggacgacatcatccgagggaccaccatgcgtcttatctcatttgtctcatccatatatata

SEQ ID NO: 40164 - DNA, 1749 bp, Oryza sativa
aatttacgacgctatattatatacatacagttcgatttgcagtttttattcgtcgagacaccgacggacggatcgatcgatcgatcaaacatcaaaagatataaattagtaaaggtgaatgagtggagcatctgtggagtgtcaattcttgttccccctctatctatgtagatctctgtcaatggctacccctatgatattgcaattactagacgatcgtttacttttacaaggcgtatattgattactagcatgcagcatgggagtatatatatggctgaccatcgctcgcatcaccaaaaagttaaactgcgagcagtgacgaggccgatgataaggatatggagaacgatctctcctccattcttttcctgccccaacatatatattcctcctcataacaacaaaggcaacgcaactttgattccaacagttaaagcatcacacaacaggagcaattgatagatacgtctgcgacaattattgtccatcactaatcacgtactgctaaagctgaaattaacactacacacataaagcagggccagtcacatatacaagagctggaaaacgatcgatccatctcttattattactgcattaaaatttgcatatgcgtggttgctaatactatttttttccaacaagtaagagtagagtgttattcttcttgggggcacagatcaacaacaagtagtatgcagacttcaggtaaggtaattgaggaactctgcagcggttgcgatggctcccccagtgatggcgttcttcaccacgttctgcctgtggctgttgctcgccgcagacaccagtgctcctgttacggcgcctccaaccatcgcgttcttctgctcaattgcatacacacacatcccaaggaaatgcaagttaacatccagatcgatcgtgcacactgcacagacagcagccagtatatattcatgaacagatgagtacattttccaaaactacagatgctttaatcaaactatcacaaaactatatatttaagagtgcgtctgccagatttagtactaaattatcaccaaactacaaatttaacatcaattttattataaaactgtagcttttgtaactttcagaaaaacaacaggctattgatttaaactttaaaatctgtagttctttgataaattcattacaaaatctgtagtttcgtggtacaagtcattaaatttatagttttgtgatgcacaacattaaatttgtagctttgcgatagtttggtccaagtattttgagatttactccgaccaaattaatcaaacaccatatgcgtatattacctagtccctgtgaccacggattctttcgattccatactccatgcccacatatacacccgcaatagtacctgaatatgtgtttcttccattgttagattaacaaaaatacaacacatgcgcttgagtacgttgacagtagtattttgttagttttgagcaaagctgagttaatagaaaatcaagtactccctccgtttcacaatgtaagactttctagcattgctcatatacatatagacgttaatgaatctaaacacatacatatgtctagattcattaacatctaaatgaatatgggcaatgctaaaaagtcttacattgtgaaacggaggaagtaggagattatatatgcagatgagttgattatttaattataccccaatatgcgccttccttgcaaattttcttgagctgcatacatataaattcaggagcgcaagat

SEQ ID NO: 40165 - DNA, 5524 bp, Oryza sativa
atgtattatgtacagcgccaatcttgaggaagccgtcgacggtgcggttgaggaagggatggcccatgtcgacggcgaggtcgaacctcggcgacgtcaggctgccggagaagccgctgtgagccatatgctgttcgttgctcgatcgatctcgtcgtcttctattgtgtatacaatcacaaataatatagccagccaattaagttgaagcagtcgccaactccggcatgcactgcacaccttccgcccgggatcgcttacctcttcaattcccttcctctgcactctctctctctctctctctctctctctctcgcatagtccatatcccacgcaattctttctgtttctgggcacacaagtaggagtaatacgcaacacatgggactcccatacacaacaagatggttcacctcgacaacaaagttttcatgtatttatgcattccttgctggttacctttgcgcaagggcacaagaatgaaacatcacaatatcaaacaaaaaccggcctacactgcctcccaaaaaaaaaaaacaaaaacaaattaagaagatgccctacacaactaacggagatttacacatttccccgtgcttttcttgttttaataatatccgggaatgcaggaaacttggaaaacaaaaccagagactataattccactattcaaaaacttggttcccctctctccaaatgacctctttctaatctcattctcaacctgcgctttcctctcattttcttccttttttcaagaaatgctacactaatagcaaattcctgtatcagcgcttcccaatggagaaagctcccccgtgttattcctgagcaatcacaacagtctgctaagtgacttgataagcagcttgatgttccgccttgtcgcgtcgtcaccggtgaaaccagagatgtctgagctgatactctgcgaagtaaccaaggacgggtacagcaaatacatttcagtctgatgatctgactgagaaataaccaaaactgacctaaagaaagttaaaagagtatatatatgcaaacctcaatattcttcagagtaaagataagggtgaaaatagactgcttaataagatcggtgttctcaggggtaagcatggaagacttcagccttctgcagggtagcacaagaaaagtttatcatcacatttatctttggtacattatataatatgatgcagtgtatatttagagaggtctatttgaatactagtataatcttgtagactctttcataataagaaagtcatagcttgatggtttatatcaaattctccaatttatatcattacttatcatgacttacctcaagcaagatgttataactcatagttgtataaataatatgtattaggccacaatgctttccagaagtaccttaaatcaccggatgcatcagccagacctttagctataatctcgacatccttcaccagatcactatcacgaacctcagaaagcagaggttgaatttcttcagctaatgcttcaatctgttccatcactaacatttaaatggatgagtactactattcaggaacatttttcgattttgcacccaaaaaaaaaggattcggcagagctgcacatatggaggaagtaccacccacaaccttttttttttctttctcaaaagcatgtgacataaacaagaaacctaacaacatatcccccctaaatggaggtcccctctcttgacagtgctacatgcatgccaaccagtgcagctatgtgataggacaaaaattgaccataccctggaacattcagtggtcaaccaacgtctgacttaagtatggacaggatggatcatttttttcttggtatatcatacacaaatagatcatatactttggtacacaaccaatttgaaccatatacaagacataaaaaaaaaacatgccaatagttgagttgtacataaaggcatgaaaacaaatgaatgaaggctgaaaatttatttgcaagtaataatcacgataattacatgatttatggcttcatatgcatgatacattgacatgttaggaaaaactgtcaggtataaaggatgagactccagtggtactaactgccagagtaaccactcttttcaatatttaaaaggtacacaggatcaggaaacgctgttgcacttccaagcatggttacgaaaatttcaccataggggtaaagcatatgaaccatgaaatcttattgagtggcagtgagaaaaaaaataggttgcaaagagatctgattaactaaataggacaaattataaatatttctccggatatggaaactatatacaaaagcagaacgatgagaaaaatgtacccgtgaaagaagaggctgcgcttcttccattattgatgctactttttcagccaacttgtagcttttgtgaacaccaatttcctccatatctcttcctagacgagtaaatattccaaccagtgcgtctaagcttactccttgttgtcctttcatcctctctttgtcacagagaattaaaccttctttggaacagtctgggtcaagaggaccaactgaaggtgtagggagtggatcttttggtgttatatcaatcagtgtctccattagaagaccagactgattcacctcaaccactgaattgcggggcacaataattttatcatcttcaacctatcatacaagagatagcaaatattcagcccagggggaattatacagtaagaaatgcacatatgtagacaataggcaagaccaaaatgaaggtgctcttgttgcccaacttactaaaaggagtgatgattgaaaggtaaactcaacctatttgtgtaactggaaagtatccgtaagagaaccaatgagccctgaagcttagtgaaacagcataaatgcaaattaatgacacattgcattgcacaaactaaaccatggattcttttcagaaagttgttctatgaattaataggcatttagggcaaagtcaatgcaaagtcttgctttcaaataagtcgcacacctgcaacaccaactttatattgaaaatgtgaagtctgagtaagtgagtagtggaaaactctaagcatctaaaaggaggacatgacccctcccatccatgaatcatgaatcatgacaagttacaataccaggaatttgctgttcagattaccagcttaggtaaatcgagtggctacacagccaggttaaaataaactagccagcaagagtaaagatctcagcttttccgaatgaacaaaatttgagcaactaactactctagatccaatattttttttagaaaaaaaaaactactctagatgcaattaatttcagcatcagtaagcaatggcaatcttctttagaaggaaatggcatatatctgcatagaatttgacatgcatgaagcagtcatttgattctgattgattaggttagcatcaaatttcagttgataattagaaagaaggcgaagcagttagcaagaaaatgcgttaaaattaaacacaagaatatgcattgccattttgacaagttacatggtttgagtgccaattgtatgagagagtaatataagtaaggtgataagaagtagtcctatggtgcatgtactagatctgccatcttccattttggtttgttgaaggaatgcaaaaggatgcataaaaaaggaagaggatggtgtaagtagggggtacctcaacataagcatcgatgctcttgagggaagagtcgacgcggacgacgttgccgacggtgacaccgcggatgcggacgggggtgccgacgcaaatcccgcaggcctgggtgaactcgaagacggcttggtacttgcggaagcgggcgcggagctggaatccccggagccaggcgagggcgagggcgagcagcgcggccccggagaccatgaagaggccgacgccgccctcccagacgctgcgcttgccgaagccgtagtcacccagggggtggagcgtgcggcgccatagcgcgaggagcgggttgccgccgccctcggcctcgggtgtgggagaagggtcgcccgaggcggaggcggagcagatagcgagggaattgcggcggcggggcctgggattgggagtgggagcgagggtggtgggacgagggttcgaagagagggcgatgaatgggggagggagaaaggatttggtggtggccatggcgatgatgacgaatttagtggatggatgaatagggggattggaagaggcgatgccgatgcgtcaccttggatgattgagcggttccatcgtcggcgattggaggcggcggatcggaggtctccggcggcggcggcggtggctgatggcgattcgatcctctttggctggacgcccctccccgtctcgtcaactaatcacatcacatcacctccaccacacactcctccaaacctttacacaagatttcacattatttttactattattattttagaaaatatttcttggtgaaagaaaatatactgctaaccttgtgtattaactcatctgttctaaaataaatcaacttttgtatacaaatttagacattatcaacgctctaggagccatcgaatttaggtttgttcattgcaaaccatccaacccagcaaccaaaaccaaatcagtacaagcgggttacactggttttctcggttatagatcaaacatgtacgatttgacaacgtggtggattgaataacggttttaacccaccggctataggtgcggcggaggtgttacttttaatctctccgttgttatagcaaggtcgtctcttctcctccaacaaaacaaggactatttgttattgtctccggtatagttactgtttgttgcatcaccatgtgcacatgttccacgtggttttttttccctctttgtttttgcttgtgcccatgcttcacactctatatatattattactctactttttttaaaaaaagaatggttatatataatagtattacaatactaccatacaattctacgatttgatactactttaaggatactgcctagaatcttgatactaacaactttggtattcctagcaattcaaaacacaatatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctcccttttttttttctcgtgggatctcctctccagatcatccccccttccagccccctctcttaagtgggcaaggtcctccttttatatctcaaggggataccacatgcaccacttctccttctctctctttttgggtgggggcccatcctatctatagtaaaacttggcttgccttctcttggaagctgaaacactgcctgttttt

SEQ ID NO: 40166 - DNA, 12275 bp, Oryza sativa
cctgcagccccacgctggttccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgcttacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgtcagggcgatcgccctcctcgagggaagcggtcgggcgtgacgccactttctaaggcctggtgacaggtgggccggtctaaaaatcgggacaagccggttcgtttttcctggagatatgatgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcgaaatagtgggcgcgagaaacgaggagccgggcacagcgttggcaagggtataaagtcgccgaggaagagatttgcttccttcctctcgctattattccccttgtcttcgccgcttgcgccctaactccttgtttcctgtgccctaccttcgccacacgtgctcgctctcaaacatctcttcttccggcgtcatggcacggggctccgctccgcttgacggtagcgtgctgccgtcttcccgcatcgtgagcgagagacaggccgggctgccacgccgcttcatgccggaatctgccaccggccgggagatagtctcgctgggcgagggatgcccggcgccacgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtgattcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgctcggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcatgatggcggtcggggcctcagaggagcgagctcctaagggccatgacggtgcgagcgggagccgcaagggagatcaatctaccccaggagggggttgtgcttccgggccccgtgatgggggctcggggggcagccgccctgccgacgcctgagggaagaggaagcaagagggtacttcctccccatctcttccccgagggggcggggcggcgcgtgtcagcagcaggcgcccggagggggccgcgccgacgccgcagcccgagggggagcggaagaagaaacggctccgcaagatgggggggacagaaccatcccggggaaacctcatttcccctccaaggtggtcgtttaaccgaccccctcgcaggttcgtcccacgcccattgtggctgtattcattcttccaacacaagttttcattcacccaccttgtttgtcttctggcttttcttctgcttcagcgagatcccgtcgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcggcgacgacttccgaggcagctcgcgacgaggccgcgggcgcatcgcttgggcccactccctcgggcgacgctcaggacaagccaggtccgggggacatccctgagtccggcacgtccatcggcgggccgagccgcgcggcatcctcaccgaggcggctctcccccacgccttccgctgccccactgagcgcagagcctcttctgcaggccttggccgtcgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccgtcacgtctcagagctcgaagcccgtcggaagatgctgggggagatcgccagggaggtggaggaggagaggggggctgccctcatcgccactaccgtgatgaacgaggcgcaggacgacctccgccttcaatacgggagctgggaggcggagctagggaggaagctcgacgccgcccggggggtccttgacgctgccgctgcccgagaacggcgggcggcggagaccgaggtggtatcccggcggcgcgaagaagcccttgaggcccgtgccatggcgctggaagagcgtgcctgcgccgtggagagggacctggcggatcgcgaggccgccgttgccatccgggaggcaacgctgactgcgcacgaggccgcctgtgccgaagaggagtccgcgctccgcctccgcgaggacgcgctcaccgagcgggagcgagctctcgaggaggccgaggccgcggcgcaacggctggcggacggcctgtccctccgtgaggcagcgtgggaggagcaggcgcgccgtaatctggaaggtgcccgcgccgagagggccgcgctgaaccagcgggccgctgagctcgaggcgcgggagaaggagctggacgcgagggcgcgcagtggcggggcggccgcgggcgaaagcgacttaaccgcccgcctcacagctgccgaacacactatcgccgatctgcagggcgcgctagactcgtccgccggggaggtcgaggccctccgcttggcaggcgaggtagggcccggcatgcttcgggacgccgtctcccgtctagaccgcgccggccggcaggcgggcctctagggcgggcggactgcgaagtatgccgccaaccaggggggcctcgcccagcgcctctcagagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggacggtgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcactacgccccgaggcacggctcggttctgggccccgtttggcgattttagccgacccgagcccccgagggcaggattgaacacgagtgacctatttcaagtcaagatccttcaaaaggaaacaacagcacagatacagcctttaggaaatcaaaaatgcttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccatggccagccgaacggagcccggccgggggacgccgatcactcgatacggaccctcccacattggtgagagcttgctcaatccagcacgcgtttggacacggtgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggggaccttagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcatttgcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggatgtgatgcccttaatgaatttaagtgcggagtgcttatcgatcttgacgaccggataagcctcgggccacttagtgaacttgtcgatcgcaacatacagatactcaaacccgcccggggcccgcctaaacggtcctaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaagactttaccaaccaaggtgcgcgaggcggagtgggctccgcattcgccttcatggatatcagcaagaagctcgacgccttgttcccgaggaatgcacttcaggaggattccgttagtcgcgcgccgatagagggtcccttctatcagcacgtagcgtttggagatgcgctggacgcgttcacttccttcgtggtcctcgggtagagtcttatctgtgaggtatgcttggatctcaacgatccaagcaatcaatctaagggagctgggagcgctcccctcgggtcccgaggcctggactccgacgggcctcgggggccggtcaggcgcgtccgtctcccctaaggggtcaggtcgcgccgacggctaggtaagcctttcttcaaaggcgcccggtggggtctgggctcgcgaggaagcgagccgtgagagttcgtcggcaatcgtgttatcccgtctgggcacgtgccgaagctctatcccgtcgaaatggcgctctatacgccgtacttggcgtacgtaagcatcgggtcagagcaccggtattccttacagacctggttaacaactagctgggagtcgcctaacaccaggaggcggcggatccccagtccagctgccaccctgagtcccgcaaggagtccctcgtactctgccatattattggtcgcccgaaagtcaaggcgaaccaggtatctgaggacgtctccgctcggcgaggtcaatgtgacccccgcaccggcgccctgaagagacagggagccgtcgaactgcatcacccagtgggcggtgtgaggcagctgcgaggggcccgagctggcctcggggactgagacgggctcgggagccggggtccactctgccacaaaatcggcgagatcctggctcttgatagcgtgacgtggttcaaagtgcaaatcgaactcagaaagttcaattgcccatttcaccacccgtcctgtaccctctcgattatgcaagatttgggcgagggggtaagacgtaaccactgtgacccgatgcacctggaaataatggtgcagtttcctcgaagccatcagaatagcgtaaagcatcttctgggcctgagggtatcgggtcttggcgtcccggaggacctcactaacaaagtagacgggccgctgcacctttcggtggggccgatcctcttcgctaggggccacatccctggggcgctctttgtccaagcggcctcgcggggcgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggcccccgggccatcctgggggtcgggggcacctggcaccgtctgacaagcgggcagagggcctgctccgattgtcgggggccttgggccaccgttcggcttgggggcctctcctccctgctctctcccgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagtgtttgaggagcttaaataagggtagcgccttctctcccagcctcgatatgaaccgacttagggcggccatgcaaccggtgacgcattgcacatccctaagcttgctgggggggcgcatccgttctatagctcgtatcttctcggggttggcctcaatgcctcgggcagagaccaagaacccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcatataacaataagttcctatgggggtaatgaatgcagttttttcctcatcctccctagccatgcgaatctgatggtaaccagagtatgcatctagaaaacacaaaaggttgcaccccgctgtggagtcgacaatctgatctatgcgaggcagggggtaagggtccttaggacatgccttgttaaggtcggtgtagtcgatgcacatccgaagcttgccgttcgcgttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccgctgcctcggggcggcgggggcggaggtgccaagcctctcgtcgcctccctcgggcttggatgcggcggtgaggtggtccgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgtgttgtagggcagactgaggtccgccacatcaaagttcacccgctccgtgcggaagttggcggatccaccgaaggtgaccgggaggtcgatatgacctagcggccaagtgtgacccggcgtcacaccgataatcggctgggacggccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctccgcctcctctcctcctcctacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggcctcccctttcgggtggcccgcgaagcgccctcgacggcgaggaaatgaccctcgtcgtcggaatgggctgacctcttcttcctcctcctgtcacgccgccatgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccagacgaggaggcgccctccgttgcgtgggtagcacgtcggccattacgccggcgctcgatactgatgcgggcatccggccccccacgcagatcttcccgggtcggaggcgctgacgaaggagtggcggccgaatggcgaacagcggccgccgctcgccgcgccctccgtcttgacgacgtggagccggtggtagcagtaccagaggtcttggtggcggaggaccgcccaccagtatctaggcgctgccgcgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagaacttagaaaaacacacgcagacccccctacctggcgcgccagatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctccctttttttttctcgtgggatctcctctccagatcatccccccttccagccccctctcttaagtgggcaaggttctccttttatatctcaaggggataccacatgcaccacttctccttctctctctttttgggtgggggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacagctgctgcccgagtgacccttctgacgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgcttacctaccccatatacgcggcgtaaaacccacaaggggttggggcgcctcggccctcggggccgagacgggagcggtccgacccctcggggagacaaagagaagggcggccgtatcaccctcgggcccgaccccccgagggggttaggccacgtgggtgatcgtgtctgcctcaagtctctaagtcatgatactcccggtcccatgtcaccgacacaatactactaaataaatgaaaatgcctcaaaataaatactaaattttagtttccaaatttaatttaactaatacaactaataggctacagtaaaaaagcaagtgctgagggcacccg

SEQ ID NO: 40167 - DNA, 2525 bp, Oryza sativa
atactattgaggtggtttactattaatttagttatcgctgacatgtacatgtttatagataacaccttactttatcattgcgggtgctctagcaagtatggacggcgaggtggagttggcccaaaataatggcaagtgtggtgtgggttggctctttgtagtaggtgtatgtttggtcgagtcgagcgtgtgagaatcgtgtaccacgttggttctttaaaaaaaagacggtggtggaccggtgcgtgtccccattgaacgaattccaaaagaaaaggacaagggcaaaaaagcaaacaggctagtagtatttacgttttttgtcctacggcaaaatcaacacacaacaaggcctattagctcagctggttagagcgtcgtgctaataacgcgaaggtcgcaggttcgagacctgcatgggccagttttattttttgttgcgatttttcttccactctgtatccataaaataaataaagttagtttttctttaacaaattttgagattttttttaacacgcatttaaggtcaggttccaaaatcccccaaaaccaaagcatattatctatctattatattattaaaattgctttcaaaggaggcaccacgttcgctgtgggggctagaaattctcacattaatcgaagaaaaagaaaaaaaaaagaaaaggagagtccaagtagaagtacaatttaaaaatagctgaaattcgaaattaaaaataagcaatattgaaagaagtttccatataagaacccaatacgagattaatcaaaattcgaaataaaaataaaataaaattaaaaattagaaaagaaaaggagagtccaagtagaaatacaatttaaaaatagctgaaattcagaattaaaaataagcaatattgaatgaaatttctatataagaacccaatacgagattaatcaaaattcgaaataaaataaaataaaatccataattagaaaaggaaaggagagtacaagtagtaatacaatttaaaaatagttaaaattcggaattaaaaataagaaatattaaaagaagagtccatataagaacccaatgcgagattaattcaaattcagaataaaaataataatatttccgaaattagcaaaagaaaataaagaaaagtttaactagggatacaaattaaaattagctaaaattcggaattaaaaataagcaatattgaaagaagaatccatataagaacccaatacgagattaattaaaattttaaataaaaatataataatatacaaaattataaaaattaaaagagagttcaagtaggaatacaattttgaaagaactgaaattgaaaataaaaaataaaaacattaaaagaacacaatacggtattaactattttttttaaaaaaatctgaaattagaaaaaaaaagatttcaattaggaataaaatttataaataactaaaatttgtgataaaaataaagactattgaaagaaaagaccatctaaaacacatgacgagataaattaagtaacatgcctataaaggagtagagttggtggcggttgatacggcatataaaaattgttaataaaacatcaaatgaatcctaatggcgattaaaaggtgggacgtcaggcaggccgtgaagcaaacaagtaaagcggttgccggaacttctagaaagtaagaaaaaaaccacattgataatcatattcgaattttaaaatctcaatgaaaataaaaaggagaagcagcgggcggggtgtataagagtatagttgcagagccgccgacggttgacgggacttctagaaaataaaaaatgaattgcaacagtagttatgctcgattttttaaatcacaatgacaataaagagtaggcggcggacgggctgtagggggtatagtggcatcgtttgatgggacttctaaaaattataaaaaataaaactacaagtctaatttttaaaggttcggaacttctaaaaataacaaaataactaatgataatcatattcgattttaaaatcacaatgacaataaagaagggaggcagcgggcgagccgtagaggagtacaatggcgggacttctagaaagtaaaaatgaacccaaacgataattatgttcgatttttaaaatctcaatgataataaagagaagagatagtggacgggccgtagaggagcataatggcaacgtttgacgggacatctaggaatcataaaaacgaaacccaacgtgaaaataaactctaaaaattataaaatccaatttttaaaggttccaagaagaatgaatagaaatagtgatagatcgagcaaacaaataaaggagataacataaggcgtaacaactggtgtgacttttaaaaactatataattagaaacacggggatgataaagtttgttttttcaaagtcttaacaatgagatagctatttaataaattttaagtaaaatcatactttaaaaaatatatgtttttttttggtgctagccgcgcaattgcgcgtagaagtacaatttaaaaatagccgaaat

SEQ ID NO: 40168 - DNA, 5839 bp, Oryza sativa
tgccttgttagtacccgtcatctatttcccttgtatgtccaaaactgttaaaaagaactccttttatcacagaaaaaaagtatgggaagctattcttccttctctcagtacttcagtatccaagaagcacaaatatgaatcagaagctgagcaaggaacggcgccgccgcctctcaaactttgccctccgcttcatatcagtcttgattggcatcataagcaacctttcggtatccagttctgactgcagggaggatttcagccttttgaggtgcccaatgcatagtgcgtgatctgaagctgtgctgtggaagtcttgctcaatgtgcaggtctatcctctcatacttggaatgccattttgcttggagataaggcaaggatctccaaggaggcagaggcatagagttctgcttaagcgaccattttgcagcatctaccataacatgcaagaactgtttcagtctgggaagagtgccaacatagaccaccggaagtgaattgagcagactgtcataagaatcaacagccctggctatttcaaagtggctcctgaagtcgatatcaatgatcagacgatattcagtatcactattcatgatgacatcgatatactcatgatcacctagtcaccgaaaaaaaaacaaacagataagttacacagttcaattccaaggagagattgtaaagatgtactgttagttatgattttgagacttgttaggcaagtacctccaggtatcttgtcgaatccctgccattttgatacgcaaacagctgcatcatatcccgaatatctcaagagcttcacaagtaaatgacggatgcagctggcactgcattgacctcttttgaaagccagaaggtctgactcatggatcgagaataacagcgagtggaccatggagagtagctcgttttctttctcatcgccgccttgcttgtagatctgaaatggaacacatagataaaacggtgagttatgacagatgaagcataatagtaatagtaatatttaaagttgtatccaacagtaagctatccagtatccaattatgaatttagataggaggagtagcagttacacaaataggcttgctaataataaattgagaggtagaaattggtagcgctagttaatggcagggcaggaaatgaaggatgcataatgaaaccctcgagtagcagctagcgtaggcatcataggggcagatttaatcgtcgttgcaatttcacgggacagaagcgccaaaaactagtaggatcatgggatgataaaatgataagaaacgagctaggcagtggtaagttgtaatgagaaattgaaagtagagtaatacccaattggaattagaagggttcccttgtgagaattttgatgcgcaattgagggggaaaagatatgcaaattacaggagaggagagggaaatcctgtcgagttgttcaaggcagaggagagaggggtatgtattgcatacagaaatgttatcggcgaggtggtcggagagggcggagtcggagtcgctgctggcgcgggaatcggcgcctccggtgccgccgttctcaaggaagtcggtgacgagcatggccaaatccatctcgctctcgtggctgtggctcccgaacccgtctcctcctcctccggctcctttggtccggagccagaggtctccgacggccacgggcgagccaccggagggagaggcggggaccctggcaggcggcggcctccggcgaggagtgaccgctgccggcggcgacaggcccaactccttggcgagcagcatcatccttcaattccttggggccttggattggaggaggagaaatttgagagaaatgatggctcagcggggtgggggacgagaaattgacgagatctcgcgaaaaggaattactagtatgttatggggaaggaagaaagaatgggcaaggcaacgccagcgcatcgcggcggattgtcggttggttttctttttcttatttatagctgacaggtgggcccgcagagcagcggcgggaagcggtttataccgtttcgatttggcgtttgctcctccgctccgctatccactgctgccatcctggccgttggttggattcatgggattcaatcccatcacatctgcgcttctctttttactcacattaaccattagcttagctgtcaattttttaggtaggagtactttattttggaagcaataatactccctccatctacttttgataagtatatttctaaatctgaaaaatttatttttgataggcatatttcaatccaacaaactattatcttaatgactttcttagatttaacgggcaactctccattctttcacacaaaattgactacatggacatcgagaaatgtaaatattaatgaatcgtttgtttacgaggaataactagtactagcatgcttgtttacgaggaataactagtactagcatatttaaatggatgataagtagaattatttatccttggtctgtgtgctaagatgaaatatgactatcaaaagtatatgaagggagtagtactccctccgtactcgtaaaggaagtcgtttaggacagcgacacggtctccaaaacacaactttgactttatatttctataaaaatatttattgaaaagtgatatatgtatacttttatgaaagtagttttcaagataaatctattcatataagttttacattttcaaactcaacaacttgagagttatttatgatttatattcctaatgtttgacttgaacattgtactaaacgacttcctttacaagtacggagggagtatgtagtaagtagtatatgcaagttcgttaaattaaattagagggtggatagtataaacgggaattattgagtactccctccgtactcgtaaagaaagtggttttggatagtgacacagtctccaaaacaaaattttaacttcttgtttctataaaaaatatttattgaaaagtgatatatgtatacttttatgaaattattttttaaaataaatctattcatataattatttacatttttaaactcaacaactaacaacttgagagttattaatgatttatatttctaatctttgacttaaaaattgttataaacgactttctaccgatggagtactagtagtagatggattaggtgggccggggggacaatgattaattagtcgattgccattaagattttaactatgggatcctaagattagggagagtatatggatctcgtcggtctgtctgcttgcacgtgcctgcgggtaactaattaagctgattcatttctttcttgccgcacaagattaagcatttctttcttgccgcacaagagtaagttaggagtagctagtttcgttagttataagtataaaactatatatatagctgactatgtatactaaaatataagaaattttgtttatgtagttattatagtatatattttgggacggataggtccgatcggaggtagtacgtacatatagtaacagttaggagtgtacaacatagtgattagtaatcatagttagatcatgacctttcgaaccggccgttcaggtacttccttcgtccaaaacaatacaatattatttaggtggtgttacattttaatttagattagtttttttttacggaaaaagtatatagctagctagctctagctgtgtttaatcacacatcggtcagtgtctttttaattagaagctctagagttttggtacagttcgtatatgtgtagtgcacaccaaagataagtagagataagtaggcagtcctactatctaaagaaaaacccacttgacagtttatttttaacatgatagtaattttggaagaaaaaataaattagaagtggaataagcggaaaaagaaacgggtttgcccacccttgcacccctaggattgaggcgcttcttacgaattgataattttcaatgggtcatatcgagaaacaaccatacatggctagaattctatataatttttagtttttcctttaaataaaaatacctcacaaacttttgttttacacacgtatctctgttgaaatcttatgtttttctctttttttttatcaaggggccagatcccatttttatttttattagtagaatgcatgaagacaagagagttttgacactacaaaagcatcgacaaaagaagatttgctcaagcacgctagcagagtttccaacagagaaacagacggggcacttttgccctttgcagcccccccccccccccccccccgcacccaaaaaaaaagtaaaaataaaaataaaaaaaatagagctacaaaaagttccagtaatgacaaccatttccagcagcaaaaagtcttcggttcaggttcttcttgctccaatcctgtagatcatgaagctcaacacagccgtttccagtttgcccttccatattgagagaatgggagttgaagacttcatttgtatgattaattaaatattagctaatttttttaaaaaatggtttaatttgatttttttaagcaactttcgtatagaaactttttttgcaaaaaacacaccgtttagctatttgaaaagcgtgcgcgcggaaaacgagggagaggggttgagaaacacagtctaaacttgtcttcgcaactgaactccccacaactatggctgtgtttagttcagcgcaaagtttgaattttggttgaaattggagatgatgtgactgaaaagttatgtgtgtatgacaggttgatgtgatggaaaaggactgaagtttggatctaaacacagcctgtctttctcgcttttcctcggaaatctgcagaatggcccatgaagacataaaagaacaggcatggtgtaagatttcagtggaatcagcaggaatgatttgatcaaaacaagctttatttctaattttcctaattgcccagaaaactacatcgacccctacaagcagcaactgctttgtttgtttttcacagctttgtaaccaagttccacgcacttgctgtaaatttacaattagtttcagattaaaggcacagattattatgtcccatgtgaacattgttaaagagcattaaaaaataagtgatgaatttgtttcctttatgtcacagaatgggcagttatcagtcctttgttctaacctcttcttttcaagttgtgacactgtttttacattaactagaggaataccttaatttttaagggtattttgataatccaaatcttcatgtgtggaaaacccacattctgtagtttcggagctttatagaaggatttcagagtgaagtttccacttcttgtcaattcaactggatttcatctttttgatccgtcagaggttaattgttacgagcatttttttttattttactctaactaggatcttaggtttttcctccgtttttctcagtctagtcttttaaaggacagagtcttaggatatatgatcgagaaagagaggagtaataaagaaacaaaagttggggtgttcaatctcgttgacataatgacatactcttaggctctgttcgtttcctggagttcccaactcccccatctcattttccgcgcgcacgcttttcaaactgctaaacggtgtgttttttgcaaaaagtttatatacgaaagttgcttaaaaattatattgatccatttttttaaaaaaaattagcaaataattaattaaccacgtgctaatggactgcttcgttttccgtaccggagggatgggttcccaactcaaccaaaagaacagagcctaaatttgttcccaagcctcagaatgcagataatactagtttggttttcgatcgaaacggatggtcgggctgcag

SEQ ID NO: 40169 - DNA, 750 bp, Oryza sativa
gcttaatttattctataccttaaaaaatatgtacgtgttacctccatattttaatataatatagatgtttagaataaactaattaggtaaaaaccaaattagctcctttggatgggaggattttcaaaagaaaaatgaaggatttgtatccttaggattttttttcctatggagtttatttggtttgtacgatttgggcttgcaaaattcctgtatatggaatcattcctatatctcagttcttttcaaaagaatttagggtttctttgaagaaacacgaattttgaaaacactggccgaggtaagaaaaaaaaggatgggagtgccgtcacatctcagatcttatggatagaaaaaacacagaaaaactataggaatgactatttggatggaacacaggaaaacacacaagaattagaagagagatagacacatatgagtttttccaagaggtttaatctcatgttggaaatcctccaaaattcatatgaattgaggcaattctaaggaatttcaaaggaatttaggagagccatttcttcattccaaaggaccccttttataggaatatatctaattaatccttcaaaattcctttgttccaaaggaacccaacctcatgttatttttccccactggtggagaaaccatctttcgtcggtcggccgatttccacaatagtcccggatgcaataaaaaccggggctaaagatgatctttagtcccggttcaaaatggggggcgcaggaa

SEQ ID NO: 40170 - DNA, 13506 bp, Oryza sativa
  unsure (1)..(13506): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgtatctccaacagcatggtcaagtaaggtgttaaacttttgaggaagtttatcaagggtaagctgctgcacatacatagagacaatatagatgtggtagaaaggatgagattggttgtagcagagctgatgagggggaaggaagtattgttattataggaacatacaacatggtaaggaacttgcattatacagtccccctcttgaatgggctccgatgcaaataatgacctgaatggacaaaaaaagctagcagctagtaacagattattatgtagtagtagaaattaagagaacaaattaagggagagaatgagaatgagaatgaccttccaaaggcagaggaggttccgagagataatacagaagaaatgtgggttccagacttgctgcgcagccaacgcaggaatacagagcagtcgcagtcgccgccgccgccgcccccctttgaattccaaaacattattattagtaatagtagtaggcagtagcagctgaaggtactccatatattatgaagcatatagaaataccttggaggcggaggcggcggcggcggcggcgcagcggcggggtgcgaagcggaatcgcatcgagcagagactggctagtcgagtcgtgggattgacctttgcgttagctaagctcaacaaggcccttcttgggccccaacaaaagagggcccccaccaaaaccaaaaaaaaaaggcccaaaaatttaaaaagaaaacgaccacagtgggagtcgaacccacgaccttctgatccgaagtcagacgcgctaatccactgcgctatgcggtcgcctctctttttctgctttatcctttttttatttgtacagaacaatcactgtaccttttttttttactgaacagaagacttgtgactgtatgggattagcctgtcttttaaacacaaatgtactgtaattgatagccagaaggcaaaaaaaacgcgctgattactctggggatgcatgcgagacatggaaggagtagtaatctctgtaagtactgtatctaggaagcatcgtatctaaccaaagcagagaatatgaaagtggctagcaggaacacgtactacgcgctcatccatccatccacccactgattacttcaattaattaatactaatagagatcctgaaaaaaaatgatacgtggtacaagctagcaccaggataagttccaacttgaacttatcttttctttttcttctccactcacctacctaagccgggcggacagaagaagaattcccctttcttttcgtttcaagttagatatgctagtagctactagtaggaatttgttcggttcacactaattcaacgtcatattaatttgtattgtactacagtactactgttccacatcatctaaaatatcgtcagactgtactttttacctacactcgtttcatcctattcaaaatcataggtctccaaccatggttcagttgtgttaggcgtaattagtgctaatagtaagttttttatatttaaaatgaaaattgttgaagtataatttgagagcatttacgaggtaagttgtatcgatgatatttctctcactagctattaagatgcatcgataactttctcgtagttcataatctgtgaattgataccccctcacatttcatgaaaaaaaatggcttttataaatttccgtatacagtagtacttacagatactagtgcacataataatctaaaattaagggtgaagcaagcagtaagcagggtggatgagaaatcagaaggaagcggaagcgcgtggaggcatgggcgatgaggaggaggagatgggccagaactgtgcgggcttgatcttggagacggcagtgagcacggacagcggcgtgacgtggccgacgacggtgaccttcttggtggcgatgtcgatgtccaaggaggtgacgccctccatcttggagatgtgcttcttcaccttccccgcgcatcccttgcagtgcagggacacccgcaggaccaccacctccacctgcgacgatgactctctcttttcctcttctcctcctcctccttccactgcagcagctacgatctcattctcctccgccgcagccgcgacagcaaccgggatgacgaagggcggcggcaactcatccgcgctgggttgcatccgggaggagttgagaaggaacctggacgagcttgcagggctaaccagctgctgcttgctcttgttcgccttcgtcttcttcttcttgctgctgttgctggtgcgagctgggtctcggaggtgcggcggcgagtggccggagaggacgatggaggtggaggcggcggaggagcaggagaggcccagcagccgcttgttcagatccttcaacaccacagacgccatgcctactgcctcctctgcttgttaattactgtactactactgtagtttgctgctgattttgctttgctctcgcatcgcgcgcgcgtgcctcttcttgcttgctgattgctgctgcttcttttaaactccccaccccagcagcagcgacttcagcataggcccaccaaacgaacctttgctttgcttctctgcccctgcccccactgtgctgtccatttcttattcgttttaattttagctaccacagtatactgcgctagtgttttactcctatataaacatcatcttttgtacttacctatatactgtactccatatactatgcaataattaagtacgtacagatcgagatcaacatcgggtcttttagttttgtcttattgtctgtttcatgaatacagtataagagatggcatccacactgcataaatacatacgtatacagattccttcacatgcgcaacaggacgtacatacatgctgctctaccacacttattttaatttttctctgctaattactacaactaatcaggccgccatacattcattaattagcaaacaattagtaaaagaaataatcagagagacatagaccaagtgctagctgcaagctagtcaaatgcagattgatagactgtgtaccacaactagaagatgagagatgagagatgagacaagaggcaactaggcaatgatgcaagcggattattaaaattctagtacaatttgctcactactacagtttactaattagactgcaggtacgtcgccgtcgaaatgtagaaattggattagtaaaggttgactcaactgaaggagaaccactctttcttcctccgcggaaatgaataaggcatctgcacgtaccttacctttcggcccatcagtttgaaactcatgcagtgcaggattacttgtttacgaattagtatgagtcagtggtttaagtatatataaataataaaaaaataggcacggatcagctgagcaatttgctttgttgacattggtacttattactgctcttttcttttctttagggaccctacatattgacgactttgggtttatctttcttacttaatttggtgagtcattaattggttcatcatgatcaaatgatgattgtctgcactgaactgaacaatcaatcggtcggtaagctcttcagtcggtgctccgttcctgtcacctatacttacttgttcatctttaattactcccagtcttactacgtgttctcccatctcaagtgcatatgctcaacatggagacactcctcctactgctgcatctgaatggagcaagtagttagacagtcagtcactccttttagcagaaaaaaggctgatgatggttgcttcttgttggtcaagagaaaaaagaatgaatcacaaaattttaacaagattaagaatgtaagcatatataggcacccactgcattagtatatactatatagtactagctagtaattgctccctgaatttcttcacctcgagcctaacccctgaaagaaaggaagaaaaaagaaaggcaaatggcaacgccaggagacggctagctaattaagctagaattaatacacgcactgattaagctagaattaatcaaaagctaagcaaattcagttgacgagtggactagtgtagacagtagcccccaaggcccaaacccccggccgcaaaagaaaagaaaagaaaaaaaatcacatgctatgcaccatcggcggcttctggtgaagctccgactctcgttaatttgtacaccttaggtccggaggaataatcgaaaataatttggcagtctcctctttttcctttttttttggggacaaatatatactctacctcctttcactttttagctaatcgtagtatgctctatctgcatatatacatcgtgcttgcttttctgatatagtatatgcaaatggctgctggaatgttgaggtttatatgaacaacccctgtagttagctccttttcttcatttggaatgttgagagttctgtacggttcaccagcagcaaattcggcgttcaagctaggctgtgtttacttcagcgtaaagtttgaattttggttgaaattggagatgatgtgactgaaaaagttgtgtgtgtatgacatgttgatgtgatgtaaaaggactgaagtttagattcaaactttggatctaaacatagccctagcttagtttttttttgtctttttattcatgttaaattattgatttcgatatgattctgatcaatcctgttaggtttttgttcatatcatatctggttcacactcagaaaaaggtttgcaatctatgggcaatggtgagaagcttctcatccacgactagaatagaatctgatgctgccaggcaggcaggcagccaatggactacggagcactctactccaatgatcaatccctttattttctttctttttttggatcatttcttttttcttttggaaaggcttcaatgatcaaggtagaatactaggtatggaaatgggaaagaaaagaaaaaaaaattggaagatacggtattgggccttgcaaagaaaggcataagggagagatggagtttctgggccaaagttaattcagtgagcccgtccggagtaagagtattaggataagttcacttaaggtccctaaggctgtgtttgagggaaaggtgattgagaagattggaagaaacgcaaaacgaggtgagccattagcgcatgattaattgattattaactattttaaacttcaaaaatagattaatatgattttttaaaacaactttcatatagaaaatttttacaaaaaacacaccatttagtagtttgggaagcgtgcgcgcggaaaacgaaacaaacaaactccctttgttctccaaacgaactcagcctaagttgtccctgaaacgaaattagatcccaaaacggtttaaactacggtttcaactgatgtaccgcctacgtggatggtttgacttgattcatgtcccatgtggcgttgatgtggcactataagcaatatttttttaaaaaataaaataaaatgtttgggtccatacgtgagataaacaaataaaaagtatagtggggaggcatatgtcggtgagtcccacttccttcaaacccccttcaccccccccccctctctctctctcttctctatgtcattccctttgctcccaagctattggcaaggaacacagcaaacaacaaagaggtaccgaggagggagtcgtggtgtcctgcggcagcggatgagaggacgaaggcaaggagagaggagctataggagccctcccacagctcctaatattcgtcactggagcagcttgccttctcgcggctctagtaaaactaatttacataatatttttttctaaagtctgatgtgtacctttttttaaaatttttaatgttatattttgttgttttgataatcaaaatagaacacatatgtgcctcttgtctaattcctatggaacacttcatttatttattttttcatttatgtagtatttttatttttttcttcaattaatatatggtaatttctagttatcgaaagtgaacatcggtgcttttcttttagtcccatatatctagcaattacacactttgtatttttaataaattttattatgaatttattccaaatttcttattttgaaggtttatttgaaattagtattgaaaatcaatttcgggatttattttattacttagttcggattttaattagtagtcttggtatgcagtatttatttatttaaatttttactcttgtttttgaattttagtgatattttaaagcttatttggaatctattttgttcttattcggaattttaattaatatattttgggttgatgatggagcggaagtgcggaggtggtgagatggggtccatgcacgcaaggtcgcgctggcgcgggcggcaggtaatcgatctgggccggccaggcctcagtactacgagtcaatacacgaacggaacggacgtctcggaagataagtgattcatcgcccgatccgatccaaccgggaacggatccaaggatcgcaggccatcagcttccttatccggctaactgacgataattatctttgaatgcaaccaactgaacttgctgcatgtacgcagtcactcccaccccacctggactggagcatcttctataaatagctacaatgatcagtctccctcccagttaatcacttcaccttcttcattcagttcatccaatccacgatcacttcctagcaattaagatcatggtgcagcgcacttcatccgattcggcggcgtcggctgaggccatggtcatggacctgagtcccaagcgtcccgccaagtcctacggcggcgaaggcggctcgtactttgattggtccccctccgagctgcccatgctccgcgccgcctccatcggcgccgccaaactctcgcttgccgccggaggcctcgccctccccttctactccgattcggctaaggtggcctacgtcctccagggcaagggcacctgcgccgttctcctccccgagaccccctccgagaagatcctacccatcaaagagggcgacgcgctcgcccttccattcggcgttgtcacctggtggcacaacctgcacgccgccaccaccgaactcgtcgtcctcttcctcggggacacatccaagggccacaccgccggccgcttcaccaacatgcagctcaccggctccaccggcatcttcaccggcttctccaccgagttcgcgcccgcgcctgggacctcccgcaggacgccgctgcctccctcgtctccacccagcccggcgccggcatcgtgaagctcaaggatggcttcaggatgcccgagggttgcgacaaggacagggagggcatggtgctcaactgcttggaggcgccgctggacgtggacatcaagaacgggggccgcgtggtggtgctgaacacgcagaacctgccgctggtgaaggaggtggggctgggcgccgacctggtgaggatcgacggccactccatgtgctcgccggggttctcgtgcgactcggcgtaccaggtgacgtacatcgtgcggggcagcgggcgcgtgcaggtggtgggcatcgacgggacgcgcgtgctggagacccgcgccgagggtggctgcctcttcatcgtccccaggttcttcgtcgtctccaagatcgccgacgacaccggcatggagtggttctccatcatcaccactcccaaccccatcttctcccacctcgccgggaggacctccgtctggaaggccatctcccccgccgtgctccaggcctccttcaacaccaccccggagatggagaacctcttccgctccaagaggctcgactccgagatcttcttcgcccccaattcgaattcgatttgatggacaatatccatcctccatctccagcacctgcccacctagcagcatcagcagattcagcttccttccttttatttagatcatgtcagtcgttagatttaattcggttctttggttgttagcatcacctacctcttttatttgataataacaataagctcgagatggagtggaatttgatagtcctatcatgcatatgtcctctttatttttttaaaactctgttttaaagtcaacagccgttcgattcgatctgccatgcatgaacgaactggttttatcagattttgtttgttttacagtggagtggagttgttattctgagaggcgcgcgatatatatgaatctaacaaattggctgcatgaatgggcgccatatatccccgctgcccgcgctaacaaacaaaggcggcgagtgtgcgtgggatagatcataatagatggacgcatgatgattgcacaaaataacctgtttattgtgttttcttgtctcctacatctaggagatgaactgtagagggagatgagctgttaatcatgcatgcatgctgctttcattgttgttgaacaggggaaatgcacactgctatagctctgaatttagtgttctgatttttctttcgaaatcattaattcaaatcttaacttttgtggaattcctgaatctaagctatgaattcagcacttaatctaaactctgaaataattcccgtagtcctgaaatcaatactacttcgtgtgctcctaaatttcattttagtggtacatctgcaaaaatcgttatggtatcttgtcctctactgttcaacagaacttgtttcgcagctctagttgatgattcttttaaaataatgatttttcattaatccagtctcaatatccaacaaggatatacataaccaaattatccacatagggtatatataacgaaatgaatacctaaaacacttagactcgcatctcaacaagaagagaacatataaccataaaaaaaacaagaagagaacatacaaccataaaaaaaccatgacctcggtacacatttgctttaggtgagttgaattgatgccacgtgccgctggttagcccaccctcattagttgtcgtccagtcaaaactagccgactagacgggatccgcttccgcgccttcgccgcatatagagcagctgtcattgtcgagatcctcttccgcctcccggactcccaaccttccaccgcccctaggaccgcatatcttgctgaaatcccagttctcctccaccgacgtcgaggaaatcctcttccgcccgaactcctaggtctctgccgctctagttgatgatggaaatcattgacaagaactatagcacttggaatttagagtagagttctgcccattttgctaacagagtgtgaaattcattaagtgggctataaaaattcagtatggaaaacatgaagttgcgagaatctttaggcttagatcccaccccaaaatttttcaccatgtcacatcaaacgtttgaacacctgcataaagtattaaatatgggttaaaaaaataattaattgcacagattgcgattaatttgcgagatgtatcttttaagcgtaattgctccatgatttgacaatgtggtgctacattagacattttctaatgacggattaattaggcttaataaatttgtctcgtggtttactgacggattctataattagtttttttattagtgcgcggacacccaatacaacaccatatataatacccgatgtgacacaccaaaactttacaccctcttagatcagttagttgggcttgtgcttagaattttacatggttgtccaatattatctgagctatttatgacttttattattttttaataagagagtaaagaggaggagtaaagaggcaaagagtagagtagcaggaacccgaaaacgcaaaacagcagaagatggaggtgttgagcggtaaaaagagccaacctgtaaacctaaacctaaagaggaaagcaacagcagtagcagtagcagtagtaggctagtgtggcgagtagtagtggtattcccctcttggtcttggtgttgggctccgatccgggtcggccggcgatcgaggtccgccaccactgaccgattcacctcgccgcccgccgcccgcccatgaagcattcttcttcttcttcttcttcttgggtcttcttctagactggactaccttgtttgactagctagctactaaggtagtgtggatgccattcaaatctgcctccgccgccgacgagtactagccgctgctcatggtttcgcggggcctcttcggctggtccccgccgcacgtccagcctctcactcccgtctccgaggcctccgagccgccggaatccccctctccctacgccgctgacctcgccggggacgccgcgccgcctccggaggatgacgccgccgccgccctcgacgatggggacgacgagcccgatccgccccccgccgccgtccccttcaagcgcctcttcgcctgcgccgaccgcctcgactgggcgctcatgtccgccggcgcccttgccgccgccgcccacggggtggccctcgtcgtctacctccacctcttcggcaccgccatccactcgcttcatggccgccacaaccacgaccttttccaccacatcaaccaggtaaggttccttcattcccctttctcatacgtactaccagatctccatttttctcatatacatgccactccactcctacatatatggtatacgtacgccccgccccaccccgcaaatcaacattccttcttacttggcgcagtaatcatgcaaatttccttggttgttacagttacaattcttctgccagctttgcattagttatctccaatttcataagcaaactacctagttagtattagactgcagatttattcttaggcttgtttggtaagctgtcattatttatttctgcctctctctgatgttgatttagataagctgctgaccttttacgatatggtattgctaccggtgtttataggcgtatggttgaagcttatatcactccatgtctgaatgtgccgctttcgctagcttttctatgacctatgcatttatgcgtgttcagctggaaccaacctttcgctccaacacactgaatgaaacaattcgctctcacgcgatgaacctttgcaaattcatttactagtaaaattactttggcagcttgctggttttctaaaccttcacaattttctaacctccacactaatatctgtgcatttctacactcatttatgcatctcttgtccatctatctaattggttacactcacttttatgtgaatatcagcatttgcttgtccttctatctctgtataatcattttttctcagaattatgtatctttgtgttttggaagttagtaactaagtgttttacccgcagcatgctttacacttcctatatattgccattggcgttttctttgcgggatggataggtaagatgaggctacatcagctttttatgcactctctgttttcttttattctaacaaattcactgtctgttatatctatagaggtttcatgctggattcttactggggaaaggcagacagcagtgataagatcaaagtatgtacaagtgttgttaaatcaagacatgagtttctttgatacctatgggaacaatggtgatattgtcagtcaagtgctgagtgatgtcttactcatccagtctgcgctgagtgagaaagtgagtaattatgagccttcatgattattcacaacaaatcgcatgcttatctgactgacaagggttattctcccattctggctttgttcttttaggttgggaactacattcacaacatggctaccttttttggtggtcttatcatcggtttggtcaactgttggcaaatagctcttttgacattggctactggtccgttcattgttgctgcaggaggaatatcaaatatttttctccacaggcttgcagaaaacattcaggatgcgtatggtgaagcagcaagcgttgccgaacaggtattcaaattctttgactttcttttatcctgtaatgactgcccacatctcatccgtgaataaccttggtttgtcctactttctcgctacaaacgactatttctaaaaagatgagagtacaacatcatcgtctaaaaggataataaatttatggtcttgaaattggtaggcctctagtgatgtgcggaatggtggatttagctaggaatatacctcttgctaaaatacaaaacacactttcctttcgcaactgcatgtagcattattattaattgctaatgaaggtatgcatccatttgaatcattctcattattgcaggcaatcttatacattaggactttgtactcattcacaaatgagaccctcgcaaaatattcttatgctacttcacttcaagcaacactgcgctatggaatcctgataagtctggtgcaaggtcttggtcttggatttacatatggccttgccatatgttcttgtgccttacaactttgggttgggaggttccttatatctcatggaaaagctaatggtggtgaagttgtagtagccctgttttctattatcctgagtggcctgtaagcatccaattttaagagattgccttacttatagttttatattgatcagcacactcatggttcccaattgtttgtaggggacttaatcaagcagcaacaaacttctattcttttgaacaaggacgtatagctgcatacaggctctatgaaatgattagccgttcaacctctgttgtaaaccaggatggccgtaccttaccttcagtgcaaggcaacattgagttccgcaatgtctacttcagttatctatcccgcccagaaatccccattttaagtggtttctaccttactgtacctgctagaaagactgtcgctcttgttggcagaaatggttcagggaaaagcagcattattcctctcatggaacgtttctatgatccaactttaggtattatgcttacaagctattctttgctattttctgtttactcaattatgaatttgaatcatctttgttatatgttgcaggtgaagtgcttttggatggagagaatataaagaacctgaagttagagtggttaagaagccagataggacttgtgacccaggaaccggctttattgagcttgagcatcagggaaaatattgcatatggaagatctgccacaactgaccagattgaggaggcagcaaagacagctcatgcacatactttcatcagttcacttgaaaaaggatatgatactcaggtgctgttcatgctttattctaacatatattgaaactgtgaaacttcttattctcttttaccggtgaacgtgcttattta

SEQ ID NO: 40171 - DNA, 1658 bp, Oryza sativa
gttttcttgaagttggtgctgcagctcttctagttggagatatggaggcgaagattaatgatcaacaatggaaatattcttttatccaggactttcctgatattgatctgttgcaaccttcaacttctacagcaagtacttttgcatcatcacagagtcacttgaaagcaataactgcctcaaaacgcatgaaatcaggccctaatcaagtttggtaggttttttaaagtgatgtatagatgtctctgcatcagtttgcatgaaacatattcacactgctttacattctattttcatttcttttttttttcttgaaaagaagaccccttgacatatcgatgctcttcaagaatttaccctggaaaatttgctgaacgtttctggttgtaattataattctttttgggattattgcttttgacaccagtggtgtatactaattgttttatgtatatgtccttatgagtaaaatcgtcatcactaaaccagttattggacataatgtttatgttttttttgaaatcaacgataaatgacaatttcttatctatgggaccatctacttcttatgtaggatgaacatacctgcaaatactttccagcctcgagcacgtcccctttttcagtataggcactacaggtacttttcttgtttcatttattcactctacataatccagggcagcatttgaaatgcttatataaggccggtttcagtgttgcattacagaaattgaactgtaagtgtttatattacagacatacagattgatgtagacaatgaaaagaagaaacaaccagtgcttaattgacaaacctatggagacacaaattatattttgtcaaatgattctctctctctctctctctctctctcgctgcccctatatcaatttgccatattaattgtagatgatatgatgttcttctataatcaacagtactcgtttgagatatatataactgttcttgaatatgagtttgtctctttatctattttttatggtcatgtttaacaatgcgcttgaatgtcttgcttattgtgttacccacttttaccagtgagcagcaacctttaaaattgaaccctgccgaaatttccgaagtcatagctgaagtttgctcagaaacaacttcaaactcaaatcagttcagtgctccatcaagattgaccacccagagtcgccaaccttcagcagatgtggcattcagtgtccttatcaaacttgttatcgacatgtaaataacattacaccctattcatttcattttgttttgtttcattgtcctccattcacacacctgtaaatgttcgtgatgtatttcatttacactggaatccttgatagtgtggctgcgtagtttcttttagggcttttactgatagctcaattgttggcaccattacttattcttatatcatgtctcaatgaatcatttattacctgaataaaatatttttatagttgaggcagcatttagagtataaaacacatactgtatctcgctcccattgaattagtagttcaagtaattaattgctgttcctttgtgtacatagtaatgttgtgagctacttcaggagatacacagtgtagatatcgatatttctgagtaaatatgaacacatctcagttaaaatagttgagattatcttg

SEQ ID NO: 40172 - DNA, 1228 bp, Oryza sativa
aagaatttcgaaatagcgggaaaagatatttactcccggttgttgagaacaaccgaaactaaagatatctttagtcccggttgttgagaacaatcggaagtaaatatcttttctttactcccggttgttctcaacaaccgggactaaagatatcaagatatctttagtcccggttgttctcaaaaaccgggagtaaagatcttttctttactcccgtttgttctcaacaaccgggactaaagattattcccggttgttgagaacaaccgggagtaaagatccaggggtatatatattcccagtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatgcatctcgatctctccgatctcgatctctctccgtcgcgccgcccgccacgagacgccgcgccacgacgacgacgcgccacgccgccgccttcgacgccgcgcaacgccgccgccgcatgccaacgccacgccgccgccgccgtcgccacgccgccgccgccttcgccgccgcgcgcgcaacgccgccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaatgaacacgtcaacgtacgttgccgcgacaacgtgaacgagaacgagaacgatcgaacgaacgtgaacgagctagggaacgtgaacaagcgaacgaacgaggacgaacgttaacatgaaatgcaatatatatatatatatatatatatatatacatgtatatatatatatatatatatatatatatatgtgtgtgtgtgtgtgtgtgtgtgtgtgtgtgtgtgtgtgtgtgtgtgtgtgtcggtgacatgggatcaggagtatcatgactagaggtttgaggcagacacaatcgcacacgtggcctggcacccccgagggacgtcgggcccgagggtgatgtgttcgccctcctcttagtccccccgagggggtc

SEQ ID NO: 40173 - DNA, 11146 bp, Oryza sativa
atttttccagatagggaacccagaacaagggggcgggtggctcatactttgtagctccttcatacacagatctcccaaaacacaggagtagggtattacgcttctcagcggcccgaacctgtatacatcgcccgtgtcttgtgtgtttcctgtctcgtgaaccttccacatacagagagcttagaatctcaccctgagtccccggccgaaccggcaaaggggggcctacgcggtctcccggtgaggagccccacgctccgtcatctggcgcgccaggtaggggactctgcgagggattttctgagctctcgcactctttcgtgtgcgccaagcttttcctgttcagcccaatggccgagccggcaaaggtgcacgacctctccccgagtatgagcggtgacgacggggagccaaacccacgtcgtcgagctcgtactccaccgccccctccacgccaaagtcctaggtgggagaaggcgctcgagagggccgaaggatccgcgacttcgacgcccacaggaggtggagaagggcggcgagatggggagcgtcgcctcctcgtctacggcgacggcagcacgccccagggcgcgctccaagctgcgggcgcgctcctacctcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcgtcgtcaagacggagggcgcggcgagcggcagccgctgttcgccattcggccgccactccttcgtcaacgcctccgacccgggaagatctgcgtggggaaccggatgcccgcatcagtatcgagcgccggcgtaatggccgacgtgctccccacgcaacggagggcgcctcctcgtccggagtgtcacctcaccaaggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgtagggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcgattctgtcaagtccgcaacaccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccgattccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccagtagggagcgcccaaccggcaagtggtgcatcgtccacaacacctcccttcacgacctcgcggactgccgcgcagtcaaaagtttggctgagcggacgaggaagtaggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggagcgtgtcctcattgatgggggagtggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcatggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcgtccaagcccgagggtggcgacgagaggcttggcgcctccgcccccgccaccccgaggcagcggatgatcacaggcgacgaggtcccggtcaaggaggttgccctgggcgacggcccgtccaagaccacacggatcggtggtcttttggacggcaaataggaagacgcgctcgtctccttcctacgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcttccatccggagtggctggcgaacccggtggtcgttcccaaggcaaacggcaagcttcggatgtgcatcgactacaccgaccttaacaaggcatgtcctaaggatccttaccccctgcctcgcatagatcagattgtcgactccactgcggggtgtgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaactttactctcagatctagcggaaacttttgagagtctccgctccgcccgcataaaactaaaccccgataagtgtgtgttcggtgtacctgcgggcaagcttctcgggttcttggtctctgcccgaggcattgaggccaatcccgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccaaaaatgccctcactcagttgaaggcatgtctaagctctcccccagttctggtcgccccggagccagacgagcccttgttactctacttagcggcgaccccgcaagtagttagtgcggcattggttgtggagcgcgatgaggacaattctcatttcacgcctccccaccctgtgccgacttggcccgggagagagcagggaggagaggctcccgagccgaacggtggcccagggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggcctaaggcccctgacgaccggagttggccctttgcccgcttgtccgacgacgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctaatggcctcgaggaaactgcgccattatttccaggcgcatcgggtcacagtagttacgtcttaccccctcggtcaaatcttgcataatcaagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggagatccgccgcctcctggtgttaggcgactcccagctggtcgttaaccaagtctgtaaggagtaccggtgctctgacccgcagatggacgcctacgtgcgccaagtacggcgtatggagcgccattttgacgggattaagcttcggcatgtgcccagacaggataacatgattgccgacgaactctcacggctcgcgtcctcgcgagcccagaccccaccgggcgcctttgaagaaaggcttgcccagccgtcggcgcgacccgaccccttaggggagacggatgcgcctgatcggcccccgaggcccgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccgtttgctgtctggggactcgatatcctgggaccgtttaggcgggccccaggtgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttggcagcagtgctctgggcaaaccgaactgcaccaagccgagcaaccggggaaacgcctttcttcctcgtctacggcgcggaagcggttctcccatccgagctcactctgaggtctcctcgggctaccatgtattgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgatgacctcgtcctacgccacgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaggtttcgggctcgggccaaccccgcaccccctcgggcgtgtagggttggccgggggctgccacacatgcacattgttatttcttttttttttcagtacttcaataaaagcagtttcaatttcctaaaggctgtatctgtgctgttttttccttttgaaaaatcttgacttgaaataggtcactcgtgctcaatcctgccctcggaggctcgggtcggctaaaatcgtcaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgtcgtcactgtcgtctgcaccaccggcattgccctcctcgtcggagttgggggcgaacgcgagccgaggggccgagccctcgaagctgtcgacgatatggtcggcggcatcccggacctgcgcgcgtgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcatactttacggtccgccctctccagaggcccacttgccgaccggcgcgatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcaagctcagcggcccgttggttcagtacggccctctcggcgcgggcaccttccagattgcggcgcgcctgctcctcctgcgctgcctcgcggagggacaggctgaccgccagctgttgcgccgcggcctcggccccctcgagagctcgctcccgctcagtgagcgcgtcctcgcggaggcggagcgtgaactcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcacgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgtcggcggtgagccttacggcccacctccaccatggcctccaccgagcgtcgcccctcttcgacacgcgcccatgcggcgtcgagctccgcccgctctgcctgcaggacctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgccgatggaagtgccggactcggggatgtcccccggacccgtttggtcctgagcgtcgcccgagggagtgggcccaagcgacgcgcccgcagcctcgtcgccagctgccccggaagttgtcgcctgagcgtcacccgagggagtgggcccaagcgacgcgcccgcggcctcgtcacgagctgcctcggaagtcgccatcgcctcgtcctggcgaaatccggcctcctcccgagcggcttccccggcctggcaggcccgggcggcctcctcccgagcggtttcctcggcctggcgagcccgggcggcctcttgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaaaccagaagacgaacaaggtgggtgagtgaaaactcgcgttgagagaatgaatacagccacgatgggtgagagatgaacctgcgaggaggtcggttaaacgaccactttggaggggaaatgaggtttccccgagatggttctgtctcccccatcttacggggccgcttcttcttgcgctccccctcgggctgcgatgttggcgcggccccctccgggcgcctgctgctggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcccgcgccgtcgtggccctttggagctcgctcctctgaggccccaaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtccttgtgaagtcttcggacccggtgtactcccaggcgtcccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatgcgggaaggcggcagcacgctaccatcaagcagagcggagccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtcaagattcgtgtgctactcaagtaatgtggcagtcttgaagagactgctcattgttgacagccgaattaccattgccgatgtgcgtggtttgtgaccgttgggtttctgcccaattgtggagaccggtcccacctgtcaccaggccttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggcacccccgagggacgtcgggcccgagggtgatgtgttcgccctcctcttagtccccccgagggggtcgggccacacccgcctcggccccgagggccgaggcaccccgacccctcgtgggtttttgctccgcgtgtatgggttagg

SEQ ID NO: 40174 - DNA, 9178 bp, Oryza sativa
  unsure (1)..(9178): unsure at all n locations
acctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgacgggtctgacaccggtcatgtcgtcagcagacagccacgattccacgtcgcacctgctcccggcgaaagtggaggtagttgtgggccgtctcatcagaagatgactcggacggcaactatacaaatctccgtccatttatgaaaaggtggggtaagtccccacaaaaaagagagaaatggtgcatgtggtatccccttaagatataaaaggaggacctagcccactgagagaggggactgatttttccagatagggaacccagaacaagggagcggctggctcatactttgtagctccttcatacacagatctcccaaaacacaggagtagggtattacgcttctcagcggcccgaacctgtatacatcgcccgtgtcttgtgtgtttcctgtctcgcgaaccttccacatacagagagcttagaatctcaccctgagtccccggccgaaccggcaaaggggggcctacgcggtctcccggtgaggagccccacgctccgtcaatatgttacttcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaatagatggctgaccgcgatgaggaacagatattgtacgatacaatcgcggagggaagcagccaatactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccaaattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgtcgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgagtatcgagctacgaactcaacatgcaagaggaggtggcaaggaaggttgatgaacgcatggccgcacatcggtcccatgatccccagctgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattctgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcaaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcagagcgaggatcagggacacggacttcttgcaaggagatgacattctctggatcaatttcaggggaatctacgaactataccagctagacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacttcgaaatcgtagctagctaggacatataatggattgtaattaatacatgactacatatgtttctatatgcatgtatacacattttctataatgtaaatatattttgttcatatatatatctatatacatatgcatttgcataacatatatatgtataaatacatatacatatatatatatatatatgtgtgtatgtgtggataatgatagaaagttttataatatgagacggaggaactagtcaactggacgtggatcgatggataattgtggtgcgaagctgttatgtgcggtgcaatataatagtggtagatgcatgtcgatggagtcaaacaagtggactatacatactgatcagctaggtacgtccaataagtcaaaggaagggtcacggggctggtggcatctctcagctggcactaattaattaagtacgagtatattagagtacacgtatatatgcttaattcctgatttatttgctatacatacagtagctagctagctaattaaggtaggcggaacgaacagcatgcaggcacaggctcttgagatgtaattaagtaacgtatctctagctattgcctttgcaatacaaagcttgccgatcctacctcgaggtagctagtagttgttacacttacacatcaatcacaacttcacaggtagatacatatactcctatatagtaatatagtttggatctgcatgcagcctactactactaacccggtttaattaacacaatttattatttactactaactaacgtacatatttctagcgattagcttgcaactaaaagacagatatgtataaatggagatatatatcgtaggagtatcacatcatattctagcatgatgcaaagagatagtactgtagtttggccgacgggattgatatatcaatgcatgcatgcatctgcatggatcgatgcatttgctgcctgtcaagtcaagtcagcctactctggttgagaatgaatcgtatgctactatacttattattattattattattagaatgaattgtactctctccgctttaaaaaaaatcaatcctaagccaggattgttttatttacagagtttttttattgtccttgacaataagcggtaccaaatcgtagccgtcgatctagcgacatcgaacggctgcgattggtccgtactgcatggtaccgcaagccccgattgaggaggtaccgcgagtgggagggtaaactagtacttccacgtccgagctcatccgtttgcggtgctttgatttgcagccctttgggaagaagggctaaaatccaatgcgagctcgccatagttttcgttcgctggccgcaactggtgagcatcgtggacccaaatccattgccgccaggcagcatcagtgccgtctgctgcattgtcgactatcgccgttagggatggatttggaacccacggtggacgccgccaactccgaccgtgccagaagtacaagtccggccgcatcgccagccgccgtcgacgaggggcagagagggagcagcttcccctgggaaaacacctcgaaggacacgcaactttccttcttactgcctatatgctcgattccacggcaaccaaacgcgttcgtcaaagtagaatccacgaagccaatctggtgattcaagacgacccgtactagcagcggcggcgcgacgacaacacactgagacaattcgctcaacaggcgaggatgcgacggtggcctcggtgagggcgtcgatgcgatggcggccgctgcggcgtggatgcgacggcaaggacacacgagttgggatggcggtgagagctcgcaagggacggaaagcaggaggattaagaactacgcagcgacgacatctgacggcctcacctacctttcggtctcccgcagcgacggtgtcgttcctcaccgatggattttttagcccgatcctacccctcctaaaccaacggtcagatttaattggtacctggtacctcatagtaccttctcaagaataggaaaaaagtatactactatacttattgctattactgttactccatgtgaagcccatacaacactaataattatagtgacttgagtagcaccataatattctaagtttaaattttcatagattaagccaatgtgaactgttctccatagatcaagttttactgtgatgtactgaactgttttttttttcgtttttaatttctaggagctgaaaaaattaaggcaatgtgttgaccattcgatgttgatccaacggatggcacaaatccccacaccgcacgacacctcggctaacaactggctgagcgtcaggcaaggcaaaggggtccgtcctataaataaaggaaacagaggctgctcctttatagcttcaaggtctgaaatcttccatccccatccaggactttgatgatctcttctcttgagtcttgatccatccatcacccacaataatcctaatcacaagtgggcgtgagagagagggggccagaaggtcaacctttgatttaattagcaggcaggaattaagaggcagctaacagtagcagtagcacacaatcaagctcaaccctcatatatcccgtgatccattgttcagacctgccttattactagctgtagagatcttaattttattgtaaagcaaagctctcacctttatttataactagctgcccttcccttgcatcctattccttccctgcatcagagcagcgagctcgctctccatcccctgcgtgccatgggcaactgctgcggaaccaagattagctccgacgccatctcccggaacgcatctggtaatctagcttcttcaattcgctctcgtatatatttcaccatctagctagctgcataggacgtactaggagtagatagattcttgattcaagtaaaaaagtaaccgctgagtagtgaggcatgtatgattaggaatggagatgttcgtttgtgcctgcctgcaatttgttgatcattcctaattgcttgagtttgttgaaatcgatcctagtaggttaggtagatcatgccgtttccagttccagttgaactgaaataagcgatcggtttcagacagagacaggacgacgcctgcacatactagtagtatatcatcttgtactaatccttgatggactagtatagtatgaaatcattcacttttgtaactaaatattatggtcatctcaatcaatctgagaaagaagttgttatatagatgaggcttctgcattgtgcggtggcgttaactggttggtaaattgacaatgcatgcgtatgatatgagctcattaattggtggtcaggttcaagaagaagaagatcaggaagcaggaggaaggggacggggctgagcagccgggtgtcgtcgtcggtggcggcggtgaccccacggagcgagggcgagatcctgcggtgtgccaacgtgaggagcttcgcgttcaacgagctcaagacggcgacgaggaacttccggcccgacagcgtgctcggcgagggaggcttcggctccgtcttcaagggttgggtggacgagaacaccttcctccccagcaggcccggcaccggcatggtcatcgccgtcaagaagctcaaccaggacggcttccagggccacagggaatggctggtatggattttctttctttctgcataactcttgattgatatactactgtagtatataataacttgcattttaatttgcaggccgaagtgaactaccttgggcaactgtcacacccaaatcttgtnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40175 - DNA, 3354 bp, Oryza sativa
cccggttaaccaattaaaatgacgagagataccattgtatatagtatatacgcatctctaatagatgaatgtggacatgtggtacctaaattgtgctcagaaattcagcacactaaacttaaatacttcatttatgcccaaaaagtcacataatttaatatcccagtaaaagttttccctggcgtgaaaatggacaaaccttgtgctcacacatcaacagtgcaaacaaaactcctgaatcagcaatgtcttgtaaaactgcactagccgcctgccttgtggattgggcgaggggaaggcatgtgtacgcatgaagaaatgtagcaggattcctgcagaatggtttggtgagatttagttgggcaactagagtgtaaaatatttcaggcaaaggaaaaaacaaaactgaccagctgaatgcatgtataagtgataggaaaactgcatctgtgccacctagcaatggtgccatatcaaatttagggttcttctcaaagcatctgttgacagacttggtcaaaatcagcagcatctacaaattaaattttcagatagagaaatctggatgagaactttagaaagtaagtttgtgtaatcacaaccaaaagcccacagaaattaattgtgttaggatgaatgcagcaggggaagcacctgaccatacatgagctctattgtcccctcaatccttcatatgactcttcagtgcaacttatacaaactaagtatattggacccttgacaaggaaaactatctgaaagatggagaataggtaggagttagaaagatttggaaataagaagtccatgttaattatgcttggatttatcttcgaatgcggcataaaagtatacaagttttggacaggaagcccacatcacctgatgtttggcagcccttacaaatttgatatggtcaccactggaatgaatgaaaacaataggtcattgccgaaaagaaagcaccaattgaagaagacagacagacaaacagataaggttaggccacaagagaagagaaaagaatagaagaaatgtgatcattgggtatcattacacacctgttctcaacgaaagaaatgattgcttgcaacgtggcggaaaacccagcaagcttatgctcatctccatacctaagaattggtttgttttttgcacaagtggtggaaaaattgaaggggaaagagaatgcattaagtgagggtggcaaagggtcgtttgttttgtgcataagtggttgttcttctttttataaaagaaaagaaaatacctagaataaattggcttgccagaattgctcaagatgaagaagtgctttttccgtttgcgccatgaagcagaagtatcgtcctggaaaaagaagggaataatggtacagtacaggagtagtagttagtccagattagaggatgtagttagtgcggagtggtgatccatggagattggagggaggaggcatatgatatggaaaacctcgtgagatgcttcttgtcgcggggccaatcgtcgtcgtcgggttggggttggggatcgtcgttggcggcggcgctgcaggccaggctggtgcccctctcggcggcgtagccgctgctgctggggctgggtggagccacgtcggcgtcttcgaggtcgtccttccaggcggaggcggaggtgctgatgctccctaccctggagacggcagtgaggtagccctcgtcgtagtcgtcgtagtagtcgtcgtggatctcgaagtcgggagggaggtgagaggtgcggagggagagggaggcgagcctcttctccggcggcggggagtcggggggaccaggggggctagggttattggtgggaggatccatatccatggggggccttcccgacgcgatgccgatgcctcttcttcttcttccttgctcgctcgctcccctcccctgtagagaatgtactctattcgattcgatcgtgtctttgctgggttgggtcgcctccgtcggtcggattcgatggaacgagaccggttgttggctccctttggctacactacacacagtttctctcccttccctggatctcttctcctctacatacagtccttcattcattcacttgggttcaaatctacatatacatacatgttataccagcaattccttactattagtaaatccctcgtgccttcgtttcagcacgcacgcgactgacacccaccaaaaaccgcatttcgtctttggctatcgcattttgctagcacatgatgtgtttctaactcccatctctctttccccctacactacagggatgtactacaccaggatagatatagatattaaccacacaagagaggggcaaaacacacacaaccggaaatataaccaactcttccgccgccccatcattccattcaacaacccagagctttgctccattaccaaactgagtgtatcaacaaattaattaccagtgcgcctgcttaaacatgatcaaacaagaatacctacccactcccacttccagcacacctatgcccaaaattacttctactacttccaccaaaacaaatataatatcccttccctaattacacttcaatgcagtaccaaactacacaacacacccccccccccccaccaagaattccatttaagtgtcaaaaataaaatgccaaaactacatcacactatcacaatgaacaaatccgatctaataacgatcagttacaaaaatgaatgaataggcaggcagcgcagcacatggaatgttgaccaattccatgtgctatatgctattccggactcatcaaactctcaagtcaatgttggagtggattcaatgggacagcgcatctcagcttcacctcctttatgccgcatgctatatgctattccggactcttcatctcaaagctttattacagcaaagcaaattaaaatatcatgtgtccagactccagagcctgtgccaatgcctatgcctatcctgtcagatcgcaacacaaatacttgtaccatctcatactgtctccaagctgccttccacgtttccagtcactagttagtgaagcagagtgagcaatgtacaaatgctaccaggggttcttatattagtctacgttgacggaatcctttggtgaaatgaggttgcatcaacttgacatacaacccattcttttgcaccagtgaatcatgcgttccctgctcaactatctttccaccattcagaacaacaatgttatccacatgcttcatcattgccgccctatgtgcaatgagaactgtcgtcttattccccataatcaatgtgtcgagggcctcctgcaccactctactggactcggattcaattgcagaactggcttcgtcaagcagcaaaatg

SEQ ID NO: 40176 - DNA, 713 bp, Oryza sativa
tagccacatatctccttgtatagagatgatttcttacataaaaaatagtgtattcatctttttacctatcttcttgttaactcttttagcgctagtggcgaagctatgttatattggaggtgcacatgaacccccaaattcctaatttctcacttaaaaacactagaatgtacagtgttgtactgaaattttctagattctcaatggtagtgcattccccttgttttgatgctagcttcgcccctgtttagcgcttcaaaattttacatatgtgacagtgtatttaatactatggacactaactgaggtagggggttgggattgcccttattccaccttctcgatcttagtcttagacatgatgatgaattgggagagagatctagagagagaattttgatgttgattaatacgagtatgagcttgaatgatttcctcaagacacgatttgttgtctccacagatgcagatccagcagaagcagtggccgaccaaaggaaccgacgaccgctaggcagccgccatgggtttgccggtttgacggagtacagtagaggtgctgtgcaggtgttttcacaacatttttctactcatcacgtgttctttggtcctcccttcattctacaatgaatttctggaactcgaactttataccactatatagtgatttctatattgattcatatgattctcgttattttagtgattttaag

SEQ ID NO: 40177 - DNA, 6584 bp, Oryza sativa
tttggtttgaggagtaaactaccgaaagtaaaattcagtccctgtcttcgagaacactgcagccagacaaggcaacagatggagccaccacctcatacaaatcgatcaaattaatgttcagttatttgcagaacagaacaagaaagaaatgaaaaaactctttctcctggaccacagaaaagtatacgtactgagcttctgaactgtccaagatcaccactattcagagaaagtgtttggacatagagaaaagtacatagtactacagtacagcaccgtgcaaagtcattgtgacatgtggactggtcgttctctgccttgtaaaattcaggcttctgcaggcagcatgatgcaaaatgcaacaaagttcagagaattccatggcatatgcagagcagacaagtctagtggactggagtacagtgagtctactgatgttcatcagagctgcatgccaaagtatccatgtctgcttgcagctgatgttaacttgttaatgcaagtggctgtggttgtcgaatcagatgcccattggatcaatccaaacgacagtgttgagtcattctagctagcatgaaatgttactattattttatcacactaaattgtcatgctctacataattaaggagagacacaacatgtcaacatacaggtctccatcacagttcatcagcatcatctctaaactattttacgagattaattctacttatttttttgtttgcaatggtccgtttgtcatcgtctgaactgcattctaacttctaagtgcatcatgataaggctgcaacaatatctttcactctttactctatcttttctgaaagtaatgccacggatgctttgtctctgatccacatggacgtcatcgatcacaaacagcactgcgatttaattaagcaattaaaccatcttgtagaggtttttcgtctggaatctgatcgagcgagctcatcgatggcgtcagggacgaaaatggccgcctatagcctggtcgtctcgtccatggcggcaaaacaagcaacgtttgccttcagaaatcttcagcagaagaaactgatcgccacttgtctgcttcgacttcatcagtttgcatcgatcgacttctctgcaaaaaagtttgattaatctaaccatcattaatctgtactatggacgcaaggttttttttacaactaatctaaacagagaacggaagaagagaatcttgaactgttcttttttttcagacagtgatctatctctgcacgaatactgactgaccgtgctcctctttacacgacaacgtaactttgttttctcaagaacaaaaacagcagagctttcaacggcaagttcttccgtgtctgatcatgtgtatatcctggaagaagagattttcttggctggagctggaaaaaaaactgcaccgggcgagacgatcgatcgatcgatgcttcggttcgctctgaaaatttggtcgatatcacgatttgtctgcacttgaacaagatccatatctggcatcatcatcagttgcatcgacttgtccgcgaaagttttttattattaatctctatcatcattttctgcaattctctgctagaagagaaggaagagcaaacgttgattagacaattgaactgctgtttaatttcccgagttcagactctgatctctgctagaatgagaagcgatttgattccgttttgcacatatatgtatgatgaaatcgatccagcagtggtggatggagttagttaacttgtcgacgatcgatgtaatttgcctgatgttgtctcgcatcagacagcgtccgttgcccgcaggcgtaaatataaattataaaagtactaaattgatactgcttctctttctcgattttagaactttgaacgacgaattcttggtttcatcatgtatgatgatgtgtatcctggaaaacctgcttcgattcgattcggtctgaaaattcaatggtacgttaccgtacaatggaagcttccaacagggaagaatattagatcagtcagagagaaaaggagatgaaatgcgtaaatagctctggtgaagtcaaggattgcgcgagttcttttagcacttctcattgtttgatccctacttgataatccgtagaaaaacaaactaaagcaactaaaataatttataagtagaagttttatatacttgtatcctttagtaacttataaaagcttatgttaaaaaataataaactactaatgaaactttaaaatcaaatctaaaattaacttttgaaatttaaattctgattacgtctgataagccaacaagcaaatgatgcggctgttaatactttttttcgttattaatgttttgttagcaacatgatggcaaatcttataataaaagcatgggcattaccaactatttagcattaaactaaactatcacatttactatttaaactaccgataaattagtagggcacattttgacgtcaatctacaatgtcccttaatttaaaacagagagagcactaggttttcggtaccccgcaacacacacgaatgagtttggaaaagaaaaagaaaaaaacatggaccatctaggcctatccaaacaaccaaactgaactggccgttcatgcaaaacgggccacaaatcttctgcacctcagcaatgggccaaaatacaacccaccaagcggaggctggggaggcggtggaaggagagagaagagggaaagagagagaggggatgacacatggggtcactattattgtttaaagtattttctgctaactcagcataaaccattttcaagttgaggatggagttatacttggttgtgtggttgagggacgaaattgctaacgggcggacgatcgccatccgtgcgcccacgtgatcgagtcatctttttttttacctttttatgttagaaattgctccttaactgtttttattttcctttttttttactattaccgattttcatggagccaagttagcgcttttttttccttttcttcttcctaaggagacgtgtgtacgtgcatatcatttctttttgcgaatatctatgtgggactttttaaaatttattttttaaattcgtttgaattcatctatagaaagtttatagatctaaagtttatacctataaagtttctatattaaaagtttacgtgtataaattttctacaaaaatttgtatgtatagggtttagacacagttagtttatatgtcaaaagtaaacgtacgtaggaagtaacatgttagggcccagtggcccacaactacatcctaattacactaggatttagatcatcccaaattactgaaaaatatgtgaagcaatggttagaataccaacaaaccagttgtatgtaagacagaaaaaaggcaaaaccaacgaaccagttttttttctcgtttcgatctcccgtcctccacacacgcaagttaggcatacaagtgggtccttccccgatcgctcgccgcaggcgccagcgatcaatcgcgtaatagggggacccgttgagggatgcggttcgattaaggggcaagataatgagagaggtaaaatagacttactccaatgagaaaaaaaacatagatccatccagccctacccactcttcattcgaaatgggcccagccgacttcacccatgaaatgggcctcgatacggcccaccaaacacgtttcccttttcttttctttctttatttcttcttctcgtctcttctcgccgccgccgccgcaatgctccgcgccgctcgcccccgccgagccggcgcgctcctcctcgccgccgcggccgccgcctcctcctcaggagcgctcgcgtacgaccgccgcggcggcgacggcgacggcgacggtgacggtgaagccttctccaccaccaccaccgcagtccgcatctcggcgtcctcgccgctccgccgcgcgctgtcctccgcggcctcggggatcctcccggggggcagtgcacacctcctcccgtcgccgctccctctcggtgaaggtacttcggtttccttccgttttctctttcagactagctcctgccatttttcggcgtcgtcgttcgtcggggtgacgtgtacggttctcgcaacggtggattgattcattgtttttttttcctactgtgattgctcgacgtagatgcgtgatctgctttcctgggcgagttcaatgtattttgccaactatgtatgaacatagtgtgatattgagctataaatttgtggccgccttgtcatatgcatacattctagcgtgtggtgtgtagctacggtgttgtgcatcaatgtgctggagttattctagtttaaccaccattgtgatttccggaaatggtggttcgatgtggaaatgaacaatgcttctgaatttttagtaggtgggtgagagatcctgtgcgtgggagtttttctttgtttatctgtgcagttgctttcttgatgggtagttaatttaaattcagtcattcctaaaataaaaaagttaaattgagcgtgtgcccccactatgttatattatatgtactctattgtgctgtgtaccaaaaggactggttgaggaccaatctgatggcatgttgtgtgtggagatgagaacatagtatgttatcccattacattgcagaatctgcgtatatctgaccatgtaagtatgtgctagatttcagctgttaacagttagctttgactttcgcttgttctgtagaaggtatgaaattgcctctacactgtataaatgccttttatgagtatttgagctgaacagcttctgtgattgtcaataaaatgttatgagaatattcacgatgtgtaacttaacaacatattcactatataagagaagcactcaagagaatttatttatttatttatttttgctgaaaacaatagtagccaccatatcttcttgattaatctctcgtatttttttccttgaagatcttaatgtgtacagtttacgtgcagggttttccttcctaaatttcttcacatctgcatcaaattggagtgcagggtttcccacccaaaattccttcgcatctgcgtcagttccacccactaatttgagcaaccagagctctgatggaaactcagatgattcaaaatgttgcccaggatgtattaaccgaaatacaatcgccaaggctgcagctgcagttggtcctgctgttgtcaacatttcttctacacaaggtaaaaactgtctaaaggagggtgtgaaaacttacagtcagcacattagctatacataataaacttttgtttgtctttttgtagaaactcatggatgggttctagagaagagcattggatctggaaccataatagacccagatgggacaatattgacatgtgcccatgttgttctagattttcaaagcacaaaaccaatcttgaggggaaaggttgttaacatgtcactaactttcgtagttttctgttcatctcaagctgtacacttcttcattatgtttcctgcacttattcatataaatctgtgatttttgctcagtcctgaatataatttactcacgggggaagtataccagtattttataggataaatccatgctgtgccaatagttttcatcaatatctgaaatatgccaaagaaaatgtgagggtaacatgcagttgtcttacgttggtgagacattagtggcacacataggcatttgatgaaactcaatgccatgatatggataaccccttatatcatattgttcttttcttcttcttcttcttttccggggttagtgtttttttccctaatatgggaaaataatcttggacatcagaaatacacttatctgatatactccaagctttagaattcaggcttttatgtactaacttatttccttatattagtacagatgcaacaaattacaattggcttgtattggaatttactgtttggttttgtatttcaaataccactttgcgcttggacaaactgagtgttataggcctttaatgttcttttgaagaaagagaatgacgtagaataatttttttctctgtactagtggtaaaatcctaaattttagtatggtcaaattattatagctgtgcttatgatagctatgaagtgtggggccaaattattgtccatgttagaatggataattcagtgcctaatggtccggatcatctaagtacttgttttcttaaaaattattatacaatagttgtgcttatgaattatgataaatacttttatactgtttcttacttagtactatttgataattcttgcatgattttggttgatataggttatttttgcaatgtgtttgtataaatcctgattcttttcttacaaaggttgaaattgtaataggttagtgtgactttgcaagatggtcgtgagtttgaaggcactgttctcaatgctgatcgtcactctgacattgctgttgtgaagattaaatcgaagacccctttaccatctgcaaatcttggatcatcatctaaacttcgaccaggtgattgggttgttgctttgggctgcccactttctcttcaaacacagttacagctggtattgtaaggttaacacctccctaagtgcagacctaatct

SEQ ID NO: 40178 - DNA, 6745 bp, Oryza sativa
  unsure (1)..(6745): unsure at all n locations
ataggaatatagcttagatgacattctcttatcatatagcatgcagcaacgaaaagcacgcatcaagaaatttaaaaaaaaactgatatgtgtatagcaaacttgatgaagcaagatgaaagtgcatataggacccctaattattttggtgttaatgacaataaaaaagagggttactaatgaagtttgttgagatgttgcaaggttcaaagtgatcagttgttgattcaaatgaaacatatagtctccatttagcatcggcattttattttaaattgccttttcaatcccctctagtctctgaagaccctttcacaataaaaggaaaaaaaaactatttcaaccctccctccaccccccccccccccccaaaaaaaaccattacatatgagttccaaagtaacaagtcaattttaaatggaaaaaaacaaattacctcttgaactattgccataaaagtgccacgtggcagcttaggagcgattttaggaggctcacgtggcggcttgagagtgtttatagggagtttaatggacttttaatatataatagatttcggagtctctgtatcatcggatactctgatcacatcggatagtctgatctgaaaatcactcaagagaaataaaaagcaattcaagacagagagtgaagttctgagaaagttcagacaatccgatgtatcggacaatccaaccttatatcggatagtccgatattttttagccaatactcagaccaaagacacagagcaaagttctgtgaaatatcggatagtctgatcaagatcggatagtccgacaggagaaaaaaggaacacttcaaatacaggattttgagcactagtgttctaccaattatatgcatgtggtatccctcttaatagtacggcatcctaatactcaagaacacaatatatacatggattagaagacaattaccacaaaagatgccgcaatgcttttaaactcaagttccactcctttttatccttgcatccatctcaacaaagagcattagtgaacctctaattgtgttgatattaacaccaaaataaatgaggggtcctagatgcactttcaggttttatgtttttaattggattcatttaattcttttttgattcattgtgtaattccccttagttgaatttgtttatgtgattggttttctcttaggttagatcgaaagaggctagagataagagggtgaatggaagaatttagaggtgagtactgatttagcctataaaaagtctaggctttttctcttttcttttcttaataaactctctcttcaccattaatttggctaaaatttacaccgttacaattacttcatcttaggtagatatttcactaaataaactactacaacaacgtgcaattctataaaaaaaactcaaatattatccgtctctcccgtcatatacttatattgatttagaatccacggatggaagcacgtatttcacaagctcagttaccgataaagttatagccaagagaatcatcatgtaatatattatataaatctttctaaaacatctacttcaatgctaaatcaaaaaccatagttttcaccaaaacatataaaacatcttcccaaaaatttacttacattttaattcgaaaaccaaaattttaaaaatgaagggaaaaaaatagaatagaaatgacttgaaattgctggcacatgtccccctcctccttccctccatccttctctctcctcctctccacctctcctctttttacctacacaccctcttctctccaccccctctctctctctactctcctctcccctcccctctctctcctcgcgctgcgctccccggccgaggcgcggcgagccagcgagccagccagccacctcctccgcgcgcgcgcgcctcgccggcgtgcaaggcccgagctcgagcgccccctctcccgcggcctggccctcctcgtcgcgcgacacgcgcgcgcgcgctctctcacggccggcgagcagtgtcggagccagcgccatccagccagcgcgtgggtgggttgggggcgcgtcgcggtgtgctcgccggccggcctcgttcccgccgcccgtccatccgtctcggggtcgaatcgaatttgaaggtgactctcgcttctttcttccggttcttgatttctttctttcttggtttctttgatttcttgaattggagggagatccattgggggtctcgggttgattccttctcccgcaccgattaacggagattagcccatccgggtttgatttgatgcgtgtgggggtggtgctgttctaatcggagtttgttggcgaaccaaaaatgatttctcccttttttttttcttcttttaattttttttggggggttcaggatgccccacgttaggtccgccgccgtgaagctgatggaggagcagctggattcatcggagatggacatggacgagcccggcggcgccgcggcggcggcggcggatgccaataatggcgccgggtccaaggtctgcccttngctcnnnccgccgcccaagaccgccaaggcttgcgccgccgcaagaagccgagatcggtgagctccgacttcggcgaggagctggacctggagcagctcggtgccaagcagcagcagcagcagcaggagaggaagctgtcgaggcaggaccgcgtcgagctgagccgctcgttccagcacgcggtgagctcccacgactgggatggcgcggaggcgctggtgcggagggccgacgcgcaggggctcaacgacgtgctctgcgtcgccgtcgacgccatctggttcctcagcgacaaggaggagctcgccgccgtcgtggccctgatccggaggatcgtgtcggagggcgccaacgacttcacccgcgccgcgctccggacgtcgttcctcgcgtcgtgcgtgtcggcgtgcagggggagaacgaccagcctcgccgacgctgtgagcttcatggggcaaaagtaagcctgtccaaaacatgaattgcatgttttgcgaccgcgaaacttcgaatcgaattcgggaattcgattcgcctttatgctttgtatttgaaactagcctgatacaattgtggtgattgtaatgatttgtttatgtatttatcaggttgaacgagcgccttcaagaatcccatggcgacgaggtattgaaggcagaagcaagcgcaaaggtgcacaagttcacagagtgggctctaaagtgtatcgggctgcattcgcgtgtgcgggagaacaagggcagaggaaaccatggcacgatcattgaggtccaacttcagctgtctgctttcaagacatttctggatcttgccgataatgatcttactgggaaggatttcacggaggcctttgacgcggcatgttttcctcttacactcttctcaaacacctttgaccaaggttgggcatcaggtatctcggcagctgcaatacaaggactcttagagttgttagtagagggtggtgccgataatgtgaaccagtgctttcttgaggctgctcgctatggaagcactgaactcgtgcgcatcttacttcaggtaataataaaaacaataattcacatgtgaatcttatttcagttaataataaatattagttgtactatttaggttaatgactcctactgagcaaacaatataaatgcagcacaactaagtggttcttaatagcctgcaccacacattggtccccatgataaccaggtcatgaatatatgaatatggaaactatgtagagctaccacctttgctattaattcagaactttgttccttttgactggaaattgatcttttttttttctctatggagctttactgctcatgtttgaattatacttggtgtaaccgtcttcaaccttcatgccttcgaacctaccttaacctattactatactttccaaatttctggagatccatataatctgttacatagagtagctgggggactgttttctgctgacttgcttcatccagattcattacgacataactatagtatacatgaaaaatctggtgaattgtataattctccccttagagaagctcataaattttggggtggtcattaatctcactggagatacatagagaatccccaatcaaagggaaaaaatggtgtgatcaatctattcgtgatggaagactttcctgaactgcgctgattgatcaggtcctaaaataggttaatatattggagttgttttgactttagacagctggtgcacagatgggtttcctttgtaattcatctctactttgggcagcaattggaccaattccattgtaggtgcactatgcatgtatttagtcatgcaaaaaaaaaaagaacaatgttttgccatgcaccttttcatggttagaccatcactcaaatatggcagttctcgaatttaattgagttagataacaattgattatttgatatatttacaaatgttttcctgtctgaaaaatgtacaggcattataggtcttgtgaaatagaagctactcaggctgtttgaggaatttttttcctttttatttcatactttctgatattttgtctgttggtgcaaatatatcatgaaacattagcagcgttctaacatatctgttgtttgtatcttttttttagattgctcgaaggaatagcttggacatcgatgtggatctagcccttggctttgctgctcactatgggaaactggataccatggggtgcttagttgaggagggtaatgcggttgcctttcttggccctttaatgcgggcagctgaacggggatgccttcaagttgttgaatggttcgtcaaccttggttgtcgggatatggagctttgcttagcccttactgctgcaacctctagtagccaggttgcagttgcagcctatcttctccctctagtcccaaagcatgttcttgcacccctcagcgtcgaaattctcaaggctgctggtgagaggagcaccggttccctgcatggtgtggacttccttctccgctcaaacttcctcaatgacccagctgccacatatgctgtagcagacaacattgcaaaatctgccgatgaggcagtggatgcaaagcttagatctttcatgctcgagcattggtcagaggcagctttttctgagggattcgcgtctgcgcaagagcacttcgttaacttcatgaggataatggaaaagggtgagtcgccgatctgcctgagggacctcccacttgagctggtgattgccatggcctacctaccactgtacagggaatgcgtggagtcaggtgggcggctattgccgcagaagctgagagggcagcttgttgaggcggctggtagactcgagggccggcaactcgacagggctagccaaggcacagagctcctggccatcttggagcaccacctcccgtgtttcatgatccagacttgaaaggtcagcttccacatgatctgcattggtcgctgcaagaagcaaagtaacaagggcaatgcaccatcttcagtgttttccagtgctgtcatgttcctgcttggggacaatcatctgaaacgatggcaccttgaggtctctgagagcatagtgactgaagaactctcctgctggcgctgttcggagagtatataattttggggagaaaatggtgtgtaccttcttgtcgagccaagtgttgagtagatcttattgggatcataatcttgatgaaaatgatataagcattgagcaaagtgttctccagttttttctgagtgctagccatgggcgtcatgtttttgttttggactaatgagtttttgaacatggactagtctcatctttcttggcttcacaaacataaaaatgaatggacagtaagtatatgctttatatgcgttgatgatgccttgattgagacgcgagacaggaagtatagttttatactagtatattgatcttgctgctgtttcttgtcaattgatttttccttttgtttgaatgcttccaaacatcggattatcaagcatcatccatggctacgcggccataccatgagctgtgacatgccagctcaaaatgttcaatctgccaaatgtcacccctggtgatctctgattgaaaaaaaccctgaaaattgtttattttccaactagaaaattctctggtgattcctaaattgttctgcatgaacatgattgcagcctgtttgtgtctggtgatttaccacagggcaggcactgtgtcgttctgatggtttcagggcatcatcaatttggatgttgcaaccatgaaaaccagcaagttaatactcctatgtcaggcatcagacctggaccctagattggtcaggcataaatgttcttgtttagtactagtaactactcctatgtcaggtatcataattccaagggccaattgaacaaaaaataatagacttgatgaatttacatttgagtagcaaagtccaacttttgccataggggaaagcaagcagtgcatctcatcatttttttagtgtattgaatgaatatgaatggtgttctagaggaatatcccttaaaaatgagaaatgaagttaacaaatacttagaaaagcagggaagaaaatggtggttcttgtcaaacttcagagattttttttctttatattggttcaagccttttagttcacaaacaaaaggagaaaaaatatttttgaaggtgcatatgatgtgacatgatattcctttttcagtgcacaagggggtgcgcacaccactaatcatggtgtta

SEQ ID NO: 40179 - DNA, 1469 bp, Oryza sativa
aaggaaatggaagacaaccatgcaagcttgggtaacaatgctcctacatgggcttatttgttattggaaaaaaatatttagtgatttacacttcaatatctgatcatctgaaagctaaattagtaatgaataaaaggtatttgactaggtaagcgaacctattctgttcaaacattagtaaaaacatggacacaaacattgttaactgatgacctatagactgccattctaatgcagcatgggcataaacattgtttactgatgacttagtctgccattctacttcacatataacttaggaaacttacatcgccgccctatccggattattttgtatgcatttctagggtcaaccgaagaataccgtcgcttgcgaagaactcaaaacaatgcccattctcaggtggagactttccagtacagctggagaatttgatcacttaaaagattgatcctttgacagaaaaaaaaaacctgcaaattttttttgtcaggtaaggtaatcacaccagaattcccaaattcagagtttcagaccagtaacatatgtaacctctaaacttcagcattcaaaatctgtctggaaagtgatgttttacagcttgcttcgtcgcgctcatcttatgtcgaatacaaaaccaaaaccaaaataacaaaaacaaaaataaattcccctaggagatgtatttacaagtaagaggaagccatgctccgcacatccgttggcatgaaggccagcacaaccagcaggatgagcaggcagactggcagcagcagcagcagcgatggcggcggaggcaatgggggaagcaccaatggaagtatgagcaatgacatggtgaggaagacgagcacgaggaacgcctcgatactgaagtaattcgatgtcgcggcggtcttcttctcggcagcatttggctgatgctgatgctgcagatgcctctttgaaccgtttggtctgggtatcagagggttcctcctctgcctagcacctacaccttccattgcaacaaaccccaaattcggctagatgttttgatctgtgattttgtctagatcagttggcaatccaagaactgagatgtgtatgagagttcttgtgatttctgatcagatctgaagtctctgttgcagacttgcccatcatctgaactgcaggcaaagtgacaacatctgaagaaaaaaagaaaagaaaaaccctttttagagttaacaatcatcatcctaataccaaatacacccatctgaaattatcaagaaaggcaagtaaaaagttcatgcctttccccccaacaattcaaagaaactgactaaccctaacaaagactaaattaggctgcaaaacaaaaaaaacatcaagaaaccgataccttcgatcctgaacttggcattgctcccatgtccggacttcgcgtctctcccaagaacgccctttctcgctccacccaacaagccaagaactcctctcc

SEQ ID NO: 40180 - DNA, 5988 bp, Oryza sativa
cctccgtccaaaaataaaccaatcttgtacgggatatgacacattctagtacaacgactctagacataagggcatctaaatttatcgtactaggatgcaccatatctgaggttaatttattttaggatagaggagtacatgtcagtgtcttcctcctttttctctctctttaggcccatgtataatagttacaagcaagagagatgggagaaagatagacagaggatgcgggacccacgtttgacaagtggaggaggcgggctatattcggaaatatcggaaaaccagaaataggctatacagacataaacatattggtattgatcgaaagccgataataaatatcggaaacattggattgtaaaatcgcacaattaattttgcataactataatataacaaattcaaggttacactatgtataagttataagttgtcttcttttaaccttgaactatagttagggatttggttgagaagttgatgggctctaaactatgaatcaaataaagaaataggccataaatattagtgtatttagaaatacgataattatcataatataaaaaaggtaaaatcatttccatttccatgtgtttttttaccattttcatttctgttttcatcggtaatcatttccatgttgctcggctggtaaaaatcggaaatgaagcatcggtcgatcaagaattttcattaccatttttacccctaagcgtggctacgtggggattggtttggctagccgaatggcttggccatctggatagcaagtcctttagtggttttttttttggggtcaaattttaacatggagagctaaatagtcactcttttggagttgctctaacccctgaactccgttagtaaggtaaaatcctactcacaaccttaattcatgttggctcgtcatgcccttgcagtttgatcttcatcagatcatcgtgccacatgcatcacttgaggtctgtatcggacgtggaaattttcctgatttatgtaagaaattttcctgaaactcttacgcaaatttctgtaaaattcttgcatttaaaatgggatccaagtcctgttaacaaagcatcaatcatgtacaaagtaccaagtatttttacacaacaattggtccaattcaattaggaaattaccggcctcggagaaggcctattgctgggtggtatactttacaagtcgtgttatgcaatactactagttatctttcgtgctagctagctttatcgatgttgcccacgttttattcaggctgtctaattctgtagaaaggcatagttgaaatctcataaaaaagatctccgtttattaaaaacgaagaattcatattcctttttctgatgtaaagaaagaaccaggcaatcggaggatgaaccgttttcacgtctcccaaaagacatggatagtggatttggaacagacctattctgtattccctccatcttttgttacttccattatttatttcagaataagtttgtttatagagtaattattgcatcgaagtttataaaagtagagaatgattattttgggagcagataaagtgagaataattgtattggaatttaataaattagaggtattttaatcttttaagtttcgtattggtacgtgtgggatgggttaaagataaacttattttaggacagagccgtgttatcttgttggtcccttctagattctactaaccatcatatacaacctattattacaataaccttgtcagctagggttgagtttgaatcaacttttacgtttggttaccaccctacttttcgtaaatacacattttgaattgttgaaaggtgtgtttttttttaaaaaaagtttatacatatattttaaaaatcaaataaatcaaaatttgaaaattataatagttaactaataattcgataatacctcttctttcatgtgccgtggaaaaacccggtagttatgctgtatccaactcagccttaaactcgagtagagttagcagtagtaataatgaaaaagggaagcaactcatttcgattcagcaaagcgaggattctacgcaaactcattaaactcaacgagaaagcaagagggagaagaagaaaaaggaagaaggagcgaatcatccatgggccatggcgcatcgcacccaagcaagaaggcagcaggttcagtgcatgcacgcgcctgacctctggcggcagacagacaggtagaggcaggcggtttgggggcgtgtggtgtaggaaaatcgatggcgctgtaccccttgcacgccacacctttgccactcattcctttatcttttctcctttccaagtttagattcaaataagccaaaatgcaatactcttatatagtactccctccgtcccgtaatataaggaattttggataggaaaaagtacaaattaccccccgaattatcgtggttgaccgaattaccccctgaacatgaaactaggtattgctcacctaaacttttaataccagacgaattacccctggatccaatctagagcggttttgtcctacgtgacgtacgcgtggcaatccagtcagcattttccttttaaaaattgtgggacccacctgtcatacatcctcttcacctcttcctattctctctctgtgtggcaggtgcaggtccgcacagccggcaacggtgtgtgcgattgggtgggtgaggcgagcatggcgggcagccgggaggctgcggcggggaggaaggcggcagtcgcaggcgtcctgagctctgctgccccctccaccgcccaaagggttggcgaagcgtggcgctgcgccaagaggaaggcggcggttgcgggcatcccaagctccgccgctccctccaccgccccaagcgccggtgactgtgagtgcccccttcgccgtcctaagctctgccgcccctgcactgcctcaagcgccagcagagcgcggcgctgcaccgagagagaggcggcggccgcagcagccgttgcgggcgtcccgagctccgccgccccctccaccgccccaagcgccggcgactgtgagtggcccctttgccgtcccgagctctgctgccccctccaccaccttaagcgccggcggagcgcggcgttgcaccaagagagaggcggcggccgcagcagcggctgcgggcgtcccgagctccgccgctccatccaccgccccaagcgccagcgactgtgagtgcccccttcgccgccccgagattcgctcgccgccgtcttcagctcacctcgcagccccctccatccactcaagctccggcggctgcgggcatcccctctgttgcctcaacgagccgtgcgccagcaattacatgcgtcccgagcttcaccgccctgagcaccagtagctgcgggctcctgcttcgccgcccgagctctgcccatcgccgttctcggctccctctccgccgttgcctctcgatgacagagagagatggaggtccgccacccggcactcgtcattggcgaaaagagagagaagaggggacaagctaacatgtggggcccatggacttttttaataaaaattagttgaccgccacatgtacgccacgtaggataaaacgacttcgaattgagttaagggggtaatatgttcggtttacatagtttagggtgtaaaatatctggttttcgagtttagggggggtaaatcagactgacgcaatagttcaagggcggtaattcgtacgttttccttttggatgaatatgacacttcctagtacaatgaatttggacatacggtcacatccacccaaaatcccttatattataggacgaagggaatatcagacgttcgcttccactcctaaaaccctgcccgcacctcacaccatcttcatggtgtctgagttgcaccctgctcgccactctcccaaccgtagtatgtacgcattgcgttccaatctcttgagccacggcttccacatattaatgccacgatggtctcttccatctgttcaatatgtgatctgaattttagacttacaatatatttgaaatagttttttaatagaactctatatgtctttccatatcatgagtcttttcttatatctcctctgtatactcttgtaagatatacgagaagggggtgacgttcatattgttattaccctatgttcgtaatcaattcctaaattatgatcattgttgattggtgctcgtgatttttttcccgttacaggttttccacgtaaaaatccatatctcctttctgcatctactttcatagcaccatcaccgttgctactgcgtcttctgcatcgatgccgtgcacgatgcccttgctccgctatttgctcggctttcttctcatgatgccggcttcgtcttacgtaatcatcctttctagttaccccttcacaagaagtatatgttggtttctcccttcgtctgttttgtattgctatgttttaaacaataatagcacatagttcttaaacttggccaccacaagtccaaagaatgagttataaatcgctgcctcatccgtctcaaaataagtgcagccatataattcaaatttaaaatatacggttatattaattttgagacagatggagtactacagagtatgttcactactagagaaatgatcgaaactgggactaaaaatatctttagtcccggtttgaaaacccacgggtatttttttaatctttagtcctggttggtaacacaccaaccggggctaaatattatttttaatcccggttcaaaaacatgtcagacccctattatttttagtgccggttgtttataacaaccgagaccaaaattaaaaaaaattgctaaaatccctaccccgaaccgcgcgcactgcctcgtccttatcccctcctcttctcctcccccctttcattttctctcctctacctcctccccttcccctctcccctcctcctccgatagtgatagcgagcagcggcccggcggaagccgccgcggtggcgcacgaggcacaagcgggcggcggcctcccctccgccagatccaacgggaggggaggccgggcagcggaggcggcgcacagccgagcggttggcggcggcgtgttttgtgaattttttttgggaatgatttgtaaattttgttgtagattattttagatttgtggatgattttgtgaatgatttgtgtattgtgggcgattttatggatgggcttatgaatcgtggatgatttgttatgcatgatttgtggggattcgagggtggcaataaatgcaagcaaaaaaaaaagaaaaaaaaagcctaaccgatgatgttaccatcttttgttccggttagtgttatcaaccggaattaaagatccattttacttctggttattttaaccgagactaaagattgacatatttagtctcgaattggacgtcctggtttgcaaccagggaaggggttgcaaaccggattaaagagcccttcccagtagtggttacatgtaagagtagccgtagccatcacaatttggctataaatcgtgtcatcaaatcaatggaatattaatggcattgtcagtttgtcacttcaggtggcaggcattctgagtcattttcgcataaaggtgctttcttctaaaagaactccctgcttgtgtgtaagtaatttgggctcatttcttccgcacaaagatggaacaaaaaatttatttaacatgatgatttacttattaatcaggagagagtgagttttcggtccatccttcctctgcttatttgcaggcgagcgttctacaaaactcctggttggaataaaaattttgccccaaattaattccacatttgttctgaataccgaaggttgttcagtttagcttaatgattggaaaagccaaaccttaaccaaactggctggatcttacgtatctggagtacatttctttaaaaaaagaatcgcaaaatttcacatagattatatatatacttctgtgtgttcttaagccacttacttattttgtaaataaaatga

SEQ ID NO: 40181 - DNA, 3157 bp, Oryza sativa
tatggagttggagcaacaagtcaattttgccagtggcatatgcttataaactgagatttccatgtttgccttgtgttctgttctgtggtttgcagcttgtttcattgtcagtgtctcaaataaccttttgttatttggcaagctcagtgtagcttgtgctctcattcttgtgtccctaaatctaaataaagtcttttccctcctaatcagtaccacatcgtaataaaatggaaccctaataatagacagcaatacagatagattaatcatttcttgatacagttctatgttgccaattccatatggtatgtacagtatatatgttctagatgtcagccaacttccttctgttttagattcaaaggcatagtgatacatctcaacaacatgctaaaaatagttagcagctatcatgtcgtctcagaacaaccaagtatgcccgacttttgtacgatggtgtcaaaggaaaaatgtaaagatggagattgaataatgtgaactccccatcaataattctttgctttctgcattgcaaaagtttcaaggggtgaatgattttacagatttgtttgaaagcaacttttttatgcgtattggaatctttcgcttgtctgcaagttcaggttggtacctttggtgtgggcacacgccccctgctgcctgcctgccttgtgcaataccgaaaaacctaggtccatttctattggttgttacatgcaacatcatacttttggttgaaatgtccctctcgtacttcatcattgggcgatataatttctttcttttttttttatgttgttgatcgttgtacacttttttctacctgtgtatggtgtaccaatagcctagcttaactcgttgcatcttgctcggaatcatttgtgcttaaatactaattaattccgtctttgctacgttcatgatgtaaattgtattggtagattattgcctattatgttatgttatgtgaccctgtctatataaactatgctgtacatgtaactgtaagacttttttttattatggaaacaaaaatatatatattgtgttttctatgttgtcaccctaaggcgtcgaaatcaagaaatcaaaaacaactttctgttgaactttacgactacttgtggggttgtgattgatagggcaatcatatcatttggcgaaatactcaagcctgtctatcactgaaacgaattagtgagcgatttgttataattaattatatgtttctgggaggaatttctagggctagcaaacaactcattcaggatcatgactagatgtccttttaatcctataaatatattttagcacgtttttttttctttttgtatatttttctactctacaacaacaataatgcagatggaccgacttgtcacaaatcacaacctttagactggtcgatttattttggtagagcattgcagctctgatgttataaaaaattgtaccttgactgctttatgttacaccatgctttcacccttagattacccatcagggaaaaaggcaataaacataccattcatgaagattgcatgcatagttcatcatagatttgtggttgacaacacactaatatgattcaattcacatatgatttttattttagctgtagcatctgtatgcttttcagggccgatgctttcatctttttctcaacacttcattttcacatgccattccttggaccaggacatcgtaggaagaaaacagcttcagacagtaacagccttttaccattttgcatagtgtgacagtaagctgactgcaactggaactgtaggagggttagattttttttcaactgcagtaacatgtgcatctgctttagaccttgttccgttaattcctcacctaaggattgaggagaatttggggaaggtgtggaatagatctccttcaatctcctctaatcccttcttaattcctcccaaaaggttcaaaaggttgaaagggattaattccacatgtgaagttaattcccctctaatgtcttccttatatggattaaccgaacaagccttaggctgtgtggtttgagccgttcaaaaccgaacaagcccttgctgtattttcctgtgaataggctgtggtttgagctgttcaaaacaatagttcttttggaacgcagcaattttacaaaaacttgtttaatttctgcaaaattccttgttccaaactccaaaggagacggtcgatacatcatgggactattacattctattgcgcaagccaaaagaaaaatgggcatgtaggatcaaatgtaatcattcgaatcaaatagctcatatatcttctgtttgttaatcatattgatccaaaaaaattcctggatcgatcaccaaaacttcaccctgatctgatctggaataacagggattaggtgtgcagcatgcataactacaggaatggtaaaaaccttcaggccccttttgattcaaaggaaattcataggaattttagaagatttcatttctataggaatttttcctacaaatccctttgaatcaaaggaatgaaccctatggaatcctatgaaattcctatagaatgcctcttcatatataagttttggaggaattttaacaagaggtagaacctcgtggaagaaatcctttaagtctttatctctcctcaaattcttgtgtttttcctgtggtccaatcaaacggtcattcctatgtttttcctgtgttttgtaatcctctattttacatttacattcctgtcagaatcctatatttttcctattcctccgttttcttattcctgtgattcaaagggaccctcagatttaattgtaaagctgaaagggggcatgcggttaacttgagctgtcacgatctctgctgctgttatgatgcacaacaaggttgcacacatgtacttgtgacatctattaaaggcccaataattccaaattatgtcaaggtcaacgacaagtaccaccctagctaccctggatttttcacattttggttcttttgaaaaacttatttcgtaactagacccctagaaaaacttatcccaaaaattatcctttttagggcgccagagtggctggcgccgtcgttcaacaggacagcgccagcctctttggcgccgtccccctgccgacgtggcggggcgatgctgaggtggctagggggag

SEQ ID NO: 40182 - DNA, 4392 bp, Oryza sativa
tctggcgccccaaaaaggaccatttctgggataagttttttcaggggtctatttgcgaaataagtttttcaaaaggaccaaaatgtgaaaaatccagcctagctacctgctgcgagattgttgtcaaggctcaccaagtgacatgttgttgcaccattctctcttgacgaagtctaaaataaaattgtagaaaatcatttttttttctagtgacaacaatcgctcatcataggtctcacaaggcatgaatgaatttaatagggcgtaaatgagaagtttggagtccaatgacttgagtaaccaaatttcataagtaatcatgagtgtggaatgttgttacttgaatgatcactggatctaaccaagcctaccttcagcttaaaacaaagctatgcatatcagaaattaaaccaccttttacacatatatctagtaccgtgatatatatttctcataccccatatatatatatatatatatatatatatatatatatatatatatatatatatatatatatatagacacacactatatatatatacacacacaccgctcgttgtcttacttatcttacatcctgtaagtaacgctgtgtttgtctgtgcgattggaaagagttattctctcgtttatcgtcaggggcggtaccacccattaggcggggttaggcggccggcccagctacggcccgtgccgccccgaccctccatatccttcttggaccgtctaccaccacatccaattcacaattggcccataaataagcagcccaagtgtccaattttaatcctgcgtatgtgatggtttcctcggtcaattcctcaacatcgttcacccccgtcccttactatagtaagtgcctactgtttttctttctctcccttctaagcaaaataataatcattttattctggtatgcgatatcttcttatatatttattttttaaaagatatctatcaaccatgctttatgaatggactcatatttgtaaattgatatgtttactggtatctttttatgtatgacgaattatgtacggcgcaaaaattattactttattttaatatcatttttgttttttgtttgccttaatttattgattatactatatgttaatatgattacaacataaatatggtattttttgcgtttagttgttcttattgagacgagcatcttcgcctcatctttattttaatcctgcgtccgccactgtttatcgtgatcatgcttttcaagctactaaacgattttttttcaaaaaactgttttgcaaaaataaaaatatatatatttcaagtttataatagttaatacttaattaaccatgtgctaatcagccaatcaacagcatcgaatttagcctatgttacagtctattaaaccatggtgttctccaaaactttgaatcatatactaatatattttttaagcaatcctgttacctgggccggtattttacattcgagaaattgatcagctgagcagattaagagaaacaaagatcaagaacaagagaataaacatttggcacacgcgtgcgccacacaagaacaaaaggccggcaatcgttttgccgttggagaggcagccaagtgcacggtttcatgacaaaccaacgcagacgcagcacaaaaggcatagaatgggatcggaaggaacaaacagcaacaacgaaaaggaggagaaaaaagaagaagaaacgggagggggtgacatcagtgacgccgacgcgtgctgaaactgcgttgcagcaacccacagagaagagaagaggagaagagcagagaaaataaaattttgcaggagcagaatctaatctcacatcacacgcaccacctgcagcaacctcccctctctctttcttttcttttcttttcttttgttttcctttttgttcttttctctcctctcaacctttctcttttctttccttgtagttgtcaaccttattctatatgtgaattgcgtaatgtttttcagttgaggaaagaacggtagaggagtctttgcgcggagtcatgggtgccaacaaaaaaaaacattgaaatatctcgtcggcgcactagcgagttaggctgaattgttttgttagctttcccaacttatctccctcaatttttgcacgcacacttcttaaactactagattgtgtgttttttcacataaaattctatatgaaagttgatttaaaaaaaatcatatcgatctatttttcaaaaaaaaatgctaatacttaattaatcataccctaatggatcgttctgttttgcatgtttggcggagagttcctaactcccactaatgtgtggttcgagctgcatgattgaaacaagagagcctgcgaagcttgtaccatggattattaatgttacatcatttttttctttttttacttttatttgggaacacgcaggagatccgtgcatcattttattaagcaatttctctttttatttgttgtcatttagtatgaataagatgtgcaacatatatagttatgtttatttttgttcatctgttactcagcttacaccaatgccttttatgacaaatccacaaatgctatttctccgcaacgaagtattatgttgcaaagcgtaattaaaggagtgcacttagaacatcagttttgaaaagatgtggctatacattaagctccaacatcatacatgaatatgtgtacatgaagatcataggaccagacactttctctagaagaattgaatctatatctcacatcacacaacctgtacgcaacctgcacagctagctagcccccatctcgctctcttcccttctttttgttcttttctcatttatctcattctattatctttagttttcttttaccagttgtcgaccttgttttttaaactgcatagcatttccagatgaggaaagaacggtacagaagtttttgggcattttaggcccaaactaatgagaaacattgaggtatatctaagctttgtttgggggctcgagattccgaaaaatagagaaactggaaaagctggtcttcatgaactatatctgacctatatcttctaattaattttttattctataactacacgaattcttatattttagttttttatttaaattctcataatttagttgagaatctgaattgtttatgaaagttagagcattcgacaaaaacttagctgatagaaactccaccaaacaaagatgctactggtaacaatataacagtaccacaatgctatttttagaatctgattggctgacatttttttttctgcggtttataagtgtttgaagtaacagaaaataattttaggacaatactttactcatctacaatttaacggtttaaaatccaaagttatgttggaaaaaaaacaattacaaacatatagattaattttcaaattaagattttgttagtgatataccctagaggcaatcatagagatgattgtatcacatactatgtttacatatttatccgactttgttccttgaaatagataattaatgaatatgtgattctttcatgagactctttatgttgtgtgttgctatttctaaaggatccctgatcaaatatcatatgtagaacaaatatatttagatgatcagcacatgtattaattgatgatcatgtctcatggatcatggtatagagataccaaattaataatgtggacacatgttagtgaacatgttattggatagacccaacataatgagacactgcaagagccatatgtgttgtgtcatcagtgatctcatttagtattggtgttgaatccttagacctgagattatcatggttcctaacatgtgtagtagcttacttagggactgctaaacgctactccgtagttgagtagttataaaagtagttttcgggtatgctatgaaacatgtagtgggatatgaataatcaagatgggatttgcccctcctatggagatatatctctgggcccctcgatgttgtagattatggaagtgcatagccatgccaaaggtgattgaggagtcaatcacaagttatataatctattaacaggttcgagtgaacggttgagctgttagaggatggcacatatctagccttgagcttaatcgatatcgtgaggcaaaggggttcatacaagtatacactaaaggttcagccgatatgatctttatgtatgccccgtgggtcaatacactctgctaggggccgctgttgacgcgtgaaccgaaaaggagtttttgggttacagccgagtgtacatgaacctacagagtcgcacgcttaatgggctagaataaggggattggatggagatccaatatgagcttgattcggataaggatccgaataggagtcctacgggccttggaggcccaagtgatggatcctat

SEQ ID NO: 40183 - DNA, 2806 bp, Oryza sativa
  unsure (1)..(2806): unsure at all n locations
nnnnnnnnnnnnnnnnnnnnnnnnnnnnnnnnnnnnnnnnnnnnnnnnnnnnnnnttcaactgttggcaggtaaagatttatctaggtcaatgtaatatgctcctcttcctttcgatcataaaataattgatctatatatttctatttagattgatgttttgttatgttccagtgtcaagacaattcgaacatgctatcctcaaaccccaaatggcactggtccagttactaatagatctgccaagctagatatgctttttgctaacaaggtaattacttttaatatttccattactcaaacaccactttgttactgatcactgagttctagtaattcctgtagtaatcttccctgaacaatgtattcttgcacagtagcaataattattgagcataatacaactaccaaaagatttatggaaattaagagtctaatgaggatttagaaaaaaacctagtgggttaactccattacaacacactggtccttacatgtgagacatctcagttccttgattgggggttcagagtctgattatatggtgcaggaaattctggaaacccaattgccatcttgacctatggttattctgtttgcactagattgcatgaataaaatcatgacacggtcgatattttgctttatctgatgtgttttgaggaaaaaaaaaactttatattctatatatatgtgcatgcatattcattatttcatttcagtatttttaggggggaaatatttcattattttttcgatgtaggtccagatgaaatgatggataaacataggaagtaataataagatattaattaacttggctcaaatgaataatattccttgttaacaaggttatttctttgttccatttttgttgtggccgacatatgtgctacactttttgtcattgatttcttgttggattaatatattttccccttgttggcagctgcatgcttttgttgagtacgatactgtagaggatgctgagaaagcggtatggaccattacatgatgcattgtaatattttcatgaacatggtaatcactgttgcacatgcatcatctctgatattttcttcatcctatgcagatcgtggaacttaatgatgagaggaactggagaaatgggctgagagttcgattattgaatacttgcatggtaaccattggattagtcaattgcacatgagagttcagtactttggtgcttaagtgcatatgcaaatgtcatgttaatgcgcacttgttatgtatgtgttgctttacctgtctgagagaactttagttggttttgccgtgtatgaatctgctttaatggcaagagaccatgattttaaatctaatccttattagaatggatcaaaccatgtggacggattcaatcgtatggcacttaacatccattggaacatctaataagagtatgaggtccattaatctatccagctttaaatacgcaagatttaggggattgcactagtgcactcataatagcgttacatttcagatttgctctcaagtatggcacaagtaaccttgaaaagaaatacacttcagttgttatgcccccaatttgcaggtgaccccactttgatcccaactctccacgaatattaataacagatcaaatatggggagttggtgaccctgtacctcatatattgtccaatatattatagacaggtctagagaatgcatttgcaagaatatagggaaagtttggtaccgtggtatataggttgacgtgtttcaactttcaacgtcataatcttaacttgttgctaatatgtgtgaacataaccagttactcaagaaattataaacatggcagcagatcaacagagaagtcatatttatctaaatagccatttgactaaaagatcacaagcagttcagtgccaaaataagcatgtttttatgttctcagcgtggacaattcatgttaattttctgtgagcgcaatttatgccatgttcagacttaattcgaacttcaagtaacaagtatcccccttctatttgggttattttctatcagtaatatgtatacaacaattggcataatcatcatcatcagtttagtgtatgccatcaatccttcctttcttttgtttgtgttcactgcaacaattatatagtgtaatcaatttgcgcagtgctatcttaatttatttgcgcagtgctatccttaaattggttgcatagctcaaaatgattatgtagtttaatgcatgccataaatgcttctttaatttgtttgcacaatgcaaaagaaaggaattctctttacctttatataatgttccttttttgtggtatagacaaagggaggcaaagggaaaaagggtggccatgatatcaatgatggacatggtgtagaggatgatgtctccacttctaaccaatcaaatgagaaacatggagaagaagcactgcaaacaccagatgcacagggagagcaattggtaagctctccattttactttgtataatcccttatttggaaacacaaaaaagaaacaaaacagtgctttactgctgtagagtttccaagtgtgcgtaaacttatttccaaatatgagcacaatttgtggcactggtgttaataagggtttcttagggcatgtaccatggtctttattagcggtctctctttattgttatgcaagcatatttggtgacgtggaagagagaggaagaaggaaagagaaagatggttgctacgcatgacacggcatagagtcgactcttagcatttattaggaaatttttcgttgtattgagtctaataaaggaaagatgact

SEQ ID NO: 40184 - DNA, 1853 bp, Oryza sativa
cagccacagccacagccaccagcaggagcaaacaagcagcctccagggccacgcatgcctacggaacacgcgggttcgccatgggcagagggaagccgcaaacatgtacgacgacacccagcgcatcatccggtagcgaaccttgaaactcgaaacacgcaatgttgctgttggtcatgttgatagaaagagatgcggttgagagacttgtcttttttacaagtctgtccttggaagcgtgcctccttttgttgtttgttctatatatacacgtttttctgccgtgtgctgttgttgtgtagtactacttctgaaacaggtagagcacacaccgtttgtgtgactcggtgtgagtgagtgacctgagtgtgctccctgtcactttgcagctctgtttttttttttttaccatttttgccgccctgactgtaagattgtagtagtaaaagttgattccagaaagataggggaggagaacatagtaaaatgtgatgatgtttcttgtactgtgttgtgttgtcctctgtttttgttgctcaactggatgttttggtgtatcatgcttgtaccttactttgaaagcgatataattgaagttcccgtaaataacgacgtagtatcaccttaatatggtttgattaaattgtgaaatagaatgtgcaagaacaaattataggaatgttgagaagcaaatgctagaaattttggaagtatgttattcagagcatgtttggttggttactgaacaggcatatgatcatgacctggcaatataacaatttagtattgaattagatagtacaacatttctccaaattcatattactaggctgtgtctataatcttgtacagggttactatattttgggacggtggtacatgatatgtaggaaagactaccaatgaagcaaagcatccttgtaacaaattgtgtcacgcctaaagccttgtggtgtgtccttagaattacgtagacaaccaaacaaaacacacccccttaagatcgccctttctagattccatgatcagaaaaacaaaattaattattgatgttactatatcacactagaaatttcaatgcacgaagaattttacatataccagaacacacaagatcaatcatgtgaaattacaaagccaagagtacgtgcacaaagtgcacacgttacaaagactaaaaaactacggcttcgccgccgccgccgccgccgcggcgagcgggtggaccttgacgacgccgccgctcttgccggcgtccggcgccgccgccgcgtcgtcctcgtcgaccaaggtgagcaggcgcgtcatctcggcgaaccaccacctccgctcgaactcgtagcccagcgccgcctccaggccgatgtcgccgtagcggctcacgtcgacggcgccgcccttgccgtagccggcgccgtagctgtagccgtcccaaaccctcgccgccaggtgaagccccacctgctcgtccacccaccgcctcttctccgccttgtctgggcggcggcgagccgccgccggcgccggcgccgacgacgacgacggtggccggaagcagcaggccagcttggacaagatcgccatgcgatcgaggcgaggcgcaagagcgagctagactgatcgatcgattggcaatggcgccgtgtcgatccctctatatgtagcgcgcgcgcgcgggctcgcaatccgagtcggagaggtagtacgtgacgatttgaaatcggagtcggagattttctttcccgcgtcgtcgactccgaattgagcaacgaaggctaagtacaagttgaatccacaatataagtgaatgtcatacagaaatacacaactttgcttttttttttctcgatttt

SEQ ID NO: 40185 - DNA, 2339 bp, Oryza sativa
tcgttttgtaatttgagatgggtgatcacggagaatgaaatagtagtagctgtataatccttcatgttcatttagtcatgtcagctgtataattcacgcaacctgaacttgtataatcctgcaaaacgtaagcaagcaatgaacacgaaggattatatagatttggaccgcatgtgtgcgtaatatcctactcctgtatatggaatatggatgatcgaaataagctacaatgcatggggtcctaacgaggaatgctagtttctctgttcataatatcatactcctgtatgtgtcctgtatgtggaatgtttagattgtggatcattaacctcatcttgatgagtatgcaaccaacgcatgtaagttgatttatttcacctctgttcgtatggatcagtttcttttatccaacataatttagttgtcattgcattctttggcacaagcattgaaacatcatgacttggtttgcctgatttttacgatttgcaacactgcaaccatggaaaacaattcaatataaaccagctttcatgctggtaactattaatacctctgttagtttgttctacaatttggtcttggattctaaattctgagacttactaaaaaatactcagttatctctttagaatagacatattatctctttagggcactactgtgttctgccttttcaaattgagcgtctaaatagaagaaattgtgcctatgtaccttttctatatattcgatgaaataagttttgatagcaaaaaaaaaaatatgcttgcggttctacataaatagcgatatggctgaaatgagacatttctaattccagattatgcaccattttgatagtgctttcagtttatctatttgaaaagctcttagatatgtgatttagtcacccgataagcttgcgactttgcagtcactgctgattggttcttttcatgtgtgctttctctcatcagtcattgttcttgccgtagtttccagataattagaacttttcagaaaaagaaagcagtgatatccaacgtgttttataacacactacgatgtacttcctccgtttcacaatgtaagtcattctagcatttccacattcatattaatgttaatatgtatagattcattaacatcaatatgaatgtgggaaatgctagaatgacttatattgtgaaacggagggagtacatgcatctttcattttgtgttttgtgattcttacgacgagtgtccagaggtagatcattcaatcgacttgaaatgcacttacctggcaaaatatgttcactgctgggtatttttactctcattctctttcatcatttcgtatggggaggtatggtgaaggcgagaagcctataatgaagtatgcctgcttcaccttgtctttgctggtatataatggcccatttttctgattcctggttaatatcaaagttcttctcatcaagcaaaatgattccctaacctccacaagcaaaattgtttgtaatgcctttaagaagagaagaaactaccaaaatgattccctaaccttttccagtgtctataagcaaaattgtttgcagtgcctttaagacgcgcgcgaagaaactgttttgagcatgttgctacatcaatagtacaatcgtcacctatagatgcctcacataaagtcattgtggctcacaaatttgcatccaaaacatgaattgagattcttttaaattggaagctcgtcactgagggttaggatcaggattgtctactactccaagtgatctgtacaatagatgatcagctcttttttttttttaacttcgcaacaggtgatagattcgataaccattggaaatatttagaaacgtgtagttgaactggaagaatatttgtggcattatagccacctaacctttttcttaatgaattattccaataattttttattgagtaatctgcccttataggaagaaatttgtactctggccatttaagctcctataaagcatgaacattattgcataagcagggagacattcttccagagtataagcttctatccttatttgtggatccaaataattatgctacctagttgaaattgtatgttcatcgagtgaaaactttcaagctgaaattgtttcgttcgtttttctcctttaagatgtgtattacatgtgcaatttttattaaggtgttacagtacttgtgcttaactgttctgtttattcaacagcagcgttacaacatactccatacaaatgtaataactcgcagcattttttatatcaataatggaaaattttagtattgatgtaaccacactcatgaggcacgccaatgccgcgccccgtaatctagtg

SEQ ID NO: 40186 - DNA, 6813 bp, Oryza sativa
aacgaagatttgctaagtattccaataaaaacacatatggtaaaaatattagttcataggagttaactctattgttgtggcacaatattttcctataattcaagatttcacggttttaagtaattttagtttagaatttatatgttgcgagggtaattagaagaaaatcataaccaacattcaaaatagtcacaaatgatttattgggaaaaaggttgataacggaatacaaatgttttagaaaaaatgactcatatttttcaagcaacattaaataaaatgctcgcgcatatgcgcgggcttgcttcctagttacctttaaagaaaaatcttcggtgtgggttccaaactgacagtagtttcaacaaatatatataaagagtgaatttcagaaaaccccatgttttgaggccaatgtaacacataactacatgttctatttattttctcatataacccagtgcattcaatccaattaacacagtaccataggtttaagtgtgggaaagtgttacaatggcaagtgacatggcagacctactccacatcagctggccccacctgccagatcaatgcgtgggctatttagggcgggatcatgcggaagaacagaactgcacgttccctgttgccacgcacacacggccggcgacggcattccccaaccatctctcgcatgatggcctccggtgatgatcgtgctattgacctagctggaggaagagtagaggaagagaactcgttggctaccaagattagggagatggatagaatcaacaatattcctagcagttaacatccatccattttcttaagatgatcatctgaatcgactccaaagtatgctggttggtgattcgcaaggacacactgcttcatagttgatgaggaattaaatctagctttttgatcatgtttgtcttgtcaagaaattagggctaataaaatgtgaagaacatgtgaagaactcaggttttatataccattctctggcatacaggtgcattctcacaaagcgaccatcctatttttcccaagcagtcacttaagcaagaacgatcaacagtacaagtatcataacattggacaccaacaaaatttgttgttttatctgtagtgatagcgccatcctttcaaattgatcgctccttttcgtctccactctccagagcctgcaacatggtgatgtccttgttcctctctccgtcagctatcatcctctccttgtgcagttcataccattgattcacttaagcttcatttcgatttcttgcacagtcaacagcgtgtcgttcaatctcaattgtgttgagatctcttgcagccactgcccacaaaatcacattcatcgtcatcctgcaacaagaaaaaaaatgccaactgaaacataaataagaaaaactagtgagaaagaaattgagtcagcaatccaactcatatggggcacccaatggattgtctcccagcatctgaaccttcccaggccatccttctcactggctcaacataattgaaatatcatgcaattttattttgcattgacaaaaatcgcaaattcccaagttactgaaaccctacaaacataaattgattaaaattgcagaaaagcagagttggagatgcttgcctttgcctgtgcacgacgacctgcccctctgaacttgtaagaggacgatttggtggaacactgccgcagtgagcatgaggaagacgaggggtgcatcgtcgcgtgcgtgggaacagaggatgggtgcttccgttctcccgcgtgatcccgccctaaatagcccacgcattgatctggcgggtggggctagctgatatggagcaggtctgccatgtcacttgccattgttgcactttcccacacttaaacctgtggtattgtgttaattggattgattgcactgggttatgtgagaaaataaatagaacctgtggttatgtgttacattggcctcaaaacatgggtttttttgaaatttactcatatataaatgatgtgggaagttataaatcctactccaaattgctattatttaaccatgacaacttgattttaagcaaatttaagaacagagaatactgcaaaacaatctactcaaatttgtgatgtacgaccattttaaaattttatttgcaggttgaaatgacctattgctactgtaacgccccaggtagccacgtacctagagtgccacactaaaaaaacattcaaaaccactaactcccgaaattattagaaatttcggcagagtctctcctaaaaatacggacatccacgacacgtagttataagatagatcaataaagaattaaccaaccattgctaaccatcctagctccataaattccacgtgaaaataaagactagaactttaaatgaccgttacaagttctacgcaaaacttatgctaaacagaaacatagtctaaaactaaatttcaatagtgtgcaataataatgtgtagttcaagagtgctactcctgtcccatgccgatcaatatcattaggtacctaaaaaccaaattaaacacaagagtgagtaaagaatactcagcgagtacaatattgaactagtaaaacatacacaggtttaatgcaataagaaaaccaatatgaaacatttgacttcctttaatttaaaacgaaagaggcaaaaagtagtagttctctccgggcaggtgtgaatatcctcttagcattaccggtaagccgagcaagcgtgatcatcgcttctcaaggatcatgaataaagatccaaattgcactcccatgactacgcatggtacttgaataatgtaaacaaaaatttccggaagaatgaaacatgaataacgtcgtgaacttgaacatgaagtgaaatatgaatatgtagcataataccaaaaccacataattgataatacgaagcttcgaataataattgggtaaatgaaaccaacaaagcaacacggtttatccatcacacaagtccatcttgtacttgccttaacttcttcgataatccaactcaactcctccaacgttggaaccctccacacctgtggagaaaaactacgcataaaccactatatctaatgatagttacaagggacatttactaaaatcgaaacctagaatatataaaaaattttaccgatttatattaaataacctatagctgttcccttactgttttatgcgtaactcacaaaccgtctaacgaaatctatcaaataatataacttcggacatctatacaaaattgtctacaactttcatgttgggcgaaaattccgattatgcctctgcaaatcccagattaaggaaaacgaattgctgtcctgatttccggatccggtcagcagtactgtttctgttgtttctcctaaaccatttatcggaatcaagggaaaccagcggcgttagaaagatatcgacaatggctacaaactttatttagaacaactaacctgaatcccgacggtttaatatcagatttgaaaatacggtttcagcctataatcaataacctcgaaaattgcacaaacgactatcgaataaatttctatttgaatcaaatacttctagagagtagccaaaagtaccgctgcagtgtggatactagaatctgagaacaaacctgctagttgcaaaatcaccgaaatccccaaattccttcttcctcctgctctcctgcgcccttctcctccctaacagcagcagtcagcagcagtcgtcatcagcagaagcagtcagcaccagcagcgatatgaagagaccagatcgcagcacatcaaggcatcaagccatgcattagcagcagcggcaattaaaagatcggatcggcagcagcaacaacaggaatttggcagcagtagctcagcaagaggcagccgagcagggaatcgattggcggcggcggacgacgacggctgtggcgacgccgtcaccagcagcggcggtgcagaggcagggttggggaggacgacgggctagggctagctgctggtgtccttttcttcttgttttttttttcgttggttaaatagagagccgagagcctaatcaatatcgaacgacccatattaatttgatcacctggatttcgttcggactccgattacaataaatttatagtctattttgcactactcggcgagctctacgcattcacggttcctgattgcctattcgaataacagtttaaaagttaaaattttgcgcgtttgttctaatattctccgaaatatactaattcgaaattcggggtattacagctaccccatgaagtcacgagcctccataatttattagcttgaatatcagatactggaattgaaaaattaccagaaaatttcgtttaatggtcaatatagggagttcttaaatgggtatcatagtagtgcaaagcacgactacatggctagtatttctcgaatgggtctaacgaattaactgacgaaatagggtggtatctaagccttggtggttccaaaaggttgattaatgataatttaactaatgactaggaaattttaacgaaacagattttcttctaaaatttccttttgaaactttgctaaaactcttacgaggcttgctatagctgaagtaattgcattttccatcatgtctttcactaaacctcctttcaactatataaaaccaaatatatgttcctatcagccaaacacgttaacaataacaagaagagaaaattccatgtgtacccctgaaagttcgctcaatcccttctatacccctgagattttctcattcccttccatacccctaaatttcagtttggatcttttctataccccttccatcagttgaccgttaaattcatatcataaagtccattttaacatttggtataaaaaaatataaatttatgaattatattgatggagtttataaatttattgtataagtttattttgtgagatattacttaacaaaaataatttttatctcgcataacaagatttatcttataaaaaattttgtactactataacaaaatatgctatatatacagtttttaatggtaattttttttgttttatctaaaataaattttgtcatagataaaaattatttttgttttcccttcacgaggtaaaactaaaatattacttttgttaaaaatatctcacaaaataaactcataaatgtaatagtcgcatacaataaatttacacaccccatcaatatacttcataaatttatattttttttataccaaagggttgtcatagataaaaattatttttgttttctcttcgcgaggcaaaactaaaatattacatttgttagataatatctcacaaaataaactcatacatataatagtcgcatacaataaatttatacacttcatcaatatacttcataaatttatattttcttgatagtaaagggcaaaatggactttatgatagaaatttaacggtcaactaatgaaggggtatagaagggatccaatttgaaatttagaggtatgaaagggaataagcaaatctcaggggcatagaagggattgggtgaagtttcaagagtacacaggaaattttctctaacaggaaggtaaacaatagttcattaaaatggacttgatgtacgtacaagcaaggtttagtttggatgaacgcagtttatgtttcactcataatcccaaaattaggaacataatatcaacatctaagcatcacaacacgttacatgtgcatattgctttgagaactaaagagaacagaaaatatccagcaccaaacatgtcaaactagctaggaatgccaatatctacccatgcctacctccctcggtgtgcccacgggcatgcctgtttaccagccaccacaagtagtgagacaatgttgaaaaaagaagtctgcaagcattataagttcaatacacatgtacgtagcatatataattgagttgtaaagtcatcaacaacaagcccctaattacaaatattaagtcttcggaccattggaccttacatccacaacacatcacaaatataacaggatgccacactagtggtatggtctgacaatcagaccatatcaaggagatcagagttataagttttacccaaccgaaatctgagcttcaagactggccattcaccaataaccttagttattgccggcaataaaactgatagcaaacaaattccaatagccagccatagcaatcgtggggctaatacggtgtataaaccagttgcaaatgccacagtagttgccatgtatgcaaaccacatgagcttcttagtgaaggacctataatgaagcaagaactgaagatcctcccaccttgctatgatgcaaatgaaggcgacaacaagtgaggaacacattgccaatgtgtctgcaatcaagaatgactgaaatacgaattttcttgccatgatgggaaatcccaagtttccagcatcgctgctataccctccaggtaaggtgaatgcagcagcaaatgtaattgtagcaatcagtattgcaactaaagaagtgttgcttgtatatgtctgagttagtgacttagcatctttcattgatgatttatttaatttgtccttggcatccttatgaagattataaatggatgttgcgttttggggatcagcttccaacataagcattgacacttcattctgcattgattaaaagagaggtacaaatgactaaatgtgattggtataacataataaaaagccttgatatcctacctttcgggtataagtattagcaaaacatgaaacacctttgtaatttctcttcgggaaaagtgagcttgtaaagtcgtttagaactcaa

SEQ ID NO: 40187 - DNA, 9549 bp, Oryza sativa
cacgcataatgttatgatgccggactcagtcatcataagaatataattatgattttaatcttttactgcctaattaaatatgtcaatgattgttaggataactaacgctcaacatttaattttgaaaatatcaaacactcatattcaaaagaaaaagatatagttgtataattttgaacgatattaacaaagtgcccatagagtgagctataaatattaatcttggtggtttataaatctatacaatctagaaagtatcataactacttaaaaacatttttaggacaaatatcatgtatttaaactattatgaaataacatcttaagtaaaagtcgtcgtatatccctatggcaataaaataaaaacaaaatgtccgtgcatgttttattccttcacgtagcatctaggcaatcaagctgctaatggaaagtttgtttggttatgatttacgcattgatagatgatattttgatctaggtgggttaataaattttcaattccgtgattttctacactccattaaaacatccgttcttttcaatactctattttacacatgcattcctatcatatttttttaccttttctattctttttttttcaatcatgtgttacgaaggaacctttaatttttttttcaccgagaggcaaagtcataacatttcacaatcttaataacacaaattatgatggtttaaataacatgcccgcgcagacgcgcgggctaccttcctagtttataaaaaaaatataagttatgcatattcatattttatcatctaataacaataaaatattaatcacaaaaaaaatcacatgataaatctacatctcacatgaaatttattactcctattttatacatccaatccagtacctaaacatgaaccaattcctgagtgcttgcctaagttggcaacttgtgactagagaggctgatgatacctgcatgcatcctagtagtatcttgcaagttacaaccaagcatgcaaacatagtaggatttgaagactgcaaatcaagtatgtttaccattttgttagggcatggcttcttttggtaggtttgtttggttttggtcgattctataagtttaacggtttcacttttcacaacagtatctttttttttacctatagaagtttacttagagcatctcccaacatgctgaaatctaactctccaaatttctatttggctagcttgtcaaaaaaaaaaaatcagagagtcaaatttatctttcacttctataacttttcaattaccctcttcaatatgacaatggattcacttgtcaatctctgcgattcttcttcttctctccctcaacatctttccttaccccacccatagtgccccagacgatggcattgggtggacgcagtgcaaagggcccagtggggtccggcagcagcggagatgcaaaggagataatggatgaggaagttggtgtggcgaaggctgaggtcgatcagtggtgggaatgctacctccagtaatggcttatagcacatgttgatttgaatgtctacgacagggtacgacaaggtagcctcgagacaacaacatgcttctcatcaacatggagggaagagggagggagaaagtgtcgcctggtcacctccattgtcacactagccactggccagctctcccacaccaccaatgccaggggcgagctttagcacagccaccgcttcacctccaccaccgcactaccctagcttcgcccaacagccaccgtcaacgcctcctctccgtcaacataagagagagagagaagaggagagtagccatgtggggaggaggaatagtacatggggcctaccgtttggcaagttattttgggttgccaagttaggccaataaggggagggatttggccatccggttggaaaggttattggggtagtatctttttactagaattgtcaaaaaaaaatagtttgagagccatttggagaggatgttgcctgttagagatgctcttaggacatcaaattccataaaaacatcagaaaaattctctcgatgaagatttataaccactaaaactgccctcaattcgaagggagttcaaaacaattaaaatcatgttcgaattgagtttcaatttcactttaacccctttgaaatctcaatggtaaaacatcaacccgtcaggtagcatggttctttttattcctttcaaaaagagttaattacaaacagaatcaaaactaacagttaggcccaaggcccatccgagcaaacaatagatcatgggccaggcctgccaccaccctccccctcctggctcccgctcttgaatttcaaaatccaaaaatatcggcacgactggccgccgacggagcgggcggaaaatgacggaacaacccctcgaattctaccccaactacgcccaccaacccacacgccactgacaatccggtcccacccttgtgggcccacctacaagcgagacgtcagtcgctcgcagcaaccagtgggcccacctcccagtgagcggcgggtagatctggactcttacccacccacactaaacaaaacggcatgaatattttgcactaaaaccctcagaaaaattccgatattccaaaccagtacagttcctgaccgttggaggagccaaagtggagcggagtgtaaaattgggaaacttaatcgagggggttaaacgcaaaaacgccgaggcgcctcccgctctatagaaaggggaggagtgggaggtggaaaccctaccacaccgcagagaaaggcgtcttcgtactcgcctctctccgcgccctcctccgccgccgctcgccgccgttcgtctccgccgccaccgccgccgccatgagggagtgcatctcgatccacatcgggcaggccggtatccaggtcgggaacgcgtgctgggagctctattgcctcgagcatggcatccaggtaaaacaaacaaaaacggatctgatgcttccattcctccgtttctcgtagtagcgcgcttcgatctgtgggtggatctgggtgatcctggggtgtggttcgttctgtttgatagatctgtcggtggatctggccttctgtggttgtcgatgtccggatctgcgttttgatcagtggtagttcgtggatctggcgaaatgttttggatctggcagtgagacgctaagaatcgggaaatgatgcaatattaggggggtttcggatggggatccactgaattagtctgtctccctgctgataatctgttcctttttggtagatctggttagtgtatgtttgtttcggatagatctgatcaatgcttgtttgttttttcaaattttctacctaggttgtataggaatggcatgcggatctggttggattgccatgatccgtgctgaaatgcccctttggttgatggatcttgatattttactgctgttcacctagatttgtactcccgtttatacttaatttgttgcttattatgaatagatctgtaacttaggcacatgtatggacggagtatgtggatctgtagtatgtacattgctgcgagctaagaactatttcagagcaagcacagaaaaaaatatttagacagattgggcaactatttgatggtctttggtatcatgctttgtagtgctcgtttctgcgtagtaatcttttgatctgatctgaagataggtgctattatattcttaaaggtcattagaacgctatctgaaaggctgtattatgtggattggttcacctgtgactccctgttcgtcttgtcttgataaatcctgtgataaaaaaaattcttaaggcgtaatttgttgaaatcttgttttgtcctatgcagcctgatggacagatgcccggtgacaagaccgttgggggaggtgatgatgcttttaacaccttcttcagtgagactggtgctgggaagcatgtcccccgtgctgtcttcgtcgatcttgagcctaccgtgattgatgaggtgaggactggtgactaccgccagctcttccaccctgagcagctcatcagtggcaaggaggatgcagccaacaactttgcccgtggtcactacaccagtaagttccatctttactactatctgttcacaatttctggaaatgtgattgtttggatgtctaacatgtggtgccgttcgtttcagttggcaaggagattgttgatctgtgccttgaccgcatcaggaagcttgccgacaactgcactggtctccagggcttccttgtgttcaacgctgttggaggaggaacgggctccggtctcggttcccttctccttgagcgtctctctgtggactatggcaagaagtccaagctcgggttcaccgtgtacccgtcccctcaggtctccacctctgtggttgagccatacaacagtgtcctctccacccactccctccttgagcacaccgatgtcgctgtcctgctcgacaatgaggccatctatgacatctgccgccgctccctcgacattgagcgcccaacctacaccaacctcaacaggcttgtgtcccaggtactgccctgcatctttccttgcagcgctatgtactccagttatttgctgtaagatcaatgtaatgtgcaatttgtcttgacatcatgtggctaatgctaatgtgctgcaggtcatctcctcactgactgcctccctgaggttcgatggtgctctgaatgtggatgtcaacgagttccaaaccaacctggtgccctacccgaggatccacttcatgctttcctcctacgccccggtgatctcggccgagaaggcctaccacgagcagctctccgtggcggagatcaccaacagcgccttcgagccgtcctccatgatggccaagtgcgacccgcgccacggcaagtacatggcgtgctgcctgatgtaccgcggcgacgtggtccccaaggacgtgaacgccgcggtggccaccatcaagacgaagcgcaccatccagttcgtggactggtgccccacggggttcaagtgcggcatcaactaccagccgcccagcgtcgtcccggggggagacctggccaaggtgcagagggccgtgtgcatgatctccaactccaccagcgtcgtcgaggtgttctcccgcatcgacatcaagttcgacctcatgtactccaagcgcgccttcgtccactggtacgtcggcgagggcatggaggagggggagttctccgaggcccgcgaggacctcgccgcgctggagaaggactacgaggaggtcggctccgagttcgacgatggtgacgagggtgatgagggtgacgagtactagagaggttcagggttcttgcctggtgccttggcaatgcttgattactgctgctatcctatgatctgtccgtgtgggcttctatctatcagtttgtgtgtctggttttgaaaaacatttgcttttcgattatgcagggtttgcttgtagctttcgctgctgtgacctgtgttgtttatgtgaaccttctttgtggcatctttaatatccaagttcgtggtttgtcgtaaaacgaagcctctacttcgtaaagttgtgtctatagcattgaaatcgtttttttgctcgagaataattgtgacctttagttggcgtgaaactagttttggatatctgattctctggttcgcaatcttgagatcgtcgctgcttaggtgagctaagtgatgttcctaagtaaatgctcctcaccagaatacgtagctgtgtgaaaagagaacgcgtgaatacgtagctgtgtaaagattgtgtcccaagtaaacctcagtgatttttgtttggatttttaatttagaaacattcgactgggagcggctagagccacacccaagttcctaactatgataaagttgctctgtaacagaaaacaccatggcaaagtgcacataaactttcccgtattaacaccaactagtaaatttcaacaaaaattctagaaaaattactaattatgttatcttcaaattcattatatttagggagcaacaaaaaaaaagacaaaatgttcccgtgagagtaaggctatgtttagttctaagggtgaaaatttttgccatgtcatatcgtatatacggacatacatttaaagtattaaatgttgtctaataataaaacaaattacaacattcgactgtaaactgcaagacgaatttattaagactaattaatccatcgttagaaaatgtttaatgtaataccacattatcaaatcatggagcaattaggcttaaaagattcgtcgcaaattagtcgcaatctgtgcaattagttattttttagctaatatttaatacttcatatagatgttcaaacgttcgatgtgacgggatgaaaaaacttgccagaggatctaatcaggccctaaaattactactatatattggaggccaagtttaattccaaactttttcttcaaacttcaaacttttccatcacatcaaaactttcctacacacataaacttccaacttttcacatcacatccttccaatttcaaccaaattttcaattttgacgttaactaaggctgtgtttagttggatccaaagtttggattttggtttaaattagagatgatgtgactgaaaagttgtgtctatatgacaggttgatgtgatagaaaatgactgaagtttggatctagacacagcttaaacatatgttgaatttaccactgagaatctcactgtcatgtccagacaaaattttcagtctcgccaaacaattaaacaaaaatacctgtagtgtactcctacgtaaataaatatccgagttagttggaagtgcacaaaaagcttggtttttctgtttctgttacagatataggaattaggaaagcattgcaaaagggattctcacatcacattatgccaatttgaagtaacatccttggtaaaaagatcagaaagtattctccagctattctatgtgaactagatatggcattaggtacaaataatcatgttgactttgcttcctccggctgcaattcttgcactgggatcctatggaagcaagcaagaaactctttgttcccttccgcgccctttatcggagattcaatccagcccttgttgcagaatccaaactgctctacgcctgaaattatcctatctagcacctgtgaccaatcaatggaatatgttggtactccgatcagaactcaagggaagaatcgtgaagtaaaatgaggcaacaatcagacactgctgaaatgggatcttttcaggatataatcaaaggatttgtttggggggtcttttcttgcttacaagtgaaactatttgtctggtggaatttcaggaataaacagcaaccttattttaaggaagtagctcattcctatattcaatgtgaagctttatgatggggacgcacaaaaaaggcagcaaatcatattacctctttatgaaccagagggtcccgaacaatcccaccacctcctacctgaacaggataaaaaggatttgctgttagtggcttgcttatttctatcactgtgcatgtatgaagagatctgaaggctatgaaagtgattatacattcttttccaattgatattcaatcaaaacgttcgaaaagaaaaactaagaccatttgtttgatacctgagatcgacgagcttcaaattgaggtttgataagtgtaatcaatgtcgagtctgtcttcattactttgactacagcaggcataaccttgatttcacaggtaacgtcagtgaacaatggatagcatgtgctttaataatttatcgaagctgctgatcttatcatcttatatttggaaaagattgcagaacatcaaaaacatcatgaacttgaactacataggtcagtaggagcatcggcagccatggacgccaaaagcacactattttttcccaatgcactattacttcagcaagatgagctaattgactatacaagaactctattgcaatgatactttttttttgctgggtcggccaaagattggccggccaatttcattaagattgagggaaaaaaagttttaaatacaacgatatgaaggatgtcgcgccggtctcaagcaatgatacttagatcattatgcgctaaatactaaacattgctgggaggacaatcaagcagcgtcggttttctaaggagaccttggaagagaaactacaaactagactaaatcatcttcattgcttaatgagaaaacaatgccatcgttatacaggctagacgtcacaaattaatctaaaccttcaactgctgcaaataacattctaaaccagataagacaatatctataagattactagatagaaactgtaactacatataagataacagccatctagtcaagcaaccatagttaagataacagggcacatgaatatacattcctgcatatgatatatgcagcatacaatatatagatgcatttaagtactggaagtctatgtagttgattgggtcaattttactgtatataccagacaactttacaagaacacacagatcatgatcctaagtatatcatactaaccatacaaatgaatagtacaaggaatgttttgtgcagaaacaccaactaaagaacagaacgatgtaaaataacccagtgtatttttcaataacatagggaaatggtattctcagttaagaaacagtgacatattataagagctctgctaaaaggacttgtgcaagtggacaatcatgcagacattaaaaaggcagcaccaaatcataccaagagaattgagatgaatgacagatccagggtcaccaagtcaaccagctgtggcagttcagtaagatatcttaaatttgtacgttcaattactgaaacacgttcatgcactcgaattttttcagccacctgaaatgaagtggagcatattatagttctgctgctgtaatcttgtaacaactacctgcagcttacaaataatgtgatagcggttagattaaaaataaacttttaagggagtagcgcaacctgtccatagccaacatcaacaccatatacatgtgatgccccatgttggagtaaacagtcagtaaaaccgccagtggataaccctgaatcaagggctaccttttcatcacagtcaataccaaattctttgatagccgcctcaagcttatgaccagctctgaatttgatcaggacagatgacacaattataaactggacaaactggagttacttttgtttgatagcaaagtaagccaatcagttcgagcatcacctacatacatattttggaatttcagccttgatttctatgatcgacttgtcagatacttgtgttccagctttattcacaacccttccatccacaaggaccttacctgaaatttgacataacagagaatgctttattaggtttgctttacatacaaaatatacttatgtacatggttaaaaagtcatagctgaaaggtgaagtgtgcaatttcctggtagatgtcatatgtggcaatagcatgagaaacacatttgagtacgcatatcatacaatctgttgcagtagggagaacttctataagcttttcactgatgaaattca

SEQ ID NO: 40188 - DNA, 6501 bp, Oryza sativa
gaggtatgtaggaaaaatgaatggtggagagctgtgattggttgggaatagaatgttggtggagaagttgttatattttaggacaaatctgagggctaaaagttgttatattttaggacatgggagtactaagttgcagggctcgttgcagtctcaaattcaacaacaaaattttcaaaacagactaatttttaaaaattgaatcttcaggcagacccctccccacacactaccaacccctactatatgcggaattactattgggcgagtgatcgcccagggcgatcggatccggatccctctccctccacctggtttcctttttttggcaccgtattactttactattttagtaattttatgcacctaaagtttgtaaacctcaagtttacacatctaaagtttagaaacctaaagtttataagtcaaaagtttatatatccgattcaaatttgaatttgaattcaaatatttttatatatagtatttctatacatctaaagtttatatacccaaagtttataagtcaaaagtttacatacttgtttcaaatttgaatttgaattcaaatattagtttatagacccaaagtttataagtcaaaagtttacataatcatttcaaatttgaatttaaattcaatttttttaatatatagtagttgtatttctatacataaaatttttccaactttatttttttattttttaaatttgtatggtgtactgtattaggaagagaagaattgggggggggggggagaaaaaaggggagagaaggtagcgtatagggagaggggtgggccggtgatcgctaggagcgatcacccccccattaaccgtcccttactatatgtgctgagttcttttctttgggttcccattgcttaaccgtgtgtttttttaaaaaggttttctatacggaagttgccttagaaaatcatattgatctatattttttaaaagctaatacttaattaatcacgtgctaatgaaccattccgttttccgtgcagagtaactccacctcccgaacacagcttaatcgggcttcttacaaaagtttactttttataaaacaattgcaagaaatgtgtttgcacaaatgaaatgatgaatgtaatttagcttcacaaatgaaattgcaagaagtgtgcctccgcatgtactgtgtttaaaagtaataatcaacgaagtgagcgtagcttaactggcaaggtttctcgtggtggaaccatttttctcgcgttcaagttctacatttgaaacatgggtactcgcatgtagatgagcgatatatgcccgtcgacatcgagacgcctatggtgatttcgtgaatctctacatatctcgtcccagtattttggagatgcttatagagataggatctgcatgtgtgcgtgcgtttataggggtgattatccaagacgttcgtgtaattgtccgctcacgaacacgtaattatcatggtagttattgtgattaaatttttttatgcgaaggatagtgtgattatcattcccttttttgagcagattttattttgcatggatttttggaagtgattaatatttctttcatcgaaagtggattagcgtttctgtttcacatcttatgtttaacatttttagacatgattttcttaacatattagcagctctatattcacaaagccggaccaaatttaacgaaactttatgttaaaattattactatctacttaaattgccaaactttatactcaaaaactttcgacagcaacgaaaaagactttacgcacgtaaactttatgttaaaaagtcatattaaactttctactcatagactttacacatatataaactttgcacgtacgattaaacattcggtatgggtagtttatacatagaaatatgaattataggaactctatatataaatttttagtatagaaaatttaaacatagaaatcattcaaattggaaaaaacaaagtttttgtttggatatgatggacattattataatttagtatttcaaaattatggtttatttcttatagtgaatatggtgagataatgcttttttaggttttttaaataataaataatctgcccgcgcaactgcgcgggctttcttcctagttcatttaaaaaatattgtgtaatcagcatctttattatcggtaaatctaattggagaggcctctccaattatatgaagtataggaacgggaccacctatacatttgtcgacaaattttcttctaaaaatttgacagatgtaattatagtacaatcatagtgtaattacactgtaacttatatgtaattacaccgtaatttgcatgtaactacagtgtaacttatatgtaagtttcacataatcttgaatcgttagatctattacaagatttgttttggtgaggaagaaaacaaatcatagcacacacatatgtgaaaaaatttgttcccacgacctccattttaccgaaataacatgttacggagagatttttgaaagttacatacaagttacactatagttacaatgtaattacatgcaagttacagtgtaattacactacgattgtactgtaattatatctgtcaaatttttggggaaaaaattatcgacagatatatagctaaatcgtagatgaaagattagaagttgggcttagaaaattcaaaaggggagtacctatacatctttcgaaagatttttataatcgtatcacacagatttttaatctttgtattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatacactgtaaatttaagtgagaaaatcgagtgagagataagaaaaaatctttcgagtgagatatagcaaaatcgattcaaaagagaacgtcatccatctgacccatcaagcccatatgaatcagacccatgttttttacgcagtgcagggggcgccgtctctggctaatcctggccttccttgtccgattcggattttcggacgcgtaaacggcagcatctcggatccgattccatcccatcaaaattcccttgtccgatttctattccgcgcgacgctttcccgccatataagggtgccatccatcacgcctccagcaaattacagcagccagagttgagaagcgcaacctaattgcgagcagctagcgagcgagctcgatcgcctcgatctcctcgccttctcggcatggcgatcgagttcttgccgaagctggcgtcctgcttccggccgccgtcgtcgtcgtcgtcgtcgttgtcggcggcggcggcgaggcgaggacggcgccaggaggcggcggctcgccgtcgcccagacaaggcggagaagaggcggtgggtggacgagcaggtggggcttcacctggcggcgagggtttgggacggctacggctacggcgccggctacggcaagggcggcgccgtcgacgtgagccgctacggcgacatcggcctggaggcggcgctgggctacgagttcgagcggaggtggtggttcgccgagatggcgcgcctgctcgccttggtcgacgaggacgacgcggcggcggcggcggcaggcaacagcggcgacaacacgccggcggcgaagggtgtgtctggaagtagtagtaattaattagttggttcgtccagctattgggtgtctctctctggaggcctaatatgttgttgttaatagtgttcatcttttaggtttctgtcagtatatattttgcagtgttcaattgttcatagttctgtaaaaaaataaaagttgtacgagactacgagtacacttttccaaagcggaactgctatccgactgtcgacagtttttacgagcgaaaactgtcaaattttttagccattgattccgctctaagatttgtgctaagatattttgctatcggatctaaaccctcttttcacaagctagtcccatcatcacatgtttatggcagatttgttctagttatatctaagttacatgctagttcaattgtagttacattgtaactatagtgtaactacactctaactacattgttatctctatataaattagatataaagttgcatatattattttaatacatatatacaagttattattattatagtatagttctaggaaaattatatactatatagttagatttgaaggtttttttaaaaaaaaaacactcgacggtttttcagctaatccctttccaaagtacgtatactatgaacagtcccttgttaactataaaaactggaataacagaaaacgaatttaacaaccacacacacatatatatatcgatgactaatactcaattatagtggaaaaactaaacatacgagctagaacttacaaaaaactgaagatgcgatcgggtccgtgtcgctcggagcctcaggagtttaacttcataatgtaattggggtgatatggcttagtgagagaagtgaaaaataacattaaatgttttcactgaggttgagcttagcctagaaacaagtaataagttcactattcccagaaacaattttcacatagcccttagcccctattctaaactacacttgcatgaaaacaatttgatttagttcatcgggcgaggggggatcaagaaccacacgtgataatcatgtataggatagttgcccatgtaacacatgatttttatagctaggtgactttcttaagaggccgctcatgataatgcaactcttttcatggcccattgtttgctgggtggtggctcatagttcattgggccatggtccaccacacaatggtcgtggcctatagtctatttattgggccttagctcaccatatgctaggtcgtggcgcacagtcatcgagtaaggtatttgccataagctaggccatggcatacaattatgcttggcctcggcccactaaatgttaggtcatgttgttctgttcctcggaccataccctattatatgttgagcctccagttatttgtgacaaaataagtagttggtaatggtttaccaccttagtgtgtgagaaaccacaaattacttcacgtcgtacccacaccatcaggttgtccacatagcggcactgaagtagccgattcttgatggttttggtttgatgagtgatagtctagagcatcactaatttatggcaatggaaaaattgtctaccatttattatgatggaggcagccttttgtcagataaggtgatcctagatggagcttttgcactggaaatctttcatcacaagatagtcacataatacgatttgtgacggaatttcgctatttctagcttgatgcaagtaccttgttaaggaagactagaaccagtgtagtgttatatcaatcctctcttcatatacaatcccttttaagtgttttcttctccatgctttctccaaatcccttatgttcccatacggtactttcatgatttgtatcatttgtttgcaccttttttctcttatagcagagttcttcacacccattttatttttgttccttgtcttcatcctaacccttctttataactcctcttcttccacatctgatcccttttctactacctctacttattattttgcttttgcaagccactgcattattgttgctgtttcctctccttcccccttggcatgcttagttctcatctcagtctcaaaaagtgcagattgtgcatgttctcttgctacatcttcctcaccctctcccagagaaatattactcgctacatctgttgcagctaaatactattacctccatattttaatgtatgacgccgttgactttttatccaatgtttgaccattcgtcctattcaaaaaatttatgcaattgccatttattttattgtgactagattcatcatcaaatgttttttaaacatgatataaatattttcatatttgcacaaaaattttgaataaaacgaatggtcaaacgttaatcgaaaagtcaacggcgtcatatattaaaatacggagggagtacatgatttatctactgattgaaaaaaatgagggtacaatgacaatcagtcctctgcgtcctgttccctatcatccttgccattcacgaacatagctctacacaacgtggacgtgtttccttcatcgatgaatcccctccaatctgaaagcatctcgccaatgatttgcctcatggcgcgttaattagtttgcccgggatcatgtcggtaaaatagatgtttggtgtctgcaaaatcatgctggaattcagaccgacatagaaaagctttccattccctacttacgatggtctgctggcttatttgtgataaagaaacacaagaattaatgtaatttgtaattgatcactagtgcgaataggtcatctatgtcgaa

SEQ ID NO: 40189 - DNA, 4446 bp, Oryza sativa
ttttttacaacatattctatatatctatattggccatgttttgatatataagaaatacatcatttgatacaaactcctataaatagcaaaaaattaataacatatactatcatgtcatccaaataatttcatgttccctctctccttgctcactttggcctccttattttctagctagcaaatactacatccgtcctaaaatatactccatctatcctataatataagtaattttggatggatatgacacgtcctagtataatgaatatgtccagattcattgtactaggatgtgtcacatccatctaaaatcccttatattatgggacggatggagtagcaactcagaactggatgagacgtatcttagtccaacgaatctagacagtcccttatctagattcattggactaggatatgtcccatccagtcccaaattgctatattttgggacggagggagtaataaatatccattaaatattgtgtatataataaaagtccattaaacattatcttccatgctcttaacccaccacatggtacatataataaattagaaaattgtattagaaattctgagaacaaaaacgaaaatcaacttagcatactctcacttaaatcggtgaactcattacttttaaccacccatgcccctcccactcgcatgcgcatgaggtgcacacggcccctgcttctccctctacctcatgctctctcctccttccttaattttatatactaaaacgatcacaattttcaagctataaaatctcattcctaatctagaaataaaatattgaaaaaaatgacatcatatattgagtcatcatatattattctacaaacatacatacccaaattaaatctacattatccaaataaaattacaaattcaaatattaaataatattttattgagggacaacatctcaaccctttcatatgtcatgcgatttaacataaaagtataaaacaatttaataacacaggttgccccatcatacatagttttcaaacatttattactaattagatatagaattaataagtatgaataatccaagtcccaatacaattattcctatatttttatctactcccagtatatttatcctctactttcacaaatcccgatgaaatgattactaaaaataaacttatttagaaacaaatggggatgtgccaaaataaagttattatacgatagagggagtaattgctctaaaatatattctatgttactatctaatcgactttagaattaagctatttagtgtagcttcagaataattatgtaaacaatgttgttgagcagtattttggaaaaatcctaccttttaatcattggataaataatttggttgattatctacccgtataaacgtagcgtaaaatacatgcccgtgtattcgcacgggctacctttctactccctccgggttaataatacttgttgttttggacaaggatatgttctctaaaaaataactttgaccattatttttcattataatatgtataaaaatattaacaaatatatgatcttattaaagtactttttaagactaatatatatatatatatatatatatatatatatatgtagtcaccatatttgatagacaaatattttaaaaataattcataattaaatattttaaagtttgacctcacctttttctaaaacgagtattatcagccctgaaggagtagttgtttgcttaaagtatggatagaaatgcgctcagacaattctctgcatatataaaatgttcagtgtaagtatatatatatatatatgtgtgtgtgtgtatccttctcccaatatttgctatcaagaacctacaaaaagatatatagtccaacgagctacatgatgacaaacagtacatatgtagtatatatcactagtaattccagtgcatctgtaccaacattaattaattcagcagaaggagcagtacataacagacacaagctgtaaaaatggacggacggctctttgaagccgcaaagtcaggcgattgcaggttgatgaaggagctggtggctgccatggatccaagcatattgctccgcacaactcctcaggggaacacctgcctccacatatccactatcaatggtcatgaggaattctgccaggaggtgttgatgttagacaattctcttctcaccgttgcaaactcacacggcgagacgccgctgctcaccgcggtaaccaacggccgcaccgccttggcctccgttttgctcagacggtgctgcgaagcggggctcagagaagctatcttgaaacaagatgagaatggatgtaatgccctgcaccatgccattcgcaacggccacagggaccttgcgttggaactgatagcagcagaagcaggcctgtcacaaggtgtaaacaagtacagggaatcacccatgtacatcgctgtgatgagagatttcactgatatcttccggaaactgttggggattcctggttctgctcacgtgggttgtcatggccgcaatgctctccatgccgccgtgagaaacgggaatccaggtaagaattgcatactaggctgtctgacgagtcattaataattactccattattcgttaaaatgaccacaggcaggtgattcttgcatatatcattaaatttgttttcagttattgctaaagagttagtggagaagcgtccagggctggctagagaattcgacgatgaaatggatactccaatgcatcatgccgcaatgtggggtaaaacccatgttctcggagcattgctgcagtatgattggtccttggggtatgtcctaagtaataataaggacagtgtcccgctccttaattccgccgcataccgtggctatgttagtgttgctagagagcttgtgcatcattgtccagatgctccgtattacgacgctaatggttgcacatgtctccatcaagccgcattcaaaggtcatctggagttcgtggaatttatcctagagtcgccgtatcttcggaaactcgtcaacatgcgagataacggcgggaacactgctctgcattacgcggtgcaggattgcaacccaagaattgttgccgctcttttgtcccatggagacacggacgtcacggtacttaactacacgggaaacgaagcagtttggcaattagggggagccgccgattatgccaagacattaaattgggtacgtccttaattactcataccgtgctcctctacttaatttacttgatgaagcatgaacatatataggccgtgtttagttcacccccaactatcctaaacttctaacttttttcaggaactaaacacagccatattgcgctcttacacaacttaccatgcattacatggactgttactattgttactataagtattaaaaaataatcacatgataaatttacatatcattcatatctatctattatctattatatactaaaagtctattaaacttcctacaaaggctcttaaaccaccacgtggcactcctaaaaatgctctcaagccgccacatggcacagtctaatcttaccgtcgaatttcaattaaattggtggaacccattattttacagactagattagatttatatcttaactaattaaaagattagtatttttccgttcgtcatcccctctattcgtccgaattttcgcccatccctcaaatcccaatccgatttcgattttgtttctgtcgtccatctgtgaaaaaagtgtgaaaaaaaaatcaagtctttccgattccacaaaagaaggaaacaaactcaagcgaagttttcgtccgcaacatctgagttgagagtccaacacaaagaaaaataaatcatccagagtgcgcatcaacaacctaatgcccgagcgatccaacgaaacttcattgcaaatgtagatacaaaatccaataggacaatctagtaaaagagaaaacaaaataaaaacttcaccgaaagccgatgacgccgacgttgccgccggattcgctgccgctgtcgtagccatcggatttccggcgcgggaagccgccatcgccgccggatcggcccgcgaaccggatctagacgcgggtagccgccggcgccgtcggtaccaccggatctgccgtgggaagcagccgccgccgtcgttgccatctgatctgccgcgggacgccgccgctgctagattgggctacgagaagctgccgccgtcgtcggcgctgtcgactccactgcggaaagccgccgccacagccggatcgggccgagggaagcagtcggttccgtcggtgccgccggatctagccggcggtacccgccgcactcgacccctctctctccttatccactcaaatggagttgtgccgtcattgtctttgcgtcatgccggcgagacaggagggagaggaggagacggactggcgacaccggtggggagggggagtggg

SEQ ID NO: 40190 - DNA, 8768 bp, Oryza sativa
aggagctcgcggtggggggatgggagtggcaccgccggtagggagaggcgccgttggtgggggtagggggaggggaagcggcggagagggatcgacaaaaggggagaagcggccaacggtgggggtatgggagggcaaaaaaggaattaggtttaggtttctttgtctgggagttttgatggattcggaaccaatctgagtcgtccatcaaaatgaacggctcagatcagtcccgcttcgggccggcatccatcgacgggccgcgcgggcttgataggccgaatcgtggttaaactttcggttagggcccaccacacaaagagaggaggagcaaggggagcgtacttagacttctttgggccgacgggtgcttttgggctgaggcggagagaagtggaatgggaggaaagcgggccggctcggttgcgggctgaagaggaaaatgggccgaaaatggcctatagagaaataaggattttttatatagatttttatttaaataaatgctgaaatgatgattgtattatcaaaattagcaactaagctctgtaattttcaagaaagtttcaaagagtgtaattaatatggagaatttaataaaaattaaatccaaccgtatcattttatttctagcacttactttacttataaattaatttaactataaacctacctacttaaaaaacccaaatattccaaaaaaatatatttactatgttttaagtcaattttctttttttcttcccgttgcaatgcacgggcattcatgctagtattataaaaaaactaataacttcctcatgtataaatgatacaatcggaactactgctcccgtacgttcgtacgagtacgtatactattgataacaaaacaatagctttacatactgttgccgccttgccagaaggaaagcacgtccataaaaaaaaaaagacaaagtaaaaaaataaatcatgcgtctgtggtaccgtcgggaaaagatgacggtttttacaatatgatttttctacaatatataaagatcttacctactgttaccggaaggaaaacacctaaaagacaaagccaaaaaaaacataaattaaaaacggtctttaaaaaaggatttttctacaatataaagataaaaatatattacttcacaaatataaatatgtataaatatgcattaaaactaatttctataataaaaatatataatatccaatcaacgctctttaaactattttttaaattatttctagattaagaaaatatttgtttgtggtaccgtcgggaaaaaaattgacggtctttaaaatatgatttttctacaatataactatcttaactaccgttgatggaagcgaaggaaagcatatagataaaaagacaaagcaaaaaaaaacatacgtatgtagtaccttcgggaaagaattaacggtctttaaaataggataaaaaatatattactacacaaatataaatatgtcgttaaactaagatctacaataaaaatataaaatatccaaccaaccttttctaaaccatattttaaattatttttagattatatatctaatttgtgattcattgtattctttaaactaaattataaaagttatattgtggtcttaaatataatagttagctatatgataatttttttttaaaaaaattcacatcatattttagggtgtgaaatatcgcttcacaaatatactatattaatttaaatctacatatgtaaaaaaaaagagaacatcacaaattcagagttttgttatgttttttttcaagtatgtctgatatttaattgtaactagatgataccccgcgtgttgctgcggaaattgctagataaaaatataagtttatagcaattagcatgctaaaaatatttatgactaacgacttaaaaattttgaacatacaactccaatgcagtaaatttttaactcacgaattgaataaaccatactgaaaatatatgtaattatatttgtagtaaaatgaaaaaataaaattgattaaaaataataaataccaaaaaggcaatggagcttaaagcttcactgagccataggcccatagctatgcaggatctcttggatttgatgcatcaacagctagtgccatgtgtgttcctacaaagaagttttttccaggagaaattgtgttcctacagagaagctttttcgaggagaaattcggcctcaattgcgcaatccaaaggatgtatgtacagaagtaataactgttagcagtaaaagcaaagataaattatgccgaatctttatttgatataacatatctcttttcgtgtctggcatatgtagctgtatatatggacagagacgccagtggcggacccaggattttgctaagcccggggccaaatcttattgccaccgcacacaatgatacaataatagatgctacattgctagtttgctactaatactaatgcacgatcaaaatgtatggtacaaatttagttgcggtgcgaaaaagaagtacaaatacattttcaaataccttgctacgtgttatcttcctcggagtctatatcatcctcattgaattcttcaattgtagctccagatcttgatcctattggaaaaagaatcacatattacatccatggattgagaaaatgagaatcaaagttaacagtacacaaatttcagaacaagaataagacataccactagggagaggtagcttcatctttctggttctcaattcttgaaaatgagttaatatcttatcattatcaatgcttgcaaatatgtctctctcaatatagcagaccacgcgatgattgagccattcatcagccattttattccgcaactcagttttgatgatattcatagctgaaaaagccctttcaactgttgctgttgccaccggcaaaatcaaagccaattcaatgagccgataaaccaaaggaaaaactgtatgtctatcactctgaaccatcttcattgcaagattaccaaggtcactgcaacttaggaaatgtgggtctgctctcacatcagctataaatgtctcaagttggtcctttaggactatgcaatcatatggagagaagtcggcagcatacattctagcaagctcaattaacttatcttcatcaaaattggcaaaagaattcctaggatcaagacaagcaatgcatctcaataactgggtagatctctcagcaaaccgattgtttaactccacaataagctggtcatgtaccacattaaagatttcattattgaaatgatgttggtaagttatcaattgacctccacgaccccttgaacgacccctagtagtagttgtatctgacatatctggcacaatgatgttatacttgagacaaaatgtctttgtctcttcaaagagttcttgccaaccatgctgccttatgtggttaattttttgcaatgtggtcccaatcaatcctatagcacgaataatattttggtctttcttttgcaagcattgtgacagatcattagttttacccaatagtctaatcattaggtgcatgataagcacaaattcaaagctctccatctgttttagcaaacctgtagcagttgtttttgtagtggggttatcctcacatatattttctaatacctctaggactgctttccacatgtgctgcaaacgacacaaggttttgtgatgtgaaccccaccgagtatccccaggtcttgcaaggttagttgcttggtttttccctcttcctgaaaatatctccccagtctctaaactactcacaagattatcatggtgttcttgggccagctgatcatgtctcttacaagaaccattgacagtgttaacaatcatgggggtatagttaaagaaatctgagacaggagaacaacattttgcaacagacacaaccactagctgcaactgatgggcaaaacaatgaatataaaaggcataggggttttcatccaatacccgtctttgcagcccatgaaattcacctctcatgtttgatgcgccatcatatccttgccctctcactttatgcatagataaaccatgactaacaatcatggcatccaaagctattttcagtgcaactgatgttgtatcaggaacatgttcaaccccaagaaatctctcaatcacctgccctttgctgttgatgtacctatgtgacataacatagaataataccattgttaatatggtcagtttcaaaatataagaacaaggaaaatgcaaaagacagcaactaacctcaaaataacagccatttgctctttaatagatgcatctcgagactcatcaacaagaatggcgaaatttctctcaccaatatcctttagaatggctttagttgtcttatttgcacaagccttgcacaaatgcttttgtatttttggtgaagtcaatagatgattcccaggagaatttccaagtaatttttgggcatctttatccttctccttgtaccattctatcatctctagaaagttccccttattgctagatccatgagattcatcatgaccacgaaaagcaagtgcttgcaataaaagaaatctcacaacacccaatatcatagttatacgaccataatattgttgctctaacttcttagatccactatccatcttatatgatacactttgcctttgatttttgaaatcctcacaatgttttctagctctattatgaaaactatctactttaccaacatgttcattaaaagatccagttgcatgtttccaattagtaaagcccttacttgtgaaagcatcaacaccaaaattatcaggtcttggttgcttgaaaagataacaataaaaacagaatgctgcatctttggcaatactatactccaaccaattatgcattttgaaccacgagtcatgaaagcttctttgtcgatttcccattaacttctgtggatatttatgaccaattggttggcatggacctcttgacaagtattcccttctaacagcatctctaatgtctatatgaaattgctcaattggttttctaagcccaggatcagcaactatgtcagccggattaagctcaactgtctctgaattgtgaggttcttgttctggttgtggaatattactccccactgtctcaacaatactaggggctgcctcacaagtactaggggcatgttgaacttgaatgttactagctctagctccagtttctcctatggctgcctcaacaacagctgctgcttgctgagtattactacctccggttcccgctgtttgtggaggatttgggtctaaattggattggggtgttgctggggcataaaaagatttcaatgtagtcctaggcctcttcatcttctgatctctattgcaagttaaataaattgattggaatcaatagatctatagacactgcagtattttaggcacttagccacttaggcatttgagaaaagaagtaaagaacaaattgacagaagaaaatagagatggaaaacttacccccgtacttgctgctccgctcatgagcacaaagccgcgccttggcccttggcccttgggggttgtcggctcgttgccgaccgccggtcccagtgatggcgcactggtgctgtccgcctgtccgccagggagccggatgaggagaggagttgaggctgaggagtaaggaggcagcaaggcagaggcaggtagggagcgaccgagcgagccgaggagacggcgtgccaggcgggcggcggcgccggcgtgctgtcgtgctgggtaggaccgtaggagcgagcctcgagcaagaaggcgtcgcgccacgccgccgctctcccatctctgtctctcgcttctaaggaactgaggaggggagttagggttaggttgatttagtgggccttgggccaaaatttcagaggtatatctaggtggggggtccattactacacggcccacgacctggtccgcggcccaggttgccccaggcctgggtccacccctgagagacgctaaaactttactgatctgaattcagaacgtgacacacctaaaggagcaggactctcacatatcagttggattttatgtagcagacgatagcctagaaaactttgagctgaaatgagcatttcaggtagtgaattgcaacctgcactattgaagtattgagactaaggaatgttgacctgtttcacatggttagttagcaaacttacagcagcaagtttaaaatgtgacaaactaaaggaaaatggtataagatggaaatgtcagataagatatgaacaaataatatttcaatggaaggtagcgtctagtgagacacatacttatgtgaacctaattaatggtccgtaaacatatgatgtataaaatgagcattataaaagcaaacagagtctgcattagttaaacagatcgagattatggttggaacaacagatacctattagtgttatcttacatttgaacccaatatcttggaagcaaggcagtaacatgagctatatatgcacagcagagagacaattaagaaggatttgagcaaatttccatagagcagaaaatgattcactcgttgcaacaatttgtctcaaggacatgaatataagaatgttagatctctatcataccttgggtacaatctggtcagaaatctgcatactataaagacatttgcccacttaaattaaataaataccttcagatattaggagaaaaacaattgtgtatgcagaagtataaaattgtgctaaaagcagcaaataccacccataagaacgtaccagcaaatcgcatcatatcatcaaccaaaaatattgttcttcttaccactttcttaccggataactgaaacatttggtccacatctaagatcagatatgccataggccaggcctggtgactacatggtgcagtactttacaaaataatatcattgatcttgcattggccaccgatgagcaagaagaaaaaggcaagattgggatccatggtgcatggtgatgccgcagacgaacattggagagagagaggtaaggactcaaggtccttgaagtactccattatcatgtcttggcaataaatctgatgatagaggtcagagaagagtggcatcgagtgaggggggttaaaagaagataaagtgcaggagcgtcgagttgaatgctccttccatttgtagaagtggaggaggcagggcatgcgccatcagtttcacgcgagggagatggaatggggaaggtgaaacgaattagcgaaagattgggtggaagcgaggaagggaaacagccctgacggtcagggggagggtgggtgggtggggagggggggtgggtcagggggagggatgggggaagcgcgacgcggcgacgatgctgggcccgcggctggctcgcgctaggaatgagaggagacgcgatcgtggccggctagcgggcccacgctggcgcgcgtgatgggggagaccaggagaggaagcgagggtgtcggcggagggccgcgtctggcacacgcgcgatggggagaggaagcagcgcgcgatggaggaggcgaagcgggacgcggcgtggatgcggtgtaggggcggcggcgcgagatgcgggagaggagcgatgcgcgcgtggggccggcgaagccgagatgcgggagaggagaggaggggagcgatgcggggaggggaggggagcgatgcgggatgcgcgtggggccggcgccgcagcgagatgcgggaggggagaggagaggagcgatgcggaggaagggctcgatgcgaatctaacggtggggacaaaaaggggtgacgtggaagcaccaggaagcagagaattgtagtagtggggatgatttgtataggtatataggatttgtttgagattaagattctcaaagcattttttggatattttcagaactatttgattggtatttaagaagtaggcagcatacatgatacatagatatgaaaaaaaatatcaacaatatttccagccaatgattttgctacaatccatcaatagatttatggtcacatatttttgtctttgccatgattttgaacaatgaagtaacatgctaataaactactcatgtcatattttcttatacttaaggaatttcactatgtcaggcataattgatagatatatgccataaacttgattgacgtgactataagtgtactccaatggattagttagtatatataaatttgggaaaaataaatgcattcttcaaattagtaaaattgcctcatgtcactatgaacaataggagtggaaaacaaactaaacgctaaattatatatatttgtcaaaatataaacaataatatggtgttctcgatattatcaaggtgctatgtatctttagctataatttttttaagtatcatgaaatgattaacctcactcattttcaaaagagagtattttatctaaatgataaaatttgagtagtaatgatgaacaccaaaaacaaactgtgtgtacactgtaccacaaatgtacttaaaaacataaaaaaaaactatcttgatatactccatcttctcttgtcctattctaaagggcatcaagggaacatatgactaagttaaggtggccacggtatatgccaccatcactaattgcaggggcggacccaggcctggggcaacctgggccgcgaaccaggtcgtgggccgtgtagtaatggaccccccacctagatatacctctgaaattttggcccaaggcccactaaatcaacctaaccctaactcccctcctcagttccttagaagcgagagacagagacgggagagcg

SEQ ID NO: 40191 - DNA, 996 bp, Oryza sativa
ccccccccccccccaaaattttttatttttgttttatttgtttgatatttttttcacgcttagggacacacaagaaccaaccatagaaaaattgaactcaaatagacgtaacatgtgacatgtagaatttttcctctcctctcctctctccgaactagtgcagaggagagagatgtgcaacttttttatttttattttatttttttgatactttttcacacttaggaactcataggaaccaaccatgtaaaaaataaactcaaacggacgaaatatgtggcatatggaattttccaaagctccaccgaaaaacttctctcctcgaaaacacaatcttgcaagcggaatttggaggttttaatatcgccgaacccagcaaagctggggagaatcggatgtaactttttctgtagatgtccatgcatatattatttgcctaattccgagtccgtatgagaaagttacgcctattttaatagatgacatattttgtccatttcggtagagttttggaaaattctacatgtcacatattttgtccgtttgagtttattttttatacggttggttcctatgttctcctaagtgtgaaaaaaatatcaaaaaaatgaaataaaaataaaaaaattgcatctctatgtactgtttaacttatatatgtcatttcatgtggttatattttgaattagattaagtaatttcatatagtggtagagtgcattatgtttaacatgctgatcaaagagttttactaaaggagttatggtctaattttagtgaaggtgcaaagtagactaagtggtatactagatattttcagacttagctaagtggtagttcgagtttaaattttttttatggttggttgtatcgtgatcctgagtgtgtaaaaacatcaaaaaaataaaataaaaatgacaccgttgcaactccacacagagaaacaggaatagaggcggcggcgccagccatgctggcgccctcctccctggggcg

SEQ ID NO: 40192 - DNA, 10860 bp, Oryza sativa
  unsure (1)..(10860): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtttgtgctggaaaagattagttcttgttgctaattgttgcagtcaaatttagctccaggtgattctcagttgtttaggtgttacctgtagtaggtctggttctaagcagctcaaagcagcaggggcagaaagtgtgtgatcaggtcatgcttcccatgcgcacaaggtgcttgttgcattgcctccccgggtgacttgcacttgcacgcatgtcacttcaatcctctccggtgtgaaatattttgtcatgtgatttcgacaaccaaaaagtcccttttgttgagacatatcgtctacaaaccaacggtcatccgattgttcttgttccggactacaaccatcaggcaggtcactggttttggtttggtgtttccctttcaagagggcccggtgtaaatctcttcctgattagttaattagcaacttaacatgtccctatcattggttagttaattatcaactctgtccttttcctgcccctcttccccctctttctgggagagtttttcttttgtaaggtttccacttcaggtgtatgttatggtctttgtatttgtgatacaatcgttgctgctgttttgggaagaaaagtcttccaaaaacagaacaaagaaatgataagaaaacgtgcttcctttgatttcatcagacaggagactgcaggaggctaaagcagcatttgacacaagcatagataatgggatgaccttatttgatacagcagaagtttatggtacagcggtaagaaactagaaaaacttcatgattcctcgctcatattttccttgcgtcaaaattctgaaggttcatttaaccttagttgttctgtccttcagctgatgggagcagtaaattctgaaagtttactcggagggtatgccacgttttgctgttcagcactccattttttttattattttttatttttgcgaaagtcacatgtgcagcaatagtcacctgttgttgtctctcttgccgccagtttcatcaaggaaaggcaggagaaagaacagattgatgttgccgtcgcaacaaagtttgctgcacttccatggagatttggccgaggaagtgttctttccgcactgaagaaatcgcttgaccgtcttgggttatcttcagttgagctctaccaacttcattggtcggcttgtctgctctttctctgatacatactttttctgtaaattttgagcattttgatctcagccgcttttgtttctctgttttcaggccagggctatggggaaatgaaggtacacagtccaatgaaaattacccatataaccatttttatgaattattagatagttccttctagcatgacaaaaacttcaacattctgacatcgttgagcattattcagggtatcttgatggacttgcagatgcctatgagcaaggccttgtaaaggctgttggagtctcaaactacaatggtctgtattctgtctgtggcctgcaaattaaatgttcttgtacattcctcgaattgtttcttcctcagtaaactttcattgaaataatagtttctatgatgacttcattcaagagaaacgccttcgggatgcatatgcgcggatgaagaaaagaggagttccacttgctgcaaaccaagtgaactacagcctaatatacaggactcctgagttgaatggtgtgaaggcagcttgtgatgagcttggcatcaccctgattgcttattccccaatagcccaaggtgagaaccatttctccttattttctgtcctaattgcttcatcgtatttagtgctatttacaatacaatcgcactcgttcttgtacatttttttagccgggacggccaaaggattaggccgctaaaatttgaattttaaaacttaattttggagttgattttacggtattttcagcgtagtttctttttcagcattggttttttgatcgctaataaaccatttggcatataattagctcttggccaaccgatggggcccttgttcttgtaatgactcatttccgttgttcaggtgttctgtcaggaaaatacactccagaaaaacctcctaccggtcctcgagcaaacacatatacccctgagttcctcaccaaggttatattagtacatattactgaacccttaagctagctagttacatacagcttcagcttggatgcgccatttagtctctgcaactgaacatttttcttatctaaaacctataaacatgtttcatgtgcacagcttcaaccactcatgaacaggatcaaggagattggagaaagctatgggaagaacccaacccaggtgcttcacctcatataatgctcagcaaatccatgcaagaaaaggaattaatatctccaagtaggatgagcagcaacttgcaaggaacagaagtgcagttccactgaaaacagctggtgttttcttttttttgtttcaggtttcactgaactggctgacatgccaaggcaatgtggtgccaatccccggagccaagaacgccggccaggcgcaggagttcgccggcgcgctcggctggagcctcaccggcgacgaggtcgaagagttgcggtctctggcacgcgagatcaagggcatcaagatgcccatcgaggagtcatagacatgtaaaaactgaagaagtttttcatgtatatgataggagatgtgtattgattgtaccatgcaatagtaaacattttacggcgataaaatgtgtagaaggtgtagaaaatgagtcagaaatttctgcctgcatgaatagaaaaggtttatatgactttgagccagccctgcccagtgatgattcaaatgcctgtacaatgtaactttgacgcaaacacgcgtgaaccattacacacttgtatttaaaaaaagaaatagatctcatacgtacgttttatattataagtcgctttaaatttttttctagtcaaacctttttagatttgaccatttcataaaaaaatagtaacatctataaaagtttcccataaaaaaaacatctatacaagttcagagactctttatataaattctataagtaacatacgcctgtagtgactttgtcaatctctagtatagatttgtcggctcagtcctcaaagatgcttataggggtatggtttgtgtgtgttcataggggtgggtgtgcgtgcgttgtgagtgtctgcgttgtactgtgtaatttaaaaaaaaaatgatgatatgaatactataagtttgattgaatcttatcataagcaccagatttaaacaataagattgcaaaatttaattatttaacatcgaaggaggccagaagttcttttttttttctatagaatgattttaccgccaaaaaaaaataaattctctctctctctctctctctttttgagttatttggaagcgatatacccagagcggccagcggcgcgtccacgtgtttacccgccaaacacacttgccagtctactctcgccggcgtcttcctctcctcgcctcgtctcgttcgtggccaaacgaagctcgcgcctcccggccactcgcagtcgaagcccagcaaccgccgccgcgccgaggccgagcaacagtgaggaggtagcttgcctgcaatgatggccgggaccctgcaggtcgccggtggctgcctggcgcccctcctccccagccgacgagcggcggcggcggtacgcccgccacgcgcgtccggggcgtcggcgtcggcggcggcggcggcggcggcggtggaggaggacggcaaggtgaggctgggtgggtcggacgtggcggtgaccaagctcggcatcggcgcctggtcctggggcgacaccacctactggaacgagttccagtgggacggtacgttcgcccaatgcgcatactcatcgatttgcttattaactcttgattatttttgtgttattccacctgcaaacctgcaatcgatcgggattgattgaccagttcttgatttaggatctcagtaggagagtctggagtccggactccacctaatatgttgattttgggggaattgttgggattgattccactcattgtgttgtagagtttcatgtagctgatgagctagctttcaggttcaaaggggtcatagttttaacctgtactaagggctaagtagtaattaaggctgtctaactgaggtttgtaaacttactaaccttgaactaacagtgtagtactatttgcaattgatttctgtcccaaggtaactgtaagtggtggtatcattaagacatgaacatcctggggcctagtctaagtaaacattgcattgcaattatgacactagactaaacgtcaaatatttatggtcagggggagtatgagttaaggggtcaggtctctaggtgaatctttgatcatgaacatgctcatggatttgttctctctgcttgtcctaatgttgttgcaactcgcaacgttcgaactaattacagattgtggaatttaagcaactcgcattggaatgttttgagtctgatttttgtatagtttggaaggcaccagccatctaaggatgtaggatctgaaagtgtgatatttaacaaagttgtctttcttttttgcattccttttttcctgctacttgttatttgtttgttgggctgaaatcagggtcatacatcccatgtgcttgatgtgcatgttgcattatctgcaagaaaccacgtgccacatgtaatatgctttgcgaaattttaacgaccaaacacatgaaatgtcataaatctctgcaattgttagtgaagtagacaatttgcttaatgtcaatgacaatccaatgacaaagataccagtgacagtcccttaatatgatgaagcactctgaaatttgccagataggaaattgaaggctgctaaaggagcatttgatgcgagtgtcgattgcggaataaccttctttgatactgcagaagtatatggtgcaggggtaagaaccaaccctgttcatagtttctgatcattctctggttcatttgaaggaaagatctaacactgcattttggttatggatgttctgaagatatcaggagccataaattcagaaagtttactaggaaggtatacaatgtacaactgtttgttgttccaaatatatgacgattttagcacaaaatttgttctaagttctcatttaccatcagattcatcaaggaaaggcaacagaaagaacaggtcgaagtagccattgcgacaaagtttgcagcccttccgtggaggcttggccgaggaagtgttatttctgcactgaaggactcgttatcccgccttggcgtctcctcagttgagctctaccaacttcattggttgtctcattgtcttttcactccaatattatgtgtttattattgttgctagtttatttaactggtgtcatcatctccttttcaggccagggatatggggaaatgaaggtattctttaatatacccatatttaaatactccctccactttttaatatatgctgttgatttttgcatatatgtctgaccagtgcaaatatgcaaaaataagttatgcttaaagtatgtttaatgataaaacaaatgacaacaaactaaatggtaattatatgaatttttgaataagatggtttgtcaaccatatgtttaaaattcaactgcatcatatattaaaatatggaggaaatacataatagaaatatttgaactgtactcaggaagcagtgggagcaattacattgttcttacatgattcaggttaccttgatggtcttggagatgcttatgagcaaggtcttgtaaaagctgttggagtctcaaactacagcggttgtaatctgacttcaagagttacatatgatgcagtttgttgtgctagttacctcttttcagtgaaactaatttcaagaacgctctttctataatttgatacagaaaagcgtctacgggatgcttacgagcgcctcaagaagaggggagttccacttgcttcaaaccaagtaaactacagtttgatatacaggaaccctgaagaaaatggggtaaaagcggcttgtgatgagcttggtattactttgatcgcatattccccgatcgctcaaggtagaattctgattctctgattctgttcttcacattaccattcaactatatcaagatcttttttttgcaagaaaaatgttcaatctagtagtttaaatgaaaatgtcctatcttagaactgaaatgtttacttcatcgatcatcattccatttctcaaatgagtgattatcgaaaataaaatcctagcttaatatgtctcctctgttcaggtgttctgacaggaaaatacactccaaataatcccccaactgggccccgtggacgaatatacactcctgagttcctgaccaaggttgtattttttactaatattattatgagcttgttgcatccttgttcacgaaccctctcctattgcactgctgcaactctgctcattgaagatgtttcttattccaaacagctccaaccacttattaacaggattaaagagattggaggaagttatgagaagaccccaactcaggtgttcttgctgctcaatatttccttttctgaagtctacccattgccaaaaacttagaatgcaaattattcagacataggagtaaattgtaagagggaaaaaatgataatttcatctttcaacaagctcaagggctacctggagatcaacaagatcccaaatgctgaagctaaaacaaccactaacactttgaattctcggaaatttgcagtgcaccaatttcgatgacatagtagtaagcaaagttgctccattctttttttctcctgcattttcttcaggtggttctgaactggctgatctgccaaggcaacgttgtgccgatccccggagcgaagaacgcagagcaggccagggagttcgctggtgcgctcgggtggagcctgacggatcaggaggtggaagaactgcgttccatggcacgagagatcaagccggtcatcggattcccagtagagaagttgtaatttctagtgagtttttcttctactttgggtctccgagaacatcatttacataaatacacaatgatctagacatacatagataggaaccatgtgtagtctttggaactgaaaattaagatgtcttagaaaataaccaaaatttacagtctgagtagcgtacatgcatgtatgctcatcgaccatattacaactaagattggtaactggattatcttcaagaaaccaatgttttattttctctggaaaaagagaaaacctgtttgcaatgtaatgaatatggccagtggcgaagccaggatttgagtatgggggggggggggcaacaaacaagtgattacacttcacacgaggtaaaatatatgttatttcactttacactgggtttagtacatatttttactttgcatcagggtatatcaaaataatttgtgttttacactagattgcatcatataactgcaggaaaatcttataaaccacgtgtgaaacttgtgatatttttttaccaagtttcacaaagttttatccatattttgtaaaacttgatgaaatttctataggtttgattatgtttatcctggtgccaagtgaaacttatttgaaagcagctcggtaaaaagtgaaattgggtgtgttttacccgatgcaaagtgtaatttactccaaaattaacaacaaagtgcaaggattaatatttcagcgatttgaaactaaaatgacgtgagaaagtttcctaatcagcatgtgcaagcgcgagctggaaatacaatatatcaaacgtatacacagtagtagctatagacggcgacgtaaatgatccctgactaattagagcaagattaatagtatagccaattgctagctccaaatcatctatagttaacttaatagttaattcatacaatatttataaacatatactatacaattaatatctggtcccatctgtcatacacacatgcatcttgtagtccgtgctgtagctggctataaatctgtaacccgctgcttttctctctcttttttttatcttctcgaactgtgtttataactggcttatagtatactattgtacctgctcttaagcttaaagctttgaggggatcgagcaattagcaagtgtctatatgggtcattactgcgttttcatgaagttaataaaattattttaattgcggcctcccacaattcttttttcaaacgtgtaggagacccgtgcatcattatattcattcattttgatccgcaggagtgttcaaacacgcataaacagcaccttgcaaaatactatactaacatagtacaacataacatagatttgatttatcataatactatgaattggacaaacagctattcagatttgtaatattaaaatatatcacatccgtattaggtttcagggacggatgagagagtgactgtcccagaagaatacatgaaagaaaaaaaaaggggagagaaatagagaagaaaaacagagaaaaaggaaacaagaaaaaggaaagggaagtaaaagagagaaaaggaaagaggagaaaaaactgaaagatacacaagcgtttattgtagtttattttacaacgctggttataaaatcgctaataacacatatataaaaattttactaaagtatttttttagttgttaataagttgtattccctccgatccaaaatataagcatttttagcatagtaacaagtcaaacatttttaactttgactattaatagcaaaaacattaaaaagaacatgtaaaattgatgttactaaatttatcattaaacaaaccatcgtaatatataactctttttatttaaaatattttacttttatagatattattggttaaagtaccatcattcagagatcgtgtcaggatcttaaaatatacttatattttaaaatggaatgagtacatataaacacataagccaaacaataggctacaacagagcaggcatgctcgaagtgccagctgtggtgaatgatgccattgccgtggaggaacaaagctccagctccggggaccgaccggagaggggtatcgacggcacggtcagaggatccttatccagtacttacatggtgctcgtttgtacccaagataatgttagagcacggaaaagaacaaaaccattaacacatgattaattaaattttaattattataaatttaaagaagtaagtttacctacttacttcgttccaatataaactgtaacttagtatatatcatatttacattagattgcacttatattagaactagaaaagtaatatttttaagcaatttatatatataaagtttttacgaaacacaccgttaagcagtttaaaaaaataccaataaaaattgaaataaaatatatatcttaatttttttagggtgcatatgcgtgcgagttgcgacggtgtacatgtgagcttggggtgtgtttagtttaaaaataagttaaagtttgaagaaagttaggagtttgaaaaaaaaaagttaaaaatttatgtgtgtagaaaagtttttattgtaatataatgtgatgaaaagttgagaacaccgggaaactgaacacggccttggtcactcgctccctccacagaaaaagtactacgcctacggcatggcctgatcatggtcaggtcagcggccaccgccggctttacgcagagcacacaggcagagctttgacctccccacgattccccaaaaccgaatattttttttcttcttcttacggttccggccggagtacgtgccactctacactacttgtactagagaagtatatacggtacacggtctaggacctccgagatctccgcaagatttttttgccacggataataagggtcccctgccaaaattttacatcctatcatattaaatgtttaaacacatacatagagtattaaatataaaaaaaataactaattatacagattgcgtgtaaattgcgagacaaatctttcctaattgctccatgatttgacaatgtggtgctacagtaaatatttgctaatgatagattaattagacctaataaattcgtctcgcagtttacatgtggaatctataatttgttttgttattagtctacgtttaatactttaaatatgttgacacgctacaactttacacccatagtccatagatttaaacacttcctaaggcaactgacaacgttaatagtattagctttgtttactcttattgcgtctcggtggcattcggtcccaacgtgccagcaaggatttatgctgtcacgttcatcacggtcgtagccgtatgaagctcctcggcacccaagacgggccagcctctagtcgaagccgcgttagggacgtcatgctcccgcgacgtgatgccccccctcccccaccaacctcttccctccgagctctagcggccagggtacaagcacggcgacgaacctaccattgtagctcatcgccactatgggtcggctcaagaagaatcgtcatcgtcattgaagagcctaccgccttggacaagctcaagctgaccagatccgcgtcggagaagaccgtcctcaccttgatccggtccaccaagagctcaccacccctatctaaccttgattcacgcagccgggaagctcaccgacaatgccgcctcgatctactcaagaggatgttagcgtgcgggaggagaggatgacaccagcgtgtgggggaagaggtcggttgtggaagagaatggcaccgacgtgtg

SEQ ID NO: 40193 - DNA, 2422 bp, Oryza sativa
ctgactttacgtcataggagcgcgctctatggccggtggcgcgagagaagaaggggtacaactactacgtactggtacgaattcttaaaggtctcaactctcaacgttagactttcttttttctttttacgtgtaattctcaaatgagtacaactactgctggtactataattctgttccacgacgtactccctcactctatccattaatataagcatatgtttggtaattctcagcacacgttactgtgtcaccataccgtttgaaaaccgttggccgctgataaaatttggtcaagttctgttataactgtaaagttcagtttgggtttttttttttaacttgaccggaaaactaggcgatttatgttctcaagcaagctcggaaagtccggttttcataaaaacaaaccgatgttcatcggttttgtaaactttgttccgaacattaaagtcgtttttaatctcaacattaatcttcactaaaacaccaacattgattatattgcggactaaaaagagtatcacagaaaattgtcacattcaatctaacctgcatagagaagtaggagtaattcttccgtcccaaaatataagcattttataaaattttttaatggtatctaacaagctagagagataaaactaaatagggacatttattcttttacctgagaaatggggatgttcgtttattggttgagaaaagtaggtactatgtactaagaactataagttttgaacgtagcgaggagtatattttgggacggagtacatgtttatttactgatatatttaagggagtaccccataaaactcccacctttaaactaacatgcataaacaagtaaagagtagttccgtccaaaaaatacagggactagtgaagttttttttttacaagaagtacgagagtggtaaaattaaaaggggatatttattcttttacctgataaatgacctatgtttaatattgttgagagaataataagaaagtaggtagagaaattgaggtaagaaaatatacggagaagttctatatttacaccatattagtagcggtgttatggtatactcacctacccgataagagggagaccaccatctatcttatggaccatcactgttaacctaaattctactgcagtgagaatctatttgctttatgtgtattttttagtgtttatcctactatcatcattaatcagagggtgacaatttagttttcatcagtttacctaatataattagaatccgctatgatgtataggtattttgttagttgtatgataaattttgaatgcaaccaggagtactccctccatcacattttaaatatagctgtaagtttctagattcaatatttaatcgttcatcttatttaaaacttttttatggttgtatttttattataaataatattttatacatgacttatatttttattttttttcgaaagaaaatcaaataaaacgaatggtgaaacgttgaatacgaaaacccatgttgacagcagcggatccacctcccgggcaagtcgggcagccgcgcgggctccgctattaccgtcaccactattgatagctattgacacccataaaaattaatcgatcaccgaaaaatactatgggcttaatgatgatgctggctccaccactgtacgttgaatacgaaacccacaactactcttgaaatgagacggagggaggtttttttttttttgggaacagtactcctttccaagctgccgactgccgttgccgattttgagggctgggccggatatggctgactgactgacaatgttacgtgacgtcccaaagcaggcaggccaaaaaaaaaaaaaaccgacggttcgtcaacccgtcctctcctcctccatacaaaaatgctacggacacgtctccctcattctttctccgctttaatttccccgacgaaatcgagcccaactacaactatccatccatttcttccactagacatctcaccttgcttcctcgccactctcacttcctctccacgagcaagaggagcaagaagaacgaggtcaggtcaggtcagctcagctcactgccatgatcactgtactccagttctttgcttcttcctcttctctcttttgattagcttttctgaattttcagtgaagtgtgacctgccggctgtcgaagaattgcggcgccatggatgcgggtgcaactgcaaggtcgtcgtcgtcgtcggcgatgatgatgaaccagaagaagcccttgctgtaatcaagatttttcgttttctttttcctttttctttttgatcttgtgttctgtgttgctatggttcttgatcgatgtaaagattggaggatttcgttctgtttgcttgcgtggcgtagctcggatggcgagctggtggagctcctgtggcaggacgggggcgtc

SEQ ID NO: 40194 - DNA, 11702 bp, Oryza sativa
ccaatgtcgacgggcacgcggcgggcgcgctcgcgctcgcgacgccgacgccgacgccgcgggcggcggcgaggagcgacgacgtgtcgagccgtctcgacgaggccgacctgagcatctgcggcagcaacgcggtcgtggcgccggcgctgcccgcggacgacgacgacgacatcgacgccgccgcgccgcgcgaggaggaggaggaggaggaggaggggccgggcgccgcgcgcgccgccggcgcgtcgtcgtcgggcgggtcggggagcgggagcgggagctacccgctgttcaagcgggggagggaggagctggttgacagccttagcgaggtcgccgacgagacccggccgtcgaagcggccggcggcgaagcgccggactcgcgccgccgaggtccacaacctgtcagagcgtgtaagacctcaagaacaccaaccaaccattgatggatagatggtgttgcatcatttgcaacaaggtgaatgttcttgattttttttgctgttcttgctgcagagaagaagggataggatcaatgagaagttgagagcattgcaagaactggtacctcattgcaacaaggtaaaataatttctgcgaaaagttgtgggaatttttgttatcctgtataatagtatagtgttcttggctattgccatggttgaattttgtggcaatttgatgattctagctgtttctcagactgacaaagcatccatactagatgaagcaattgagtacttgaagtccctgcaaatgcaagttcaggtttgaaatcaaactttccccatttctccacagtagcaatagaatttcaatccttctggatgaatcaaatcacggtgcctgattgtgagactgttgcttcatgttcagatcatgtggatgactaccgggattgtgccgatgatgttccccggtacccaccagctcatgccaccgatgggcatgggattgaacacggcatgcatgcctggggctcaagctcaaggcctgaatcagatgcaaagaacaacatattacatgaacaattctctgccaaaccagatgcctcagatcccttctccagctatgaatgcacccagtgttccagacgatatgcagaatgataatcgcatccgcgggccaagaaatccttttcttcattgcaatgatacactgacagcaacagctcaggttgattattatgttaaatttcatcattaccgatcattcagacttcaattcttgtttatcttacaatatcagttcttttcaggtgccaggtttgtttacctatggatctcaaattgcagaacaaaatgagattcaggagttactctctggcgctgtcattccatcctcatctgatgggaccataaaataagtaagatgttttgatggtcagtacacagttcttgatatttccaaacttaaatgcagcatggacatgtacatgaaacctccctatagatgcacttgcacaacaatatgaggtatataaatcagagaatacatggtatatcatttttttgcgcttaaccgcactaatttgtgtactgaaactagttgattgtcgtcatttgatctaattccatcttctgatagatcagttttggacacttcagttctgctttgggcattgtctagtcctatcctatcaatagatgaactctggctgtggttgtgcgtccatttcgttctttcgctgttgcattcaatagactattttgtcacattagaaaaaacagtgggctagttcacaaacaattgggttgagcatcgctttcatgatatggacatgataagcagtgtatagggacttgcatgagggatcagcaactagcgaaaaacgctactagtagcactgcatgttgagcaagttgttgcctccttgatgctatccttaatatctcgacaaccaatgctttcttaacacgattgctgaaagataggttcattagctgataaaggttatgatgatctataaagaaacaagtttagattgaccatctaaaacataactgaagatgtcagggaaaattagacatgtgcaatgccatctagcattataagaatactttctttcagcatataaaattcacagtcattcccaagcaatataatactagtgatgaaacaatgttttcctcactttttttttctcatcatcattgacttgtttgttgtgcagtgaccaacatgcaaacaactaggggagataaacaaaggaaggcagaacaactggtcctagaagaatgatttgattccaagatgcagtttgtgtcctgtgagtcgtgtaaggctgaagctttgggacaccactcggcagtcgacacgtgtacaccgcctcctgatgctattcttatctgaagagtatagtgatcaacatcacctttctgtttctggaagggtttttgtctatgggagatgaactggaggatccctttgcatagataatcaagacaacaggaagatgcttcatatgatgctacatgtatggaaatggcaggcaccggcaatatgtgaagaatatagtggctgtgtggactcagcttgagccggcatcgcaaaagctgcacaagaacacaacagtgacagtttcactcttcttttagctgatgttactgttatatgatgcctgagggacatgcatctggtgagttcttacaagaacaaatcaaggaaccaaatgacagttttggttgctatgttgatttttcaactggataagcataaccatcggttcttcaagattgcacatggtctaaagcagaaaaagaacttaggtagactgaaccatgtacaattcagatatatggcacatcaagatcattggaaatgcgcagatatcggcagaaattttgctcctgaacaaaacagctaccacatctgtatctcctcttgccttggtactcattgcctcatcaatgtaactttcacctttctcatgatcttgactgtactacttgcaactagtcgaattccctgcacaattgtgcagtagacagtatagcaaatatgaaattgcatttcttgtacatctataatcacattattcgatcaatctccatcattataatttggacttaatttgcacatttcgcaacatatacataatttgcaagagaggtttttgcaatgtctggtagtgaaaatgccaaaatgggggactatgttcttcctgtgttaatgatagttagctggtacaccgttgctttgtcgttagttaatcatgacagggatgtgcttcattaatcactacttataaagtaattagtgagtccatttcagtcgctatcaatcaagatctgagcttttggtccgcatttatacgttgagatttggttctcgccctaaagttggatgtagagtatcttgttgggagaaaatggcacatcgagattgacataaacatatcatccttttttgtcaaaagatgatgtttatacgacaagccttcagtatggaagcattgcaatgttcaacagtagtacaaactaacaaacacaaaaacagccaacgcactacgtggatctcttcctatcactattcttccctcaatttgttaatctctctgcacccaaaatcgtgtattatcactctgatcagccaacaattcaggcagattaattttctctttaaaaaaaattaggcagattaacagactgttccatgaacagcagtttgcagggatagttttaatgctcttttaaattatttttttctactgcaaacacaaatggggtggtggcgcagttggctagcgcgtaggtctcatagctaatgttgtgagtgatcctgaggtcgagagttcgagcctctctcaccccaaatttttttccttttttcactgcaaacatgaaaccttagctaaacccacatgagttcatggaaaattaaatatgaattattatttttttgtaatgctgcttttatatttgttcagagcaaacatgaaacctgaacccacatgtgttcaatgaaaattaaatactccctttgcttttaataaatgatattgttgactattagaaatatgatgaatggaatgacaaaaaccgagtgattgcgtgtatcagctgttcttcctgttcatatgatcatatcgccggcgccaggggcaatggttcaactgctgcattcctgttcaatatcatcagggaggcaagggcacagcacagtgttgccttttttttttttttttttttttttttttttgctctctgcgctgtgcagcctacttcttccagcaatttctgcacagatttctgtttggagaaggtggagttcccttttcagcttcactgtttagtgatctgtaatcttttcagtcgggtaaataaagacattgatcattcgataggaacagaaaatggagtgtttgcttggtaatgtagatgtggacctaaattaattggttttaggcaaaatttgctacaggacaccgaaagattgcggtctttgctgtgagacacctgaagatcgtgtatttgctggtggacactgcaaaaaagtggtaattagctgctggatactcctcccattattttattatttccggtaaaaatggagagagagagttgtgtaagtactaaaatgcccttggacactgttcttcctctctctctccttttcttttcccaattcttcctcgcgacggcggccggcccgagccaggatggctcggccacggtggggcggcggcggcggcgcatcaccggggttcaccaccgacggcgatgacgcacggcggcggcccggcgcacggatgaggtcggcaaagcttggttgtcgacgatggctcgcggaatgtctcggcggcggcgcttcaccttggatgaacggcgatggctcaatttcttcaaaggattaccatgcatgcatgtctttcgtgttagagaggtccatgtgaggctaccatggcaaggaatcggattgggactcaccggagagggagaaatcgaagatggacctcggcgaccggagttggagaaagatgatgccgatctctaagatcgctgcgcgactggatagggtacttgggggtaaatggagaggaggtcgaggtgaagctgatggcgtggtggctcggcctacaacggtccactgcacccggaacggtgacgacgtcgaggcggcgacgcgcagagcgcgctccaaggccggcgatgacacgatggcgttcccgtcgatccgctgcacaagagaggatggaatcaaaatgaaaaatcttcggcatgttaaggtaagtatggaacggtggtgaggcagagatggagatagctctacggtgacagtgggcattgtcttcttcatggccggcgagggatttgaggacaacgaagagattgagggcttcctctctcagtttggtcgacactagagccggggtttaccgccgacggcgacgacgcatgacggctcggccatggtggagctcggcggcggcgcaatgagaaagagacgaacagagaaagagaggaagaagaagaatagagaaagagagattgacaagtgggcccatgggcaaacttgtctttaaccaaagtttctctctccattttgatctgaaataataaaataatgggaggagtgtccagcagctaattaccacttttttgcagtgtccaccagcaaatacacgatcttcgggtgtctcacagcaaaggccgtaatctttcggtatcctgtagcaaattttgccttggttttaagccatgccattatgcagatgtaatgtagatgtgcagcctacatcttcgcagcaatttatgcacagattcctgtttggagaaggtggagatcctttttcagcttcactattgagggatctgtaatctttttagtcaggttaaacaacactcaatcaatagaaacaggaaatggagtctttgcttgataatgtagatgtggacataaattaagttattttaagccatggcattcttgtatcacgaaaacagcatagtaagttcttttgtctgttaacatcagttatctttttggtagtactgacatatgctgccagcatcagcattacttttgtctgttaacatcagtaaacagttattatttgattgataatgtatggtgctaactgtatatacaactagtaagttcttccttgacacatgaaaggacatccaattagcattttcttcagataccgatcaagttattcaggaaagatcattcttagcacaatctatcaacaaatctacaagttattctgttgtcaggactgagcatcacaagatgcattgtttgagatcatggaaaaccttgtcgaagttctgatgctgtcacaagtgttcaaatgatatgccatcggtatatacttccgtttgttgaagccaccatagaagcttggttgcatgtgaattagcaggagttgttgttggatcatcctgggagccttttgggtgaagaattcttgggccagcatgagatggtacagggttaacaagtaagagctacaccatttagtaactgtgtaactggaactggactgagctgttgacatgctgtgatgacacacaactgggagaaaggggaacgaagaaatgagcgctgttcttgacctgcatatggacagagagatattcaggcacctggcagcctctcccagcagcagctagatgttcagattaattggttgacatgctaatacacattaatgagggatgtggaaggactacaataatcttctactgttccaaaaggttgtcttgccttttttcttgtagtgctactatgcagttggaccttcttgttgtttttccattgtttgctggttgcaagcgattctcacatgtgctgcttcatgcaacatttctgtgattatataatgtaaagttgtgttttttgcaacttcatatatatctcagcagatactgcacctagattttcagggctcaggatcattccaatggtgacttagtttcagacttactagtatggtttcttacatggagcttgtaacctgaattcggaacatcttcgttcttcaggttatcgaatattcagatgttaacatggagatcttccagtccatacagaagcatcttcaggttagcatggagtttgtgatgaaatctgtcaaaccaggagggcctttggctcttgttatcagaaattcagaatggacagtgacaaagagcatcttgaatttgctgaaatgcttctgtcaggtaagctttctccctttctgaacatttgactaataacacgcaacagattggatggttaataatttgaagttttaaactcaagttcatggattcagtatcatctgaaaatgataacatgctgatgttgttggattattttgaagacttcagcagtaatttcttcgaaaaagtaaaaaattatagcatgcaccatgcatcattttaggccaaggcccaaggaatttgacacccagctttatatagaatgcaaaatggaatagagtgtgaactccagcttacaatcactcaccatgtcaccagctcttactcctttctgtttaaggactatgaagtctaaaactctgaagacaacaactgttacagaaaaaaggctaaatgaataagtcgaagacctcaattaaattgagaccaaattaagtttcacctttgacatacactaatcctaccaccctcagtgagtttcttaattagtatcctaaattaaggagcatgcattattcaacctccattattcatgcatcgaagaatatatgcacatttttcttcttcttcctcctgaatttcttgcaggtccaagtacagataccgcgtttctacggatcgaagcaagcattgaaattacagacaaatatacaaaccgtcggatttaattaatgggtagttatcgaatatcaagattcaatcacaatgtgtcacatccagggttcactctattgggacagccctttgtatcgggggtcaccgaaatcctaaaatttcggaaatttcggctcgaaatttccgaaattttaagcaaaatttagttgaatttgaacaaatattacccaaattcataaaaaattgaaaaattgaaaaattacaaccgaaataatatcgtatcggagatgaacgaaatgaccgaaagttcagaaatttcggtccgaaatttccaaccctggtcacatcaatctataaaatgcatcctttttcctttaaattgtacaatattatagagtatgtgtgccgaataattgggcggctagtaggaaggaagaagtacatctattttttcagaaagccccctcaataagttcaaattgtacaaccacaccccatctcctctctctccggcgacattgcggcgcctccggccggccgggttctccggcagccaccgccttcatcggcgggatggaacttccgacgttcggcatgctcggacgcgtccctgtgttctcttctgcgcaggcggcggcctatcgatctctgtctgccatggacggattgaggcggcggccggcggcggtgtgcagctctcgccggagtgcggcgcggcgccggccgtcaacctgactcaacggcggcatgcatgcatgcaggcaagatattcgaactgattggcacattattttgctctaactgcagcaagttcagaactgagcaaaggtttcagtattgaaaattattttcgggaatacgcaaggagcgtattttttccattaaaagaaataaaagttatttacaaggcagtattgaaaattatactactataattaatctatcatattagttcacatgcatgatcttgatttcatcacaagataaacaatgtaggagtacgtatatatacatcagaaacgcagcgagtaaatgcaaatgcatgcaatgcacacagtaatatataattaatctacaaaggctagctatctgacttcagagaaattccaaaaattagactagctcgggcatgcaatgatgtaaatgctgtatatatatatgcactgtcatgttcatatccactgattgtttttttttaactcaaaattcgtgcatgcactagctagatccatgtgaatgattacttaacaagaaaagaaaacaagcattctaaggatatataaaacatgcaatgcaacaagaaagaagagagagatgtagagagagaaagagagaagggaagagggccatgcttggcacctcgcacgccgtacgcagcggccaacaacgagatcgagttcattgggttggcagccatgcgagcggcatacagggagccaggcatatcccctaccttttcatcaccttcacaatcacccaaagtaccaaacacacacacacatatatctcccctccaatgccgccatattgccacaccaaactaactacatctaaattaacaccatgaacactacctatatctatatgtctctcttaaaactatgtcactctttcttttctccctttcaaagtggatatgcatggctagctagaagagaagatggatggatggatggatggatatggatatggatacatggaggatagagcatggtgtgtttgttgtgctaatgctgtgaaatggtgcatgtttgcatgatgagaagggaggcctatccctacttatatagtgcagccactagcccacacctcctctcctcttcatagaatcatactagtcagtgtggctacacatccctataactaaatatatactccaagcaataaaccatgagtaattaattaacctaattatgtaagcccacatccaatgtacacttgtgtcaatgcactaattaatctgcatgcatgcatgcatgatgagctttcaagtttcacctaaaccctagctaagctatagggcgtctccatgcacatgcatggtggtgtgtaagtagcacagacaaacacatgcacacacacatcattgcaagatggaataaagtggagaggggcactatgcacccacagaaagagccacagctggcactgtacatgtcaaaagagtctcttctctctcgcttctcttatgtattgtatactccactttgtatatatatatatatatatatatatatatatatatatatatatatatatatatatatatatatatatatacatgtacatacattatacacagtatgtgtcctacacagcatacatcccatcaaattgacatgcaagttaaacctaacatagtgcaatgcattggccattggaacatatttgagggatccttttgaacggggtactaaaaacacaagaacatgaaaaattgcaggaatcagataccatgttctacacgatcctatagggttacacacgaagatttaattggtgcgttacgtttggatggttcacagaaataaatattggaatttttttcgaaaaagaaaatattggaattttaaagtgaactgtttgctagagaaaaactagagggagaaaggaagagagtgcattggacttctcaaatgaaaataaaacatgaggtatgagctctcgttatattttcctatagaaagggggcatacgaaggcaaccaataagaattttggcatatccctattctttgatccaacgtacggtcctcataggaaaattttttctaaggattcaatcctccacaaatcctttgaaaatccttcaatgcaaaggagccctgaactttttgtgtacatgtttgcatagttgcattgcatcatgcatggtactctctctctctctctctctctctctctcaatctctctgtgtgtgcctgttttgcaaagagctggctttctggactgggctttgtctctgggtgtttggaagcaagtaggattcccctgtgcaggacagatgtggaccagacctgtgtgagtcaagaatcaagatagctagccattgttttgatttgtttcaacctctttctccatggccatgcatgtgctactgctagctagctagcttcttgcacatatgctctcctcttctttttcacaatcaattattactgctgctaccctatttactctttattcgttgcttgacatggcagagggtcaagctctagcttgagaagaatcttgtcgctttatgtcttggacttggaacatttcaacccatgcattaaccggctcgtgtcgatctatcgtcactcgaaatattctcagccagtgtagtaaccgctgtagtattgtctcgagcttcctgttcctgtggccgagaagagaatgcataaaattaatgataacaatttattttagcaattctggaatgcacattcatcaaagttagttttgctatgcacaaataaattagttttgctatgagaagaacgtctgcatatttattcataaaaataagtaatttgctatgcagaagtttgtatgatttcttctgaattaaatgtcaattattcgatggaactcattgcctttcctcacatagtcatcttcgttgacgactttcgatggtggttgcagtgtatcttaatttgccaagttgttcggattatgtcaccggggtgggtgggtgtattaaggatagggatgggaagaggaaggatccatggtttagacggaggctggggaggggtgaaggtaggttgacgtatgtggtaggacaagggaagattggttaggagggaggtagattttcaaggcagtgaaaataagtggaggggtgatctgaagggcaatggagattggtagaaaggggtagagtggtagacttgaaggcggtgacaagaaatgaagggtgaggggcaatggatattggtag

SEQ ID NO: 40195 - DNA, 7323 bp, Oryza sativa
aacatgctaaaacctgtagttttgtgataatggagacaaaatctatagttttatgataaatgaaggcactaaatgtgtagttttgtgataaacgaatacactaaatctatagttttgtgaaacaaattcttaaatatatagttttgtgatagattgtacaaagtaactatagttttataataaacgcggagacactaaatctgtagttttgtgataaattatgcaaaatacatgtagttttgtgaaatttacactaaaatataaaaaaatattcatgctatctttatgcactattttttttaccggaccatacgagagataaggatatcgagggggtggcgtggttcataaagtcggtttttttggaaaggtcagtttttgtgccaaattgttttttgtttactgaagttaatttggcttttgaacggttgatgtttttttgtgtgggtaggggtgggtatggacggaactccattttcaatgttgtagagatatggaacatttttttaattagcatacttgtactacttcctctagctagaaatatttggcgtttaggataactttcaaattaatgttcagtttaaaacaagaaaaacgacatgcatgtattgatgtgccttcaaaagtagtaccgatcataatatcataaactcattagattctaacatacaattaattgatagtcaaagtgttgaagtttggctaaatcttgtcctaaacattaaacattttatgacataaggaagcacttaatttatgcttggtaatcttctaattaattacctatatgatgttggatatatagatatattcatgagatatgtggtgcgtgggccagtttatacatgcatcattccagacttcccagtagatgtcttcgctagaagttgagagctagagtacatgcacgaggccacacttttgttcgatcgatcaatgcagtcacgcagatgcagtgtagtggagagatcacgtactcgagtagcatgcatgcgcacacggtggtggtggtcgccggccggccggccgggagattcgccggcgctcgtgcagaaggcaagtggccggcaggcattgcatctgatcatatgcatgcatgatctcgatcgatgctgcaagaatcatatcatacatatcgatcgatagatatgaaatcagcatgaatatgatgcaatgcagaatgcagatgagagcgagtggtagcttagcttagctgcttgtgtttgtccggctcccgtcgccgttttcctccctgtcggtttctgcatgcatgccaactgcaatcgtacaccgatactgtgtaccagtttttactctgctctcgctgcagctgcaaccgcatcgtttctgaatcatcttcagacatcacggcgacacgctgcccagcccagctaccccctccctctccctgcctgtctgcaacaacacataatgatccatcaaccttgctaacatatagaaatatacatttggttaataatatactctcttaacacccagtttttcaatcgagaatgcaggactatatatcatcaatatataatatacctccagattaattggtcatgcaaagcattgttggtgtatggggaccagcaaaatatattggagaggaagtacagcatatatatgttgaaaagcagggaccagatcaataaatggctggccaagtggccatggatgttttttctcttggacattactgacctgagaccacccctggtcaccatcatgttggtctgctggactaccctgcagctggccagcacgccccacatgtcgcacgaaaccattcagcagagctccattagttaacccttgcagattaattaacttgattcagagattaacaaagaaaaaattgctacaaaaaagcatcgccacagtgagtccacagctagctagattggaagagagcatatggcaaagggctgatgagaagaatattgacacacacatagcgtcatgcatgtcagaattgtatatttcagaattcagcattgctattgctattgctattgttggttagctgttttttcctttcggtacaatatgacaatataagtagttaggagaatcaagctagagttgagcacaaaattccaaccccaacagcatgcatgggagctagtaaacaaactttagatacagtcttcctttgctcatgccctacatgacaagaaagaaatacaaggtttaggcaaccgttctagcaatgtgtcattttcatgtaatcacctatattggatgaatgtagcatgatgcctgcattttgtgctgctttgtcatttgatcaatgaggagtgactaccccaagttatgaaatggccaaggtgctaagatgtctttagcaacgggacaaaagcgtttcaatgaaaacaaaaagatccaagaatctcaaaagttcggtaaagaacaaatacatctttgagtagaaaaatcagaactaaccagacattgtttgtaggaccaccacatggcacagtgctccattagccttctatggtagttaatttggtgaacatatctgaaaccacattcactttcagtaactgatcaagtaagtcgagtaggtattcgggcagcaaatatctttggtattcgggcagcaaatatctttttcacctggattataccgacaataccagatagtcaacagtagttaccattttttctggcttccaaatatccaaaaaatcaagttattactgtccaatggtgcaggaatacatgctttgacgttacatgtcctcatgtacagccttcagcctctttgcagtgtgccttccagaatttaatacgagctttggcatcacagaatcacacttacacagttatccaatcaaaaacattagggtacatatatacatatgcatagagtacaatattagtgcaattttatttcataatgccagattgtagcaaaatatttgaattaataacattgttatatttacaaaaataattagatactacatctatgatttgctaggttacaggctaaccattttcctcagctggaaattggaataatttccccataataagttggaaacactaactaataccgaagatatcttcatcttagagtaagcgtgccatgggtttctaacttacacaatccatccttagttactttatggaggccaatgctgatctttgaaggcttttatacactccatagtggattggatgctgcttgacacgcccttccccaacttgggcaggttaacgcctcctgaaatctgagggttttcatgaaagtttaggagcctttgtcgagattctttcctcacagccgctacctggctcgcataactgatggcatcccagaccaagcctctgatgatggtaaaggtgtaaaacctagctgattcgaaagggatattgcttgcgaaacctacaaacaggaggaaattctgttatccaaaagtggagaatgtagttggtaccttgcaataatagacataactaaggttggctaactggcaggaggagaaataaaactatgtaagtttatagtagaggagtgttattgctgaactgctatgtctgcattgcatttgatggcactgcagtagcgcgtttgatggtaaaatcacttatgatctaacatctgaacaggactacatgcatatggttagattgctaaatcatgtcgcagcaatcacatgggttgccaggttgcaggggatcccttataacaacagggaaagagcatcattgaaatagagatccaacacaacggtgcagtgtgcacacgtgcatgctactggacatactgatctttttttcacacaaacgggtagttgctttcattttcatttctattcccacatgaacattaattgatttactattactgaacaagttaaaactccattaatttccgagatccaccaactgcagtgcagtgaaacagcgtatattctgcaggaacacaatgaagtaatatcactggataaaaagaacactagccagtgatatttatctcacctatatacagttatagataacaaatcacttccactaccaactcaactactacatggattcgaggagacaaatatcaccctctggtatttagtctcaattatcaataacaaataatttccaatactaactcaacatatcaataacaaaccacttccaatactaactcaattgctatggattagaggagacaattaatcaaacatggcatggcaaacgacgcaatcgaaaactgaaactgcagaagaagagaaaggcatcaccatcaccatcacatatgagcaaagagcaagagagtggcaatataccgctgtggtactggttcctgatgaggccgtgctgcggcaagccgacgccgacgccggcgagcgtgacgccgacgctgaacccgacgccgcagccggcgccgacgtagccgatgacctcgggcccgaacccaggcccccacccaaccccgcacccgagccccagcccgatcccccagaacgtacccaccgtcgggtgcacggggttccacctctcgtacctccccagcatccccttgattatcatcctcggcttcacctgcaccggcgccgccacctccacaacccccaaaccaaacaacaacaaaaaaaaagtcaatctccgacgagaattgctggaaatggcgcgggaggggagagagcatttcaagtggtgggaatacctgcgagttgcgtggggcattcggtgtcgtggacgcggcgggatcggtgggcggcggcggcggcggtggcggcgggtggtggatttggggggaatcgggcatgtgtgtgggttggtctcggggattggatgggttggaggaggaggaggccacttggcgggttgaacagtggtgggcggccatgtcgtcgccgtggccaccttatccttctctcaatctctctctcacacacacgctcgaatccccatccactccggccgtcgccgtcgtgcgcttttccggctgcgctttttggagaggacggaggcccagggggtcggagcttcgctgacttggcatttgggcccagtttacttttctagcggaagaatttgagcgccatttcacagctgctgcaaatgctggtagaaagtacgactaggatcatgtgaaattccagtggctgaattttcagcggcacttctacatttttttaaccagtttttttccctttttttttttttactatagttggtacgtattacctccgtttttttaatatatgacgttgttaactttttcacaaacgtttaactattaatcgtattcaaaatttttgtgcaaatattacataatactttttaataagacgaatagttaaatgcattttaaaagttaacgatgttatatattaaaaaaataaaaaaacggagggagtatgaaaaaaaaatgtggattgtcttactatttgctaacttcatctgccgcaagttcaaaaaaaaaaaaaatctgccgcagtttagaagcatacagagaaacaacatgtacgtggttgaagctgaaacatataccattcccaatcacaataagatgtttggatgccaaagtaccaccaaacgagatgataggggtcaaagtgcaattcaacagggagtacatggacataaataatgaaaggttcctcattttcagaattttcttacactttgttcagagagtgcataaccaaaaggtacaggctagagtatatacattacatgttttggaacaaacctaatacacaagcaaggctacttatttggctacaacaacagactacttaggccaagcgccagaaaaagcgattggtgatctcattcatgacatagaaaagaagattgaaggtcaaaaaccacaaaactatacaaaccggagtcctgtgatcagttggaatcatcgaacccgcctgatctgccgaaatctgatgttccaaaaccattagggcgtctgctgtaccgtgtcgaacctgaatcatcaaaactcctagagcgtctgttgccatttctactgaaattgccttctccaaagtcaccaaatccgaatccatcaggctgcttggaactagacctgccaaaggcattggagggtcgtctaaaatctccaaacccactgccatatcttgaaccagcatcgcgtgatctcccaccacgattaggggaactgccaaagccatcaaaatcaccaaagccccgggaacggccttctccaaaaccaccatagcctcctcgtccgaaagaggagccaccggttcttgggcttccagctaatctagagcgattgtctctcacaacattaaacatgtctgaggcctcatctgcaacttcaatctttggaagctacacacggtaaagcaaaaataagcaaacatatttttatctcagctgcaaaaatgatatcattaggattcaacatgcacagttttggaactgtttttacctctgtgaatttgcatcctatatcttgctcaatgatccttacagctctagcttgatcatttgtgtatattaaaattgcacttcctttcttccctgctcgtgcagttcgtccagatctgtgaacaaataactccgaggtgtttgggagttcgtaatgtataacctgaacaagcatgcggaagattattttttaagttaaccgatatgaacgtcaaacagctagattaatcatacttttccaaaaatttccattaaagaaacacatcaggctacttacaagatcaacattgggtatgtctaatccacgagcagcaacatcggttgctactaggatattaaagcggccatctcgaaatcctgatagtgtcctttctctctgattctgtgaaatatccccatgaagcgcctgacatgcatagctcctgcccatagcatatgctaatctatctgcctctcgtttagtttgagtaaacacaatacattttccaccattagcatgctcctgtggaagtgtagagaaaagagtcgttaacggtgcaaactataaaacacatcatacattcagaagagtgctcactttgatcaatggaccaagaattgatggcttcccatagtgctcagaggcaattgaataaagagagattccttcaggtaatttctggtcctcatcaccaaccttaggaaacaatgtaaaatgtcagaattatcttaacaatcctgttgctcttctcagaaaaactgtgataaagtccaagtactatttccagagttaatcaaacaattcaacaaatgtttctaacctacagatgtgcccaccccatcatttcttatatcaatatgaactccacattatgttatgctactccttatccaggagtaatatcccttcaatttaccatggcacat

SEQ ID NO: 40196 - DNA, 10623 bp, Oryza sativa
ctggtgttccaaccacaacatcaacaccataattaagagctctcatttgatgactgatgggaacacctccatagacacaaagagagtccaaaggagcagattccttaaattccttctcaacttgtctagcaagttctctagtaggtgcgagaattatggctaaaggatttctaccactcctgcatgcaccaaactataccattatcacaataaattctatctgtccgataattacataaaacaaattccaggtgagaaagtgaaaccaacccattcttctcattgtgacgaagaatcctgtccatgataggaataccaaaagccaacgttttcccagttccagttcttgcacgtccaatcatatctttgccttgcattgctggatcaaggacagccctctggacagagaaagataaaacacatcactacataaaaaagcaaaaaaaagaaaaataaagtagagtgacaagagcaccaagcaaatcatattgcaaattagataaattgtagggaaaaacacattctagattgagatgacataaatgatagatctactctataaccgctgcattgccaagaatacaaatgatctgcccagattctggtggaactcaaggaccacaataacttgtaattcttttttccccttttaatattttggatctacatctctagatgaaagaacttgacctggtcagaaattcagaatcactagacctcgtttatattgcagactaaataagcacgagtatacaccaccccaaataaggtacaatacagtccatcaaattttctgttgatggtttgaagcaaagtcctattgatttatcgaatttgctgccaaaataaattagacattctttctcttgtccaaacttgcaaacagttgaacagtacgatgcaaaatacattaccagcagctcagcatcgtgtaagtacaactatacagctcctatgtgcaaaactaagaatggcaaattcctagttttcatgacaaaactgtgccactattcaactaaatctaacgattcagcagcacacgactgataactctacagttctagcacttccaaagctaacgacaccagcatctcatctaggggaaagaatttcatcagccactctactcgttcatgttgaaaacgggcctaatcaatcaaacctcagtttctactgaggaaggcggcgttatggagtctaccatgatagatccacagcaagcctgtcctctgttcatgagagatattggtggggactccatgtgttggtttttaaattcatgatcctatttaatttttgtatggaatttatatggagaaaataccatatgcttctattatggcttacaatttgggtgacaaggcgttttggtccatcagtcatctgttcttatatggcaatgttatcttggcttcatttgaaacaattaactgtgagaacgttatttaacacttagaagcgggataagtcgatcaaaatgcagcatatttgcatctaggactcttcatggatcattaacttttcaatttttaaacagttaatgtcctgtactgtgcaatgatttagtttacagcaaacagctggttgcacagcatcaatgtgaagtatccacactgtttggtactcatattgtttacttgtattaaacctttgtctcgatgcttaacttgtgttttttttttacaccacagcaaaatgtagcaaatgttctactagcttctaagtgcagttaacagaagtccaatgtgcactttggccttttggactactattcaactgtggaaaatctttctaacttgaaaatttctaggacagatttaggattttggaaccaagaaaacttattgagctgaaaaacaggttcaatctttagtgggcatctagtaccgaataagcacaagcacaggaagtgtactaaaacaagggcaccagaagaatgtccatcaaattttgagttgacggttcaaagaacatcctattgaattttttgcagggaagatttgaattcgaatttgtgccaaaatcaaactacacaatagtcattctttctcttgcccaaacttgtatacaattcaacagtgggacacggaatagagagccagcagctaagtgaatagggtatgtactactatacaacctaatgtagcaaactaagatggccctttcctcactccatcacacaactatgctgataattcaactaaactaaaagaaatcagtagcacacgacaatgaaatgtaaatatgacagaactgtagaaaaagcacaatctggaatgagatgaacatataaataggcttgttccataactgctgcattgctgagacaccaaatgtgaccagattccagtggaacacagtgtccaaatatgcaaataacttatgattcccttcttttttcttctaatattttgaatttaaaattttacatctgaagattaaagaacttggctcaggaagaacctcattctgtgattcattgtgtataacaataagcacaagtgtactctaaaaaaaaggcaccagagaatgccaatcaaatttcagttgatggttcaaagcaacatcctattcatttgaattcgaatttgctgccaaaatcaaattatacaatagacattctcttgttgaacattgcaaacaattcaacagtggtacacaaaatacagtactagcttctcagtgtataggatatctacaactatacagctgtgatgtagcacaactaagaatggcccattcatcatttccatcaggaaactatgctgctaattcaactaaactaaaagaaaatcagtagcacacgcacagttctagcgattccaaacctaaaaatgccagcatctcatctggagccaagcatttcatccgtgaatctactccttcatgccaaaaccggaccaaatcaagcaagccataataagtttccaattagcgagcagcaagccggctacctggatggggaagagcctggtgatgccccgtgcggcgagcctctccacgatccacggcgagatccccagcctcgcgacctccagcccgtcgtccccaccgacggccgcccccgcctccgggctggaccacgacgccggtgtggacctgaaccccagggggctcggcgagccatggaacgcccgccgcctcggtggctccggcgcagcagggccccggcatgggtcgagagggctagccgacggggagagcagcgcggcgagaagagatctcccccgcggcgccgccggcgaggaggaggcggcgcagagcgcacggctgagtagcgagaacatggctttttttttttttagggaaattcttatcttgggcttgggatgtgagaagtgaagcgggttagcgggtatagggatggcaaaggggccatccccgctgggtgtgttccgacagggccgcacacccgatgagcccatatgcccattggcattagcgagaacaatatgatagttcggcaagccgactgcgagggctgcagctgcggctacgcacagtgagtatggtactgtttgtaccggctacggcacaaccacaacctagcagccgaacaagtccaattgtgtttttttttgttttttttgaaaatttttgtgttgggctttaggatgtgagaagtgaagcggatacggatgataaattgtttgtgttgtttggatctgtttctattcgccgtcgagtaatttcttattgtatcaagttatgaaccgagttcctttttttagaaaaaaaaagaaccgagttcatataaaatattctattctcttaaaaattcagttttttttacgaaacaattacttcaacgttcgtgctgatacaatgttgttactaaaacttatgctagtcgattttttttctctaaacttttatgatcatttaagtgtagtcgttaaaagaatgatcatttgtgtaattaataagtaaaaaaattaaaaattttgggcactcaccctctcggtctcacaacaactatgagtttttccttttatctgtgataaatcttttacgactgaaactattaatggaactcgggttattaattaaaacgtgtgactagtcaattaacacagcttacgagtgattctattcatagccacaattactgttcacggacataaatgtactactgacattgcaaacttggacaatcaacaacaaaattggcaggtgttatattggagctagaatgagctgcaaattgcttcagcccgagattaaacagacaactaaacccagactagcatacatccaacgcccgcagctaatctttgaatccagattatacatccacatcaaacagagcatgcatgcacgcactcaggcataaattaaaccactgttcttctaatcaagtcttagagaaagaaataagcctcacatcctctcatatagatcacttggagcgtccaaagtatgggatcttcccaaccagaaaagcccagacgttctccagaatgaggttggtaaaggtgtctataaccattttcacgtcttctgcatcaattgattgaagcaccatacccaactcttgcgcgaacttgtcaatcacgaagggaattccgaacttgatcgccagtacaactgtcacaacaactccaacaaagaggcctagtccagttgtaaaaggtatactccaacgaagttgattcatcatgaccttgattttatccatgtctgcagctccggtcctaaaatttccaaatgacaaacattgattattcttaactttcattaaaaagaacacatgtatgcactaacagaaactaatgattggtacatactgtgcatactaaccacataataaaaagattaaatttcagtttagatcacttttaataactgaagtttcacaatatactagggcctaacatatatttcacataaacaccacatatagtaccattctttacactttcgataagaatttacagctatacatatcctagcgcaaaaaaaactatacataacaatagatcctaccaaacaaatagggtttcattaattagtactaactctgtctcaaacataacaatctaggatatgattaggcttatcataggactataaatttagacatgctctatgtccaaattcatagtcttgggatagatctaatcttatcttagataagattgtggaacgaaggaagtacatataaacttccacaaatcagtcaccacatgacaattgagggcacttaacttgatgaatactcagactaaaaatagtgaagtagctcgtcgcacccctaattagagtcaattctttagagtgacaggtaattaagtcattcaaaaattaaatcaacaatttaagataatcaatcaagcaatatgatatttgttgcttgccctttgtgaaccccggtccaaagtgttaaagaatgttactatatgcagtgttatgtgaaaatatgaacctataactagtccggtgtaaaattttggttagtaaagaaggcccaaaataaaatatactcttaacaaaaaagatgaacaaattgattgattttaaacagctcatacaacagagatgattagatgaatggtttctcacctcggacgagaacacaagtcgtcgagtttgccagagatgttcctggcgtagagaagaatcctttggagaagacgttcatcgcgaggtttcgtcctccgacggcgacgagcaccgggcgcgcggtcgtcggccttgtcggcgtcgccctcaacgaccaccccggcaacatccttggccttgtcgacgtcgctcgtgccatcgacgaccaccgcggcgacattcttggccttgtcctggtcgcccgcgccctcgacatcctggctgcccgcacctcccgctccggtaccgaacttgtcgacatcggtcgcgtcctggaggccggcgccgtcagccatcttggctttgtcggcgtcgtcattgatgtgcttgtaggcgatgccgttcatggcgctgctgtcgcctggtccacctccatgagaatcgagcagctctttgagaccttggtctttctggttggaggggagtgacgagatgcccctgttgcggaggaacggagaagggggcagcaacgggagcggacggacgacgagagcgcgcggtgggttgccgtggccgcgcccgcggacggtgatcttggcgtcccggcgccagcccgtctccttggcgacggcgacgtccttggagaagagcacggcgttcaccgcggccaccgctctggtgtcgtcctggatggcggcgagcgacgcggcctcccgtgtcgtcgccccctgcccctggcgcagcagctcagagcggttggtgacagacagcacggaggtgtgacgaccagccagcatcggtggcgatggtggtgcgcccgcgggccagcgacgcggcagccttggcggcggcgcggaggcggatcatgttccgtcgtcgggagcgcgcggttgtagctggttgtggtggagctagcgatcgagctaaccctagacgacgacggagcggggcatggcgaggtcggaggcggcggcgataggtggatggggggaagggatgggatcgatcaaaccctagttagactcaccatctcacaccagccgcggctcgtgctcgtgtgctccgagagtgagagagagaggaataaggacgtgtttcttttgcttttgcttttagctgttgatcccctcaggcggttgcaggagaagacggaaaccaaaccgtgcctaaacggcgttagccagctgattcgtctactcattccctccagggatgggacccaccatgcaagtccgaccgactaggcgactactggttgcattgcacctaagccgcgcgccatgcaccgatcgtatgtatactgcgttcaccactggacctcgcacgcaacgcaaacgtacggttcgaccgatccatacgaccataccctagcctggcgcacggtgcagtggtagcgagtagcgacaaccctttttaattacacttttgcccttttcttttctaccgtagtgggttacaagcgcgcgcttagcccttgtatactttctttctttcttttttatttttaagaaagcccttggtaatactagtggtacaatgttcgtgtggctgacctgatttaaagttgctggaaaggattaactaattattcccactctccctaaaattttcatgaggccggtgagagtgggcaccaagggctagctgtttagtttgatgtcacaaatatgtagtttgaatgtattttgttatatattctttgaggaggaggggtatcctttcgagtttctcaattcaataatatctacctggtgttcaagaaatcaatattgttagaggcaattttatggtctaccgatggataaatggctaattttgctacatggctatttaattcgttattgggcattataaaaatgtgctatagctagaggacacttacaaaactggtatattttgtgaggatgtcgtggctgttattttattatttatggcctaatcatatagagaaaactttcaaaaaagataagaattttgcccataagcttctaacctaacattggattgaataagtaataagatgtatgatattaatgcacttggcatgatgaccaattgagagttgcataattaatgtgcattttgaaaatatggaaggaaatcaaaattctggtttattttcaaaattctgtaaaaaattaaaaatttagaagagttacaaacacagccttaaagagctagcaattttaataaaaatgtagtctccaacagagttggtattcgactatctaaaccaaaatgtgacaattttaataaaaatgtagtctccaacagacttgccaaacggatggctaagccatccggctagccaaactcatctcctagctagcaaaacttgccaaacgtgggccccaccaccctccaaaccccctctttccccgtcccctcactcactctccctctgtgtcgccgtccttttcttttccacccctcttcgcaccagcgctccctctctgtcgcactcctctcacgtcgcagttgttgaagatccataacttcgcgccaccgctgtcaaagattgggagccaagatcactagcaagcgccaggcgccagggtcccctcctcacgttgccaccgtacgtccgctgctgatttccagtagtctccatcgcatatgctgctgatttccatctccgtcgcctcctcgccgacgcacatcctcctcctccattgcagcaagcatctaggttgggggtcgccgttgtccatcctccgtcgccagctacgtccagcaaaggagctccccatcctctgcctcctgcccccgtcgtcgtctgctacatggatccgtcgtcaagctcatcctccacgccgactaccgcccctttttccttgccaccgagttcgtcctatgcgtcgactgtcgcgccctctccgtcgaggtcatccggatcatcgagctcaccgctccgctgggccaccacgtgaatctcactcccctggttggagagagaagacaatgggcgaggggaaaaatacagagggaaggacaagagaagtaaagagagactaacatgttgggattgggataactattactccagattggagaatgtgatagaaagtttgttggactaaatacaaatatactgtagttctctaatttttactaaatagccatgctctaggctcaacttttctcgagaggcagtcagggccagccctggccctatgcagccgaggcgaccgccgggggcctatgatgataggggccaatacctaatactagtagtctagtacctcatccgatgttgagatcaattatttttattcataattaaatgtgttgcaaatgagtttgccagattcttcgatgtccgcgcctgagattctgaagtttgttatggatgcaaattgttatctaaatatttttgttgcgtatcgaattctcttaactgtacctgtgacggtagcttcagctaaaagaagtttctcaaaattgaagtttcgaagaactatctaagatcaactatgtcacaagaaaggttaaatggcttggctatgtgctcaatcgagaagaatatcttggacactattgatcttaataccattcttgataattttgcatcaagaaatgcccgaagaagtatctttttatgggaagcaatggatatgatgtggttctattcttcattaagttaatgaataatgatattaatttcaagttacaaatatattgttattttggtcgactttatttcttgataattatcagacatgttaaatttaatatatgtatgtatttgtttttattttacaagtaaaattaatgtctatatatactataaaattttatatatagcttagagggtccatcgtgatgagttcacttaggatcctcggaatcataggaccggccccggaggcggtagccatattgtgttcacgcaatggattactagaggagtaatagtagttgacagacatgactatactagagttgcctggaattcaaacagcgtaaagcaaggtactagcctctgggcatgcgggacctagctacccagcagcatctgggcacgacggcacgggtcagcttgcccattaaggaaagggaacagacaccgatgaccggactcgggctctggaaggaagcacaagtaagccagcaaacggaactaaacggcgtcaaaggggaaaagaaaaaggactccctcccttccagtacgcatagatgagatcagtgctccgatctcatctatgccttgcctaatcttcatcaatccctggtcgatcgtgggctcgtttgaaacaatattttttttctctggtttttataggaatctggtttgaaaaaaaatatattcaaatttcaaggctgcttgtaaatctaataatttcatagacttttttaggaaaggcacaacatttttcagctgaacggatgaatataatggacgatgaattatccgatttgcagtgatattagaggtatcttattcgaaaagaaacaatatttaaaggtacaaaacagtatacattaacaattataaaagtgtagagttttgttttatagtagaagttttctaataaagcttctgaaaaattaccgtttagaaacttggcaagtatactctagtgtataaatataagatcttgatattatataatgcgtaacagcgtaagagaaaaaaaaagacgtgggctttaggctcatttgactcagacctgtaggcatcgtttagcttagacgggacggctaagatgatgaaaacacgatcgataattagcacacgattaattaaatattaactattgaaaatttaaaagttgatctgtttaatttctacataaaaaagttttgtttttaaaagatacaccatttagcaatttaaaaaggaaaaaatacgaattacccccccgaactattgcggtcgtctgaattaccctcctgaaccacaaaaccggacattcttcaccccgaactatgtaaaccggacgaattacccccctcgacccaatccacagtggttttggtctacgtggcgtacgcgtggcagtacagtcagcattttatttattaaaaaaatatgggacccatgtgtcatactcctatccaactattccgggctgcaggaat

SEQ ID NO: 40197 - DNA, 10687 bp, Oryza sativa
ggagccgcctcgcctcgacgagcgctaccacgaccatggtgaggcagaccgtcgccgcatccggccggttgacctggccgtcgttgcgggccatgtggagccgtcttgtctcgacgagcgccgccacgaacatggcgagacaggccgtcgccatgcgggcgccgatgcgctggagcatcgtgatgcctccgccgcgctcgcctctccaccccctcgcctcctcatccgccgccgccgtctaaagaagaagagagaaagagatagagagagagcgagaaactgacaggtggggctcacataatttctaataaatgaattgctgagtggactgccatgtagaccaaaaccaccgcggattggatcaggggggtaattcgtccggtttacatagttcggggtgaagaatatccggttttatggttcaggggggtaattcaaatgactgcgatagttggggaggggggttaattcgtaccttttccatttaaaaaacacataaaaattattaagcgtgtggctacgtatagtttactctttccatctatactagccactttgtcacgcgttgcacgactttgatgcccactttgacatgtaaaagttctatgatgaatgtccgttgaaaatatatgcggaaattcaatttttatatgaagaacttgataaagaaccgctatggattttatttcgttatattttttcatcttaaattgaattaatgttttaattgtcaagtgtatttttttagataatggaatgaaacatcccggcctttgcttaaaagagctatagccaattgtcaagtgtatgaatatctttcggtttgaaagaagaagattcattttaatagaatccacattttattagtagaaaaagtttatttttatttttcttttaaagttgggtttcatggtataatggataatcatcagtctgtttaagctcgtcacatgaagaaaagaggatggaatttctgctttccagcttctattagaaaagaatttactcagagccacaaacaaattgcttcgtctccatagccggtggaactcttccctctccttttctcccggagcctcttgaagccttcagactacccttgggcccttttgatttggagaaaaaacataggaattttagaggttttcaatcctataggaaaatttcctataaagccctttgaaacaaaggattgaatcatatccaatcctttaaaattcctatggaatggacaatcctatagagattttggaggaaatttagcaagagcttcaacctcttgctaactttcctttgagtctatctctctcatccaattcctgtgtttttcctgtggttcaatcaaacagtcattcctgtatttttcctgtgttttgcaatcatttgttttacacttacattcctatcaaaatcctacgtttttcctattcctacgttttctcaatcctgcgattcaaaggggcccttaaccttttgattctttgttgggctctatatccaacggtaaattttgtttcaaagctatatttgatggccattagtcttctgatgacttggtaaatcctccattcgagaaagaataattctttcactagttaagatgtagcctttgacattggtattaagaagggtaaaataaacctaaggaataaaatttaaattttattagttgttatattttaagatgaatatagtagtttctataaattcccttagaaaattactccctccattccaatataatatataagatataaccatccttaacctaaagagtaaaaaataattattatcgcattattgtttgaatcatccaaaaaatattatacatacacccaataaaatcactgatttttactatgaaagagataaaaacataatagtttagggccctttgaatcgaaggaatgaaaaaacagtggaataggaaaacacaggattctgacaggaatacaattgtaaaacagaggaaaaacacaggaatggccgttatttgattggaccacaggaaaaacgcaggaatcagatgagagagatagactcagaggaaatgttccaagaggttagacctcttgctaactttcctccaaaatgtgcataggattacccattccataggaattttaaatgattggatatgattcaatcctttgtttcaaaagccttcataggattttttccttaggattgaaatcctctaaaatttctacattttttctaaaaatcaaaggggcccttagtggagaaaaattgctagttaattacatacatgcatgtacgccagtacatgctactccctctccccaaaaaaattcaaaccctagcatcccaagaaagttttaagattagcaacaaaagtctagaatacccttaattaatgtgaatgttgtattggttgatgcataggtgaggggtattgaagtaataaaaattttcgatttgcatattggtgatagataataaggaatgagttgatttatttttggataaatttcaaacctaggagttggtttatttcgaatagaggagaactgctagggagtccttgctactgttcgagtgactgcatgcacttcccttggcaaacaatcaaataaaaatgctgctgctactactactccactactccatcctcgcgcgttttctgttgagcactgagagcaggctactactactagcttcatgtactcatcacaagtcacaagtcacaagtcacaataggagtatagtacacatcaaatcacatcctgtagagattctcccttccctcttgtctccgtttctctcacacacgcatactcctagtatttgtctctccatcagaataggagtacaattaaacatttgcagtagtaggccagcttggtactaataaccggttacatttgcagtataggccgtgtttatactccctcacgcacatttcgccactttgaaattgcggatgataaacaatgtactccctccgtccgagtgtataagaagttttagagttggacaatgttattaaggccctgtttagtttcaggggtgaaaagttttgacgtgttacatcggatatatggacatacatttgaaatattaaacatagtctattaacaaaacatattacagattccacctctaaaccgcgagataaatttattaagcctaattaatccgtcattagcaaatatttactgtagcacaacattgtcaaatcatggcgcaattaggcttaaaagatttgtctcgcaatttacacataatctatgcaattagtttttttcgtctatatttaatactccgtacatgtgtccaaacattcgatgtgacatggtgaaaagtttttgtgtgggaactaaacagggcctaagaaagtatatagaaatgaacggtggaggtttgtgattggatgagtagtggaggtactaggtggaaaaattgaatattggagggttgttattggttgagaggagaatgttggtggagaagttgttatattttgggataaatcttaaagtctagaagttgttatattttgggacggagggagtatgttgaggtagaagaaagtcactcaatatgtttttgttggcctaagaagaagtgaaggtaggtggaaaaattaaatggtggagggttgttattagttgagaggagaatgttggtggagaagttgttatattttgagacaaatcctaaagtctagaagttgttatattttaggacggatggagtatattgaggtagaagaaagtcactcaatatgcttttgctggcctaatatttactccctcactcctaaagtataaacacttctaaaatttaaccacaaggagagatgtggaattaaaatgaagggctgttgaaatttgttgagataagaaaatatagataaagaaattattaaaatgaagggatgttgaaatttgttgagataagaaaatatagataaagaaattaaatgagagaatgttatgattagttgagacaatgaaaggggtaagcagcattattttggaaaagaacttcaatgctatatatatatatatatatatatatatatatatatatatatatatatatatatatatatatatatataaaagacgaacagggttccctgttaactatagaagtagagaaaagtagaaagagatatgtagctaaattgtggtgattcaaattttaaaggtggggattaatctataccattttaccattttttatttaacctttttaatttttaattttaaaaacaatctattccaaaacttatttttaaaatccgaaccttttatagacactttagctgactgttggagtggaataatactgtcacggtgatgtgaataacgtgatggtgttatttggttacatcggtttagaacgggttattttttaaataaaaaaggttcccgtcttacacaaaatgcaaatcgcattatgaaaaagaaaaacaatactgcaaaatcaaattatgtttttctttctggaaaaagaagcctgagtttatacgtcaaatgcaataatacgccgctttgcgtctgttcggatggttggctgctgcagccaacaccaacaatgttatacacacaccgagaaatcaacgaattacgacggctgcagttgaagatattgaatatatctactttgcatacgaatctaaataagtgtacgtttagatttatatagaaattaactttattaatatgaatgtattagtttcgtgtaatactatctacgaaaaccgctagtttgctggtaaagacatgaatggttgttttggattaaaaccaaaatgtgctctactaaaattttggtaacttagccaccaatggattggtagagtatttcaccctaaggaacatatagcgagtcatatacagtaattggtgttaactcgctggggtcatatacagtaacaagtcatgtacaaccgacccgaggcccggcccggcccgtgagaccgatacgatttggagcttgcacttggcataaagaagaggagataaacggagcaacacactttccccctcgaagagagcgaccccaaaacaaaccaaaccaaaccctagacgcctcgccttcttcgattcgtccttccctcgatccgctgtgctatggcgctgcgccacctgcccgggaagctgaggctcaccgccgccgccgcatggttcctggtcgccctcgacttctctcccgctcctcccaggtccgtcgtctgattccccacctcttcctcatccgtggtagctacatgtggtgcttaatttcctgcgcatccgagacgacgaggtcatgcatctccgcgcgtaccatgttttcacgtggaatcgtagatcgatcgcaatcgtatcctataatcatcaatagactgcacgcacgattctctttaaataattgcaatccccagctgccggtgctttatttcccctcgcacctcactttttttactgaaatcgtcgctgtttttgtatatttgcgattagccttagcaaatgtatattgtgcctgtcgatgctattctggcaaacccaattaggatgctgtttggaactattttgtaccttattaattttaatataagtaaagaaatacaagtgtgaaacatggaatctgagccaccgcttcttcccttgccatactgctgcttgatctggctcagggtgtggtttctgctgctggatctatcagctttagtaaggggagcggcaggcagcatgacaatggggaacagaggattctttacggttgagggaagtagatgatcatgagcgaggacggaggttgattgaggctaatccggtttagggtatggctgtatgggtaaaccgaagtagcaaaacgagacaattcatggaaacatggaccattcattcatcagcatttcattgatgaagcttcatattatttcgtacattagggcgtgtggatgtgagaaggcaatctgaatgttggttggggggaaagtactgtttatgagctagaccttggtgcatattttggaggtgttggtgttgacgaagagtgataagcctgctctggattcatgcctcgataatttaggattgctcttgaccaagtttttggatttacaggggtataagcggctggaaagcttggtcaaacaagtactggcctcactcctaccttgggagaccttagtgttttgccatatccatgatttattgatttggtttaggtctcatggtttgaaaatatggaagagggcacttatatatgttagagatctttttttttttggccattcttagttacatataactgactagcttcttctatgttagtatagttgcatttatgctacatgaagggattgcatgcaccatataatcttgtaggagtaattctttcttaaaatgaataacatgcacagctaattcatctttttattcaagatggtagtactatgtgctttcaaagattttctgttaggctgtttgcggtgtatggtttaagtaattagtttacatgtcaagttggtttatttggtaatcttgttgaattgcagggcgaaaaaaatggccgtgcaagtagagtggtcctgaatgaaaaaagtgaacgtgaaaaagaaatcttgtaagtgctctatgtaataataacctgatgtttgatttaagtataaatggagtgatcctaattcattcatttaccatggttgtttctggaaggcaagacatggaaagaactatcaagaggctacctatgattacagcgttgtctatggttggtggtgctggccttgcgtttggcttcttgggatgtgtgtttgttattgcctcggccagtgaagactgaggagacagtttaacaattggtcagttcgctgtttgtatgaggcatcgtgcatttggtgttagtccaagagtactaatttttatgtgggtaatgtctgttatgtaagatcgacgcgaagttcttaaatagtagtagtaccacccagcatcgatcccagagggatgtgatcgtagggaaggaaaaagaactactgtctaaaagactgtattatgctgcggtgtgtttaaactaatatattattattatgttgttgtgtgttgtggatcaagttcccatcttattttttcgcttatgcttattcttattagttaaaatttgagctttcaaacttaaatttggagttgattttgaggttttttaatcgaagtttattttttaaagcttttttccttcttttaaattgctaaaaacatgcatgaattattattattattattttctacaaatatgtcgtttggctattctactaataagtaggggccgttcgcagctcatgttattatatatatacatgctatatattgatctgacaccttataccatacctctttctttgatgatgacataaattgaattcatcttccaaaaattactctcccctgtttgtccgcctaagcctaagctgtaggatcattcaaggtgacagcagagccagcatcatggaatatggaggcgcggcttcgctttgtctctttaaccgctcggacgccgagactagactagcaacagctgtgtgctgtgcctgttaccgcggcggccagccaaggagtagcatggcgagagagacagagacctctcggataagatgctcccgaatacttacgtggcactggcatccgctaattcgatccggttcacgtcttctaccctagtggtactattattataaacactaacgtgtgggataaaataatagaatatatcttctccgtctcaaaaaggaccaattctacctacgaatttggacacatgtaggagttcgttttttctgggacgaagtagtatatattagtgattataataataatgtcattatggcagatgattctcacccacttcgctcgactagagagagtgctgttaatttccatcctcagatccatcgtatgcagaccttgagggttgctttcgccatcgagttcgatcgagcacataatttgctctctgtggactgcatgttgtggcctccatatgcatcttgtgtgggcagcgtcgtctgccatggatcgccgcttgtcttgtgttgggcgacgctcaagatcgaatatcagacagagcaagagcgccatggcgccagagtatggagttgccaatttgtcatcgttcggagctgtggtcactacgtattaccagttgcaaaagttacagtacgtccacccaccaccaaactaattaactgcaaaaagccttgtagtggtattctctggtgtcaccaattaagcagctacggccttgtttagttcgtgtgctaaaaatttttggaagttcgaagaacaatttttcttcaaactttcaaaaattccgtcacatcaattgttaggacacatgcatgagcattaaatgtggacgaaaaaaacaattgcacagtttgcatgtgaattacaagacgaatcttttgagcctaattacgccatgatttgacaatgtggtgctacagtaaatatttgctaatgacgaattaattaggcttaatagattcgtctcgcaatttacaattggattatataatttgttttgttattagattttaatactttaaatgtgcgtccatatacatctaaaagtttctgagcatgaactaaacacggcctacatcgtctgtacattgaatacccacactgccatacatgatcctccctaggcgattaggcccgtccctgccatccatgtcctcttgctgcgtactccctcagtcaaaaaaaaacacaacctttagatgtgatattttctagtacaacgaatctggacatactgctgtccagattcattatattagaaaacataccattcaatactaggttgagttttttttacagagggagtatactactttaggttgtgctctctcttaccctggttcgaaatcggagtggcagattagcgtattattagttaagtattagcttaattttttaaaaaatagattaatatgattttttaagcaattttctataaaatccatttgtataaaactacactatttagcaatttgataaacgtgcgcacgaaaaaggatagagtataattaagttggcgaaacgcaatagaaaccaccctaatcgcatattattctgtgttcatttttactagttcccaacccttctatctcgttttccacgtgcacgcttttcaaactgatggtacgtgatttgcaatgctttaaaaatattatattaatatattttttaagtttttatactaaatatttaattaatcatatattaatttattgctccattttgcgtgtgggggggagtggttcccaacccctccataaatacagttatatttaatctataaagcaacaggtacgttctttgctaggtgcacccaacaaaatatacataaaacatccttatctctttgctcaaccatccgatctgttcatctgaagactgaaaatggaccgtgggtatctctgtcttataataccatgatgaaattaccgatccgctcctccgcgcaatttccgctccttttgacgcccacgactctgccacctaaataaaccattgggataatgttttttattttctaatttgatataatgttacacacactacttaaaaaagggttttccttgtacatatacctctttaaattgcagacggaccaatcatgtctgcgaaaatcatcctccattttcgtgcgcggctccttaaaaggaccgcacaaaaaaatcgattttcgcgtgtgagcctcttaaatggatcgcatgcgaaaatgagtctattttcacgagcgaacctcttaagaggtaggtacgcaagcaaaaatatccctccctcttttccctctcactcactttaaaattttcacctatctcccttttattttcccactcatccctctatctcctctcctatctatctctttcctcctctcctctccgcggctcggtggccggctcggcgtcgacgccgacgaggtggtagccgggagtggcggctcgcggctcggcgggctcgggcatggcgaggtgacgaggcaggaggcggcggccgacgtgctcacgtcgacggccgcatgcagaaggcagcgaggggcgacggcgatcgtcccccgcttggatccggcgacggcggccgtcccccacatagatccacgcggatccggtggtggtggcggcagccggtgggcggtggggaagagccgtggcggtggcggatctgacgaggacagcggcgacggtggcttcgaggttagggttcggaggaggcgtggcgacagcggatttgacgaggacgacggcttcgaggttagggttcggagaaggcgtgatgatgatggatctaactaggatgacggcgacgaggaggaggaggaggttagggttcaggtttttgattttatttttagttttgcatgcggacgacataagcacctgaacgcaaaagtagcgatttttgtagatacctgtgtgcgtgcggttcatccttccgcatgagaaatccctttttcaccgcacgcaaaaatcattttcgtagtagtgacgtagttacttctacgatttcaatatattaagacggtctaattggacaagtaggccaactattcctaagaccattttttcaaagtatacatggaagttgataggtcatattttaagaagaaatttcaaaaatctataactttactatcagtttgctgcaacattagtgac

SEQ ID NO: 40198 - DNA, 23672 bp, Oryza sativa
atctatatgaatatggataatgctaaaaagtcttacattgtgaaacggagggagtatatgtattgtagcagtatataacgtagaagttgcagttttgtaataatttcatacgctattattgcagcaaactaaaacatgtcactaatgttgcagcaaattaatagttttatcactaaagttacaattttctgaaatttactttatttataaatattgtagtagaatgaatgttattgccgctaatgcaaagaggcgaggttgcttcccgtatcatcggtgtaaacgccagggttcaccataccgccggtaaccgcgcggttaccgggcttaccgcgggggtacggtaatgtaaataccgcggtaacctccttaaattcaaataaatttaaaaaataatttgaatttttgatgaattttacacggtttcgtacggtttttcacggtgcttaccgccggggcgcggtaactccggccctggcggtttgaaaaaccctgctaaacgctgccttttgggctgggtggggtcctcaacgttgtcattccattcggcaggtacctctgataggttgtgtcgcctctactcttttaactactccctcatcctataacgatcgtcatacatatacatatttatgtatcaagaccaataataattttattcgtattaattaagataccatgcgcacattttcccgcaatgcatgcattgattaaaacaccataccaattacactttagcatgtacacattctcccatgcttcgttaattgtattttaatgaaatccgtgtccatatgattatatgatgatgaatttgagaaattttggattccattatacgatgatatgggaaggaggaagtactaattaattaatcccttggtttgtttaagtaaataaatatatagaacgatatgcatattcattcagttttgagactagccgtacgtgcaattgggcctggcctcccctaattatgacatactaattaatcctctaattatgtaattatgtcaagcactgtgttggttccttacagttttgcaggcccaattaagcaggctagtgattaatgtatactgggctacggtggcccccgtcatcggagatgtcactgctgtctccgtcttctaaccacacgcttcgctttgctctcgtcaccaacactagtaattaatcactggttatcgatcccatatttttgatggtgccgtcgtctcccacgaccatccatttaagaccggtaaattcttctctcttccccctttcctcacctctctcccaccctgtctaaacccaggattttaattattgattggccccaccgttatttcgtcggagtcaccgccatctcgccatagctggggaagaaggcatgtaggatgaatcgtgacggatccaatgatggagggttcgacagaaatccaccccaaatttacatcaaatggaggttagcacttctgataatatatagatacgaaaacatacttttgttgtactttggaatggagggtgcatgctcaaaacatatagaacattatattgatacgatattcctttagagtaaaatgcttaaaaatttgtgtgtattatggtacaattttattttataatcatcatcattcagtacatatcttttaagttggtatcttaagtccaaatcctggcttcgccgttgtgtttgatttaaataaatgcatgaaaatgatcctaacatctactccatccgtcccaaaaaagagcattcctagcatctcaagataaaactggggagtcaaaatgaccaaaatacccttatgattggaaaaagtagtaagggtgataggtatgtaaaatgtattcaagacatgattggaaaacgttgtaagggtgataggtatgtaaaatgtattcaagtatattcaagacataaaacttcctgctttatgtgttgagtgtagttaggatgatagaagttatattttttttttacaaaattcaaactctataagttactactccccccgtctaaaaaaaataatttaggtggagatgtgacccatcccctcatatacatatattaatctagtgggggtcatacatacatcccctcctagattgattctttttggaacgaatggagtaagtttttaggatggagagagtactatatattttgattttacatgttgtttgatgaaggcgggacatagatgacactactgtgagcaggctgctgcccatgattacagccacgtccatgcagatttgtatcaggtgcagttggtactatgactgcaacttaggcagtccactgccacctgttagatctgaatctaacggtccacatgcacccggatactgtagaacattgtagcaacaaacattctctattcctactgcaggtgatcccatatcctgtccatgcatggttgctgctgctgggccccccggccttctggggatgtgtttttttgttgctttcggaggcaaagatgagggggtgttttagtccctctcacccaaacactctctcacaggaggtgtttaaccagttgtcagttcgctgttagtttaagagtatattattatggttaattaattaccggttatgtaagagtgatgtaatgcatgtggtggagagaaaaaaaagtactcttcaaataaccactactcgcaagcattgttggtttataaataggagtacattattttcatgccagctgccaggtgcccagcttcttttattctaagtagttattgaattgcatggtgcaactaaggatcattattttttgagagatcgatgaacgtgagcatgaactcttgtaaccaattaattaatctattgtttttatttaattaagtaaggtctcctttagaacgcaacattcaaaaaccgcaaaaataggaaaaaaatgtagggatatattgctcttttgaatattttgaaacacatgattattttagctagtgctttaggatggtttacatgaaatagactacaagaattatacaagaatcacttgtggaagagtgaggaagtagagggagtgcattatattggacttatcaaaggggaaaaaaaaagagctatcacacaggattttatccaagtttgttcctccaaagggccatatagaattaaaatccgtagaaactcaattctctaaattcctataaaaatcctccaatccaaaggacacgacttaaacaatcctgcgtgacaacttgacttaacgatcttaacatgcagtactgtatcaattctctataattccatgcatggatgaatgctacacgagacatagtgacataattggatttgacacctagtgcatttcctagctccgtatttgttcttgatcgatgcacttgcacattagtatgtcacctcatgattaaactcagggaatcaaactctcaattgcagctgaattgagcattcagctgcaattgagaggcattcctccggccggtcgctggggaacttgctgcagcacaagggatccttgctctctttggagaggcctctggtcttcataccaacttcaccaaatgctccgcgatcccgatcagctgctcggaggaagaggtcgcagtacttggtaactccttcccctgcccagttgaggagttcccatgcaaatatttgggtttgactctttccatcagaaagctgtgtcgtgagggcctccaacctctggtcgataggattgcgcagcggctgccgctgtggcgatcggattggttccagccggccgggcgcctagcacttgtcaaagcagtgctgagtgcgatcccggtttacctgctcatcgccattgcccccccaaaatgggtgctgaaagccatcgacaagatatgacgcggcttcctctggtatggtcgtgcttcctctggtatggtcgtgcgaatgctcagggtggccactaccggctggcttggtcccgagtctgcgcgccattggaatatgggggacttggcatccacaacctggagttcatgggaattgcactccattctaggtggctctggggtgctgaaagccatcgacaagatacgacgcggcttcctctggtatggtcgtgcgaatgctcagggtggccactaccggctggcttggtcctgagtctgcgcgccattggaatatgggggacttggcatccacaacctggagttcatgggaattgcactccgttctaggtggctctgggctcaacgcgcctcccaatccctatcctggcaggggttgcaaatctcgtgctccagacaagagcgcgagtttgtggccgcttgacctgtgtccttggcgatggcaagtcgatcctcttctgggaggacagatggctacagggttcgagtcttcactctttggcacccgagctctatgatcgcattcgtgtccgccggaagctcttggttgctgatgcattggccaacaaccgttggatccgcgatctccatggctccttgggagtccaggcaatcttgcaatacttgcatatttggtcgttgctgcggacaacaactctctccgagggccatcctgattctttcatttggaggtgggagagttcggggttatactccacccggtcggcttaccttgccctcttcgtgggcaggatctcatttcagcacctgccaatctggcgatcttttgccccgcctcggtgtcgctacttcctgtggttggtcgctcaccgacgctgctggatggctgaccgtttggagaagcgtggactgccacacccagcctttttgtgtcttctgtgactaagtggaagagacaatcaaccacattctgattggatgccccgagtccctccagctatggtggactgtcctttcaagcctcggcctccctcagtgtttctcctctggcgctgtttccttccatgagtggcactctcttgccggctcaaagttccgagggagcgtcgttgtgggttcgatacgattgtgactcttggcgcttggtccatttggaaagaaaggaacaaccgtgtgttcaacaaccgttcccggtcctggcctgaggttgtcacagccatggcgcaagaagccgccctgtggcgtcttgcccatcccctgtcgccagcgcttcctagttagcttatttggtcgttcggtcgtcacattgtaatagcgagagtaggcttaagtcctttttttttccctttccctccctttttttccctatctctcttctttgtttgccatttgtataaattttatttctcttaatacaaaagtgcgcaatccttttgcgtattccaaaaaaaaaattgagaggtattcatattcatatatagtgattattgttttgactgctgctgaaacaattaaagatattgtggcacatattcatatatagtgattattgttttgactgctgctgaaacaattaaagatattgtggcacaactttgtccaactgtataaatacactgttacacttgtgagttgcgacttgccacctacacattatatacatctagtactgagtaccttgcctgtgcagctagctgtgctgcaagctgtgcacgcatggaatccaaagcaagatagcacagattacagataagatcataatagagcggtgcttgcaacgtattgtgggccgggcacgcatcaattcatttattatccaaagttttcaattatctctgcagatatctgtccagtaaaattaataataaacatgcatatattcatgtgttgtgcctattggccatgtgctacatatgagaaactgcagtctctggtcgatccctatggctgtaatatgccatacattcttgtctatatatatatatatactgtcctatatatgtgcccttcttttttcttgagaaaatgttggtttaattacttttttttaataatccataaatctgttagaatatactctcaccatttctaaatatttgacaccgttaactttttaagcacatgtttgatcgtttgtcttatttaaaaacttttgtgaaatatataaaactatacgtatacatataagtatatttaacaatgaatcaaatgataggaaaagaattaataattacttgaattttttgaataagacgaactgttaaacatattttaaaaaaatcaacggcgtcaaatatttaaaaacatagggagtatgttatattctcatacatttgtgtggtcacctctatttctcatgcgacaataattaagagagaaatgatttgggagcacgaagccgagacccgagggataaatgggtgaacagttaataagtgtgagaaagatcttgagatgcacaactctgcacattgatatgtgcctatgctatatgcacgatcaatatattttgttaagcgtactatatatcagtgttcacgtttcacaccattcgtttatgtccttgctgattggtaaattgtcggcaaattcagaactttcaaactctaggtctaccgatgatagtgtcttcccacctccgcgcttacgtccctattccattaattggttagttctaaatttcttgtatttggttattattgaaagttgtagtaataatatattaatgacggatatataaaaagagactaaattgttcaatatggtcgagttaggtcaataaattgtggtgaggagatcgaaacactacagcgagaagcttttgcaatgcaaaatgtctaagggagggaaagaatatgaggtttcccatccttaaatagcatatatacctcttaaaaggaggtaccacaattaatattataaattattagttataggttggagtaggtttagaaacttatgtctatatatgttgttgaatttttctccatttttaatgaggtgtagaaagttctattagctaggaggtatatatacttcacattataagtgtataccacatcactgacattacgatgtatatatatacctctctacaccactttacaaatagagaaatatcatcgttgccaatcttaataatactatctagctccctctgttctaaaatataactactcaaatttaactatattctcttcacaatatatcagaaattttcgctattcaaatttcctgtctacctcctcttatagaacaatcacaataccttatttagtttcatcatttcttttaatacatgtgtccaactctaaaacttctcggaacaactaaataacaaagttaacagaaaatagtggaaaggtatatacctcgatcttcatgtcgagaacctcaaagaatatgccacgtggatatgtagaaaggttaggagtgcagttcaaactcgtgttaggaaatcagatggtagaaaagcccgggagtttccatgaatttttaggtggatcaaatgtcgctagaggcagaagaaggcatcctggccattggatgcgcacccaacaagagaaggtataaatctcagccgtacgtctttaaaaaaaatgcgccacaaattaataatgtcagtcacggccacgaataatccagcacgacatctcataattaacgtgcgcgtcatcaatagcattaatcacgcacggttacacgcttaattgctctactaccaaattgacccaaaccgtactcctacgtacaaatgtacggtttcatacagtgagtatacgtagacgagaccccttgcgaaaaaaaagtatacgtagacgcgatctccgtatatttgtccgtacatcggtacatgtacggacacatgccaccttcgcgcgccacctaccttcgcgcgcctccgcctcccatctctcccgcctttttcttcttcttcttctacctctcgcgcgctaactcacggcaacgcgggagctagcggcgccatggaggccggccaggatgacgcggcggacaggctcacctacgagatcttctccatcctcgagagcaagttcctcttcggctatggcggcggcggcggcggcgagacgaagagcttgcagtgcgcgccgccggtgtcgagagggaacagggtgtgcgtgctctccgtcgacggcggcgcgcgcccggaggacgggctcctcgccgcggcggcgttggtgcggctcgaggccgcggtgcagcggcgcgccggcagcaaggccgcgcggctcgcggatttcttcgatgtcgccgctggctccggcgccgggggcgtcctcgccgccatgctgttcgcgcgcggcccgtgtgggcggccgatgtactccgctgatgacgcgctcggcttcctgctccgccgcgtccgccgccgcgggtggtcgtcccgcgccggcggcctgctccgccgccccgccggcgccttccacaaggttggcgttcgcgtgctcgtctactttttgtactactcggtatgcgtctaagctcgcgccatggctggtgaaccaggtgttcggcgagctgacgctgcgggacacggtgcgcccggtgctcgtcccgtgctacgacctcgcgacgcgggcgccgttcctcttctcccgcgccgacgccgcgcagtcgccggcgtacgacttccgcctccgagacgcctgcgccgcgacgtgcgccccctcgggcggcggcgccgccgtggaggcctcctcggtggacggcgtcacccggatcacggcggtcggcagcggcgtcgcgctggggaacccgacggccgcggcgatcacccacgttctcaacaaccggcgcgagttccccgccgcggccggcgtcgacaacctgctcgtcatctccatcggcaccggcgaggccgccggcagcagcagccgccaccgcgcgaggacgccggtgatcgcgcggatcgccgccgagggcgcgtcggacatggtacgtgccccccgatcaatacaccacacgacacggacgccactgttcactcttgttttacacgcacacgtagagttgaagcaaacagagtacgccgcataattaatttgctagtacaatttttgtacgcatgcatctcgtctcgtcttgctcggagtactcgacatgagactgagatctgatctggcatgcaaatgcaaatgcaaatgctgaaatccatccaatccaatccgatcccattaggtagatcaagctgtcgccatggcgttcggacaacacaggacaagcaattacgtccgcatccaggtaaaaggctacagtcaaaacctctgagatttttgcagtacaatcgatcagaatttgattgatttgggtggatggattgaaattgttcgtgcagggtatgggggtggcgcggcggcgcggcggcggcgtggcgtgcggcggcgagacggcggagaaggcggtgtgggtggcggaggcgatgctgcagcagaggaacgtggaggcggtgatgttccaggggaggaggctcgccggcgagaccaacgccgagaaggtggagcggttcgcgcgtgagctgatcaaggaacacggccggaggaagcagcatgttccgccggcggcgagcggcggcggcggcggcggactggactgccatgtgagcaagaaacagccgtaagtcagccacggcgagcggtgtcgcggtggctgaccggccgaccgccgggcgtattgcggtgttgttcgtgcacctccggcgatggacgtcgatcatactatcatacaatcgtactgcatcatgttaattaaataataatctcgaccgatcatttaattttcaccttgttctgcttgctcctgtaattaattaaatgcgtggcagtggatcacgtcttgggctgatggtctcgtcggccgcagccgccgccgccgcgctggtcgccggagtacgacttcggccggctgcgctagcttgcgccgccgtacgggagcaacataataagattgaaacaagacaacggaaaacaacagaataagattgaaactgaagacaatttatcacaagttcacaactactctgtcactttgttcaaaatcatcacaactactctatcactttgttcaaaataatcacaattactctgtcactttgttcaaaatcatcacaactctgttacttgttcaaactcatcacaacactccagtcacttgttcagaaaactccatctggcagtgcagatccttgtttcatttcttgaaaagtctcctccaccaaggaaccttattagccttcacctcctctcttagctctttaattgcatccgcgataccctgcagcatctctgaaatcctcttggctacttcttcgcatgtctccagcttgatatctttgatgacgtaaggcacgtagaacgccgtgactccaccgaagccccccagtagcaccagcacgatgcgccacgcagtgattgacacggtgaatttggaggtcaggatatcatcccttgcaacaaacacacaacagaaagcaaatcatttagtatttgtcagaatctaattcaacaacacggttgagtgagtccattgcaacaaacacacaacatgaaacgatcagttgtcagtttaacaacacagctgaatcccttgcaacaaacacacaacagcaagcaaatcatttatttgtcagaatctaattcaacaacacagttgagtgagtccattgcaacaaacacacaacatgaaacaatcagttgtcagtttaataacacagctgatcccttgcaacaaattaaacacacaacagaaacagtcatttgtcagaatctaattcaacaacacagttgagtcccttgcaagttgcaagggacacacaacatgaggcaaaccatttgtcagattaataaacagagctgaatcccttgcaacaatcacacaacatatgaagtaaccatttgtcagaatccaatttaacgacaaagctgaatcgcgatatattaatcgtatttatacatacctgtagtttctcctcactgagtggagttcatctttagttgcagccatttcttgagcaagctgagtgcagtgtaggagcaaggagctgtggcgagagtgagccaactcttcctgctggaagttcttttgcagtacccaagtaatcgtctgctccatcttgttattcaccattctctccataccctccactgtcttctccagcaatttctcaagctgatcagcgcgcttctcagcgatgtccgcgcgcaactcagcaatgcgcaggttggcgtcccatttcgcttccacatcctccagtctcttctcaaggctcctcacaagctgctccaactcggtgactctcacactgacatcaacgagtctgatcctgtttgctctcctcttgtcgccattggcactgctggtgctggtatcatcagggatgctgacattgggagtacttgagaggcatcgagtggtctgcatcgaggacagacgacgtcgactccctttagaagcagactgcaccgggatcatgatcttgatgccgttggcagtggcgagagagctgacattggtgatgcccgatgacggcggcagtgtcttcttgtcacgcgcatcgtcgaacacgcagggcgccagggagacgaagcctccggtcgtttcgccatgctcaggatggccaccgccggcgacgatcaggtcgcggatgagctccaccatgctgtcgtcggcctcgagcacaacgaattcagggtcttggatcgccggcagcggcaggttcttgacgaggcagacgagcgccgcggcgaggtggtgttgctctgccttgctcaagaggtgacgagcgcggaggagagcagagtcttcggtggcggtcgccggagccaccggatccgaccccaacttgatggtcgcgctcgcgctcgcgctcgcaccggcggcgccgatcagccaaggagcagacatcccgactccgaccatggcttctccgccaccggaggcagcggcggtaggcgacaccatgtccgcgccgccaccgatgatgatctcctcggggcgggggcgggggcgggggtccacttcaccggcgcggctggagagcgccctgagaggaaggcacggcagcgggacggtggtggtggcccgggtcgcgccgtgcgcgccggcggcgagcatgacgagggcgcgggggcgaggcaggcacgccgccttggccttgcggccggcgagggtgagcgcccggaggagcagcaacggcggagacatgcttgtattgtacggtacggcgagtcggcgaccggaggcgaattgaagtggcggcggcggcggcggctagggtttcgggggatgaatcgaatcgaatccaccaccaccaccaccacgcggtgctcgccttctcgctccctcgtctcgctcggctgctgctgctgctgctgctgcacagctttcgaggacggaaaagcagcgggcggccaatgtgtgggtgacgcgtgtaaggcgagagattccattttttcaattcatcacctccaatggatgccgtccaatctgcaacggacggtccagatgatcgcctcgcctgcctccttcccgtctttcgcgctgttacagcaaacacgtagtattagcctgtttattatacttagttggactgattaggttattattgtagtaataatgtagaggaatacatatacattcatgtcaagaaaatgagccagattttgtggtatattgaatcaaaacttatcagtgaaaaagaagaaacctgcaatatatataatttgcatatgcatttttcctttttgcgagaaggaataaaaatgcctgctctgtattgaaagcatagtactccagtttacaggatggatgtgcagcacaacaaaacagggctcacagcagacaattgaaacccttttctatccttgatccttcagatcacacccaacataaccccaactagtgcactctacaccttgccacaaattgaagacaataacctttataaggtttaaccctcacgcgctcacgacttcagctttgccaatcttctcaatatatagagctttgaataatcctatccagctttgccagcgcctctgatgtctcatctcaatgccagccaccataactgcaagaaggatgccaagtttgtgaatggcggcaacaggataactcaaaggattcaattatatattttctgcttaacataaacgataaatcatttggccttcagaatctgccaattttgcaacagaaattgggcattagagtagtgcaagaagcatcattgctgtcctattttgcttctcttgttttcttaatacgtatgagtatgcgtatcatttcattaagaagaaacgacgagggagtggctaaaacaccttacactccaaacaacaacagattgctatacaaacacaactcactcgccctgaccttacccagccggggtaagcaactttctaaggaactcgccgagcttagaagccccagcctacaccaaagaccgtgtgaatgacaatcataacaatagaactagccccatcaaacacactcattcctatacttccatatctcccaagccacattcattttgtttctcttgttatatggatatttgtttcaaaatcaaagtagcactacaaattcatactagtcaatgtagagttatttgtttctcctttgtagttcctttaatcactagaagttctccttgtctctaactagtaaacaagcatgttcaatgcacatcatgggcaacatgaatcgaaccaaacattttcttttgaatgagttgctagaaaaaaccccaagcatgaaattagaaaataagatacacttaaaaaaggatatagatactcacgttccattcatgtgatttcatgaaccaggagagtacaagtcattggctaacacatctacagtagcagtaaataccaccaaacattaatggtcattgttcaagagttcatagccccttatctacagtaacactaaccacaagaatgaataatctaactaatctatactaatgtaatacccaaaatcttcaaaatccagatatttaatatattccaaatttctgttagcatggttatatgattggtggtaataaaatgaatttttaatccttaaaataatttttgaaagcatgctcccggtgtcatttcttcagttataaattcaggttcctttaaattcttactattaggcacgggctataaagtgttatacaagaaacaaaagcaagtggtagtggaaccatccctataatttatgcatgcatcagagtggagttcaagcatccaaggatgtattgccatctagaatgcctagcaatccttactcttatatttcattatattggaaaaacatggaagaagaggacatgtgggagcatgaaacattacacatgcatattagacagtgatctgtacaaaataaatgaatgaaactatccatcatttgtgggactgaaatatgtgctacaaagcacatatttagttatttaccaaccgtatcttcccttgtcatttcacttttctaactcattgcatgaaccatcatggaaaaccagagcttccatgtgacattgtaaaatcataaagaacctgaaattaatgattttaagttgcaacgcgctgaaaacattgtgaagccgaaatctacttcagtccaaaggaactgtcgaataaaaaccttacttccaacgttaaaatgcttgtagagcgccttgacaatgctgcatcatatcagtatacattataatttatggtgattgtagtcccataaaagttttttacattacccctgacaaacccagtgcaagtgctgttgccatttttatgatgcaccataaatcaacaatgttcagtaaatgaaaaaaaaatatgtgtagcatcaaaagtttcttaaaggaaaagaaaaataaatgttgaacgaattgaatggcctttcgagattcatgtgtgatatcttgtagttcatcaaggctatgcagatgggaagggaacaacaagccttgtacaatggaaagcagatgtgttgtaacagaaaaaaagaacggtagtgttgtaacaaatggttaccattcacttcttaatggaaattaggaatgtagctagcatgttcatccaaagaagaaaataccttccatgtggctttctcccttgtttcagtttgctcgaaaaggtatttaagcatccctttcccttgttggtctgtccatgttataattttctaagctatcatactacacaaagccataaagcgaaaaggcacaaaatataaatgtgcatcaacaagacatgtatataaaaatattcttatatattgtcatgtttatgagagaaataaaacttcatctgcaaaaaaagcctattgactaaaactcgtctagtaaaggattgcaaaatgacatgtaaatactgttatttttccaatctcattttccctatgtattgacatgctgatcaaaatctctatgcctgtgttgtgaccaggcaatcaggaaaacagagagatggtatgttttccttcaagctttacaattattttgtaatgaatatgtaaaaatgatttggcttgatcaatagaacaacacttaagttctgaatcatttttagtacatattatgtttctgaagattgttcctgattacatacaaagaaagtgcttaaaactggaaaagctagcaactgaaatatttcatgttagatgatatcagaattggagtaataccacaatcctcacaagttttttaaatttttttagaaaacgcaggagagctgcacttcatttcattaagaaggaaaacaaaccacccatacaaccaagggctcatgagcccttcacccagaacacatccacaactagcatcacacaaggcgatacacgaccaaaaaccaccgtacaaagaccaaaaaccagcctagtgccctgggttagtgacctacaaaggaaatcttggagcgcaagagctctagccaggaaccgaaacctagcttctgttgacactgccctcgacacctccatgacgcttggatccgctccgttggaaacactgtcattatggtgtttccgaatttcccaagcaactaggataatcaatgaattgagcccctttttctgctccctatgcatgacataactgaactcggtgaaaccattgaacatttaatgaattgatccttacagtccttactgaattttattcaaaacttaccatgttattttttagataatatcatcatattaaataaaatatactgttataaactcgtaactactgccagcagtgtaaatgagtttagtggcaaaaaagtgttctccacaggagattcaaaacaatttaaaacagtttgtggataaaattctgaataagttgagaaaagaagttgatatgcagttcatgaacactatgatcacctggaatcctcaatatgcacaaactgtgtatctttcagcaaacatcaaagaattcaacataagaaaaaattgcttagtaacatacaaattggttccaggttaatgtaaaaatatatacatgcattgtcttgtaaaaccgttcactacattgtgcactagctaaaagttgctcccaggatgatttcaaaaagaatatcctgattgcatggaactcacgaaaaagaacaagttgggtccgactaaaattggttatcaagctaaaagtggttccctgagaaccacccatgacatgctagacaatttttttacgcaaaaggatataaagttcctgcactgacaaaaacatagtaaacggaaaattaggatgaggggatgcacagaaagtaatgtccagatgaatgaacattaactggttatcctttgataaccccttgtttatgtggtcaattgcttttataaattgtacactagataaagtcgaacgaggcttcttttcaataacctgaataagaattaatccacaaaatctgtttgtggatgaatagccacaaggaaaggattaccaagctagtaaactagttgatttatgcaaaacctgtgactactaaatcatacagggcatattaaagagcatattacataaacataccttgatcaaatttaatatgataattgggtttctgtatctcatctaccaaggtcaccaaaatgaagctgagtcgttttatagtcagtgtttggttgtcctgcggttataggagtgtcacaaaagtcctatgtacataataatttttccgcagatttgccacaaggaaaggatttagggcttacttgtgatgtttggcttaatagaaaatttagcttcttgagaccacagaagatgtatggatcctccgcattgcacaacagatattatatttgatggcattttatcttgggtgtcttgaaacacaatttgctttgtctcaacatcatcggcggcaattttgatgtgtttatacaattctgggcccagcaaaatggcattaaagcttagctataacagtcactgaaactttctcctaaatgagccatgaactatatattaataattgcactgcaaaagaagacaatagcgtagtaaacataaaaaaaagggcgcatttgataataatgataaattacaggttcaacactaggagtacagagtagagttattttttttgcgaacacgtaaaaggaagtagagttatgtactaaccatcctagcagctagtaaaaattagcaatgtggttttgctgacaaaaacataattgcatttgttaacaattgttattaagtgcaactatacatgagttgtcaaaggtgatgaacaaccaatttactactagtaaattctgcggttaaatgcagacgaggacactggataaactaccagagacaaggtcgacaaaatggccccaaatcacagctgcagcaagatcgctggtggatggagctcgttgcggacgaaattaccggccacgaagacgaagaaatcaaaccaaaaccgagccccccgaaaaaaaaataaatcattaccaaatgcgagagagacattgataagcattaagcaggcaatcatggtgtggtgagagagattcgaggaggcctcactacgaagaagatgatgacgagggagatcaggacgaggatcaactcgggatcctcgcgttcccgccgcgggcgtaattggcggcttgccctcgcagcgaaaccctagggctggctcatccccctctccgctcccacactcgcctagcttcttccccctcctgatccgccataacgaaggggaggccgaagaggtcggtgccgccggggacgcctcgacgtcaccaccgatggcgccgccgccggcgaaccttcgcttatcgggagtttcgccgccggcggaactgaagcgacggagcggcggaggaggttttgatcgccgtgagtggtcccacaaatttacgaacttacggcccattaagcatatgcgagattacggcccatcagagaatatccgtagcgggctagagtcggcccaatatctggtcgggtcgcgaattttttcgtttttagattttttttaatatttacagaaataatctatcgacaaaaaaaatttacaaaaatagaccctgccgccccaatggtgggcggcaagctgatgtggcagatggtgggttgaccgcgccgtctgccgccatcggccaaaattgcgattaggcccttgccgcctatagggctaattgcaattttggccgcccataaagagcttgcggccgtactttttgcatctgggtcggggcggcaagggacccagatgtaaaaagtacggtcaaaagatttttctatgttatgttaataataaataaagaagtatttattggtaaaacttgttaatattgttataaaaatgtattgaagttggttgttgcgcaatttcatatgttaagtgagctattattttgtaccttattcgacgtattagtactcggataatttatataggcctatcgcagtctgggtcgtagaaacattatatggacttaaacgaggagaattatgtaacatgaagaaatagtagtataatttgaacatgatataactatttgcattgcggttacatagatgatattagattcgaactaggagggaggtagtgcaatagttgaacacaacgacgatgtagtaatgggaaaaggaagcatgacagtagaaatttcaatatgccaagttgtccgataatagctaacccctacgtgaggatccctctcctctctcaaaccgcgctttagtaaccctgtattgctctagtagttcaagctgcacaacacggctaggtggagttagaacccttctggtgtctatccattctctgtattgacatctccttggtggttcctgggaggaaagaatagatataaagcaagcaaagttagtaaatgttgtgagaaaataaggattcatgtaatcaaaatattcttaccatgaaatcgtcgtcaagaatatttggaaccttcgacccaatgttgtaggatttatggaacgaagaacctgacaacgatcaccacacctgcatcttggacgggctttccatggagggagtgccgtagttagcacccgccagtcgctctgttgttcacgacattgtcgttcataaagccgcttttctctgtaagtattgctcagtactttcggatgcgaaataccagcgaccttcttgtaaacaagtggttaggtcgagaacgagattttttgtatcgacccactcgatgtatgcgcaagccgtagtgcgggtctgccgaatagagtagtgttacgaagaataaagcgattgcccatacataatgaataagcatatgcagataataaaatatctcacggtcatagttagggcacctaaaaaagtgccttcctcgaatatcaagattccttgaagccattagttggcatcgatcaccgcataggcagagaggacgctggcaccaaggtggtagtaggtatacacaaggatcgctacgccagtttggatcctcaacaccccggcgtctagccattgacgaaagccggtaggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattagcgccgaaagttacatgcctgatcggcgccgaaagttacattggtcgtatgcgccaaatggtgggcaaatactcgtatcgcacgcgaataaaggaggctgcatcggtgcggcagaaagtagtcgtgcatgcgccgaaaggtatcgtgcacatataacaacaacgtagtcattacacaagcatacagtactggaaagtgaagcaaataaacaaagagaagactgctctactggccctgccctgcgccgcgaccacgcttggtcctccgggcctgtgctcgcacgtggtcctggaagtaggtgaaacgatccggtggcacagcacgggtagcacgagtgtctggcggaggagtggcctgcgcctggtcttgcgtctgcactagcggtgcgtctcccagctgtgaggggccgatgacgtcctctgtcgagcctgaagcgaagtcgaagagcaaggtggaaggcagcaagcggtccgacgacggcaccacagagtacctatcgtagggtagtcgacctctggtcgctcctcgtacagtgactcctcgtacacgtgctggtccacctcagggcggccgatcgcaatcctctcagttgcccagatagaaagaaagagagggcacccaccaaaggtcgcactgggatccgtcttcgtgcaagcctcacaaagtgcacggtacagagccgccaacaacgcggaaccccagctccactgaggcacctcgcctaccgcggcatcggcgatgctcctggcgtagtgcacgagtcccttgtcgaccgcgtgcccgtgaccgccacagaacatcacccagccaaaaagctagagcaagtacgcctccaaacagcggctgtaggagtactcgtcggcctccgcctgtagctgctcgacgtgcaagccttcgataaaatgttaggcaccttaactgtggactaaatatgtaacacgcttgtcatttcagtacaaaacactcacgggaactgaagcagccacctcttcgtaggtccagtgttgcggtggtgagccaacggctcgagcgggaggtgcagtgtgcgctgtactagtgcgaaatgtgccgtcagatcatcctgccagtccacagccgtggtcactggcccaacagcgtctcccgcgagcggtagccccaacaagtacgatacgtcctgtagggtaggggctacctcaccgcacgacaagtgaaaagtgtgcgtctctggcctccatcggtcgaccaaagctgcaaggagggacctgtccacagtccatcgtctggccgggtccgcgtcgccggcggtagcctccaccagccgacacatcggtaggaggccggcctcacgcaacctgcaataacaaattaatatgtcattataaaaaatattacagtgcaactaatttatagtaatacactgttcgtacctctcgacaaaggagtcgtgaaccgtgagtaactcaccgcacgtccgtgctcggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaagtagtaatgtaaaacaaaagataacttgcaaaattatgaaatagtaataaaatcatgagaataattatgtacaacaagagtacatgctatttaaatatagcaaacgttactaatggtacataacgatgacgtgcaatttaacatatatgtagagttcgataatataacataacattacgtgtcgaagtccgacatacatcagcatacctaaagacgttaggcgccttagtttgacgttacatcacgagacctaaagacatgacatgccgaagtctgacattacacgacgaaacataaacacatcgataagttcgaaacgaattacaagcaaaaccacatgccaacatagaacataagaactacaccacgtagccagacgtggcacgacgatgcctaggacgtggtcgagtggaggtagtgccttcacccgtagggcgagctctatctgctgctgatcctgatagtcctgcctccgccgcacttggtttctccttgtctttaggacaatgcttgtaggtgtgcccatgttcatcgtatttgctacaacgcttcaccctgccagcctccgactcgtccatatcgttgcggatgcgacgagtcctcctccttctagccttgcctcggagcttcgatgggtcaggaatattgagtacttcatcgttagtctctgtgaactccccagctatgccgaacccataaatctcgccgctccatgtatgatatattgcttgcttactgaagtactgtaacacatatactgcatctggtatgccacactccgctgcggcagcaatgacatgggtgcatggcctgtggagcagcttcggctttgcacaagagcaatgacatatgccgtcggctttgagaacacactcctgcttcactctcttgcggtagatacccctgcctgccttatcttgacatagtatctcaaacctgtgctgttgggtactttgcactagagctcgatgtttcatggcctttttacgcaactcctctagctttttctgcatgaaagttccaaacaaaatgctgttgttcggcatagagggaagaactgcctggaactgatccctaaaatacctgcatgtcccatgtaaaatgaactccactatgccaactagtggcagtccacggacaccgcgcatcacccagttgtaaacttctgccaaatttgttatcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactacatttggctgtcaactcatctaatctcttccaaagctcattaaattttttctcctggttctgattgcacagcctcttgaacatgttcatgagctccttgttcttgaattgcttgaagaaattagctcccatatgacacatgcaccacctactctgtacatcttcccaaacaccatggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacatttcatgaatgccatcttgcatgcatgtagagctaagaacgccctttgcagcacactcttgccaggatgttcaattgaggggaatttcttcacttcgtaagagctcccagggtttctttcctcgataacaccaagcaggcgtagcaaattgtcatacgaggcttcgtaagttccaaatctcatatctattattttctgtttggcccaccaggccttggcatagctaatagtatacttgtatgtctctttgatgtgtcggattattgaccttggttcatatgtgagattatgggg

SEQ ID NO: 40199 - DNA, 10755 bp, Oryza sativa
ttatacgcgtgcactctccagggacaaccatctttttccttaacacaccgaacttcatattgcgaccggttcgacttggcaacccaaaactctctatgaagtgacactgcaaaatattttaccgcctccttcatatcttctgctctactataaatcgctccctgaataacctcattttctttgtactcccatctcacactatcctcttcagagacgattagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaattctcatttacttcagcacttggtccctcgccatcatccatgttcatctgcacacttggatccttcgggtgaacaaacggaaccaaagctagaggccacccgcgttgcaatgcattttccaaataccatctccacactcgagagttttgaactggcattagttcccaataaaaaccctcggttgtccgacttactataacattgattgttatgtcgcttgtctgtggatcaattctcaagcccctcattaaccatccttttatagaaggtacactcctctcagccggtctatcaattcccctttctgatacaataaaatctgacagatctaccccagttggcccgtaatggacgtttcctggtccatggtaaacttggaatatttgtttgttcgacatatctgtcaacaaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatttatgaatattacctgaaatcggcgtctgaatccagcagggcttcgccccttcttctcttctcctcccctctcttcttttttttttcactggatttgaggagggaggaatgagggctgggggctgggcggcaggccttttataggcagcgagacctgccagagggcggcaaggggctttcttcaaaatggcctgccccgactggcttttttgcattcgggccccttgccgccccaccagagagcggcaagggtttttctgcaaaaaaaccctccctccgtcaccgcccgtacctcccccgtttgccacgtcagctgccaccccagaggtgggtggccgggtctatttttgtaatttttttggccgatagattatttctgtaaatatttaaaaaaaatctaaaaccgaaaaaaattcgtcgggtcgcccacgacatgaactcttcttctctttctagtacagaaccgggggtgttagaaaaaaaagagaattctccctaagccaagccgaagatccggcggcatccatgtcgtatcgctccctgctgcacaagaggatcctccccgccgccgccgccgccgccaccgccgccgccggagctgctctccggcgaccggcggccggctctcgccttctccaagcccgacttcaccaggttcgcctcccgctcacgaatccgtcttgtttagtgtttaccactagtagttttgaatgcggctaagattgatcgattatacgttgccaaaatcgacctgcgtcaagtcgcacaatatcagatcgatctatgcgcttttcccgggtagaatttggtacctcaccagcgtggtgagctagcgacgattggggattggggattccatccacattcctacagtgacaggtcttgtcctgttattactacattaagatatacattgagatatgcatcaatgaatgctatatcaatgaatgctcttgatatcttgttaggttatcaatgaatgctcttgatatcttgttaggttttggattggaacatatattcaacagctactgtgaatcgatagttcagggtctgtttactttgatgcaaaaaaaaaaaaaaccttaccaaattttagcaatgccaaaacttggcagcaaactaaatataactattttttttgacaactttaccaaaatttggtaaggttgaaaatggcatcaaagtgaacatgacctcagttactttcaaaaagaaagcatacatacagagtgcttcgttgtcaaattgttaatatcttagctcaaattggtgcaatatactcacctctaattttgccactatttgtttgcagggtaatggaaggcaacgcagcagcagtgcatttctgacgctggttttagagacagcgagaaggatatcgatagggaaatagaacagctcgctcaaaagttcgaagaaaacagcaaacggtggaagcaagaacgggaggagttggacaacctcaggaggtacacctcctcctaaacatcttgcaattttcttttcgtcatatgattcaatttaactccatcgaattgactattatatacactacttcctttgtttcaggttataagattttctaacattgtccacatttatatagatgtgtctagattcattaacatttatatgaatatgggaaatgctaaaaagtcttataatttaaaacagaggtagtaacaatcataaattaatctactgattctctttttccccctccatgttcttgtcggagaaaaggttggatttggaagagatagagaaatccagagagagaacacaaaagattttagacgtcgccactggtgttagtgctgggtttttcctcgtgggtattgcaagctataataatctgatatagcttaatgagatgttaccatcggaggcatctgtttttcagtttatattgtaactatttattgtagtattaataaatgttcagtgttgccaggaaggtggaaatgccttgtcttctttacctactttatttatccgtcctaaaatataatggattttgggtgtacgttcttgtgtatgtggcgcctcgagaatcaagctacttgtactcttgttgtatgaggtaatataggaatttgccaagcatcatgtgactgaccatgagaaccatcttaatttagcgatggctagcttctcttctcaggtgacggtgatggcagccatcaatttctcgaacaaatgacccaaattagggttcagagttagggtggaggaaggtaagtagggactacggattgttcgggtgtctatactactccctccgttttctaatacatgacataattaatgtttgatacgatgtttgaccatttgtcctatttaaaaacttatgtaaatgttgtttattttgttgtgacatgtcttatcattaaaaaaaacatttagacgtgttttatactttaacatatttgtcctaactttttaataagacaaataaccaaatattatttttataagtcaacatcgttagctattaaaaactggatagatgtagtataggaggttgaccagcggtaggtgatggacacggacatatgcttcttgttccatcttgatcaccgggactgcaactgaatcaccttaatcctcttactcgcacaaccatggttgcctacttgcccaagtatcttatcactaacgctctaccactagctttgggctcctcccttctattggctcataggatgaccgtgacttgaataaaacgaatggtcaaatattatgtgaaaagttaatggcgtcatacattttgaggaggcactagttattacaaattatacgtatgacacggtattagtagttagcgctgtctatgatgtctggccttgcagttgacgtgggcaatgaagagaagcagggcggtctgtaattcgttgcttgtatgaggtaaagtatgtcttagttcctgttttatagaacttttgatccaagattttagagctggttcatagctttataaatttatgaatatggatttacaattacattgataatgaatcattttgttcccattttacataaaatataaaattataaacctctgcaatttcacatctattatgcaatattgtttccgaaatcttttgatatgtatgtatagagggtgcattagcatataattaagcttaatttctgaaagatgtgtttggagaaaacggtctgaagaagagacgcgccttcaacatatattacgacgactctccttttccttttgcttacttaattcttgttggtaatcttcaatgcatatatcaaatagtttgtaataacgtatggcttgaacttgtcgtcacagctaaaaaacaatggcacgtggaggtttactgaaagttactaaataccacgaaggacgggctgcgatttcgtgattgtctagctcggagcgatcgagttgaaacataaaacagaaaagcaaatggacaactcgctgcagcgtaaaattgtcgagcttattcatttggactctaaacaatcttttctaaaaataaaaagaaactaattgattctgcctaattaatagataaattgctatgccatatccttcttaaatttggtctcttccagataagctttctttattaattgattaatttacttaaccaaatccactaagaatatgactgctggtgaccttcaatcaaccaatctctagaactctaatactctaatactggtactgactctaaccgatgatgactttggaggttaattactaaatttttgtattaatacgtacaagccaggagtctatctaagacttcttctttaaaaagcttatatgactggaggaacaaatattgagaaaaatgaattcaaccatcgtactcaataaatcatatcggaaaatgcaagtggtacaaggagtaatataataggttgaggttttgcataaaggcaattttcaaacaggcaaggtttaaagcttcaaagcacgatcttaatctattcatattattaatcagcacacctgcacgaactttgctttaactcatgccatcaagttgtagttccaaacattctagtttaacatagtaaaatctctaacttgggtatatttatttttagggttgtccataaccgattgttaatacattataggatccatcaaaacgtacaaactgttgtgctaaatgttagccctactcaacttcaaaacgtacattttgacttaacagagttctctctggtggtctgtcctcacaggacctgggagagagaatggtgatcacaatatctgcatgttttctgcttgatctatctatgcttatgcatgtttatacttcacatcctgcaaactatcccaaagcatttgctgtacgtagtctgcagctcgatctgtgcatttcacctcgtattccatcacatgcatgctttatcccattatctctatgaaaaaaaaaaactggcaagatagtcctcaagttatatatatataaatcaacatttgttccaaactaagtgcgcatagatatcataagtatatagagtgctcttacagaagagatcgagtgcatatcagatacatagccacaacaaaagatcgagcgctctcccacacaagacatcagagtgttcttacttcttacttagagctgaaccataagacaaactggctaaccagagtgcaagctcttacatgatcatattgcttaattttacatagccatagaagcaaattaattgtagcacagaaaataaaaccagatagatgtttgtttgctgctcgcccttctctgcttgactactgtttgatggatatttttaccaaaatttatagaaaaaatgataaatcattggtcattaatttcatattcgaatataatttgccgcccaattttccaaaatatatgtgaagggtgtctttgacacgtgggcccaagaaaatcaaatacaaggcggcgttcaaatatattaaatattggactcggtttgttgtataatttaaatagaaaataatggttcaaacagattttaaatccgatgtacaattcaaaagatttgagccatggaaagaaaagaaataagcaagtgctatcgttacttgctttggtacgtgagcatgcagtcattatctctaatttggagattaaacgcaggaggcccactgtcattagcactgttaattctaggatgatttaatcggcagtagttatctcgtgcagatcggtggattagtacgcctgtttgctgtcttatccaaggaaattcacgcgtgatttgccgttgtattcggacgtggttgagagtcccagcctgatctatccatccctacatctgcctataaagcaccttgactcccactgctcggggggctggcagatgcatccatgcagaagcgctaaggcgctgcacatacacgccacgccggcgccgccgacgctatgcgctgcgcagggacgcaggccctgcgccggtggccggtggcacatgcacccactcaattctcggtgacttgccggcggctcgcaagcaggcgcgccgtgcagtggagattaaacattcccccatcgagctgatgtcgcaggcggagatgatcgtgctaggcggtgagtacgatgaataatttcctccaatcctgttgctaaatcggtcgttctaatggatgattggagtacctcttttctcctcaacaattgaagtgcgatgaaaatcaaatcgcatctgcttccttgaaacataaacttgggcatgtctaatctacggatcggactatcctcgtatttttttataatcaaaacatatgttttacggtgcacatgccgggagcgagccccaaattataaaacaagggaaggagatgggagaaaatctctggtgctgaggcggctgacagaggaggagacgtaggcaggcaactctgctgcgtgctctgatctgcttatagttccacaatcccatatccaacatctacacaatttacaagccgtcaccggggcgcacacatgtacacgccgccgccaagcgctgcgccaagatgcaggccctgagctggtgatgataaacattatagctacacaaatatttgggaggaatcgggagaaggcaaagtaatcgtcaaggagtctgcttcatcatcgctggtgcaactccaaattaatcattcgccttctgtcgagccgcgcttcatcaacataatttctccgtcaagttatttgtcatcgacaacacaatggcgccgtagtgctgtgcagatattatgcatagcccgacattgtctcctagagggagcaaatatacaccgtagcgttgtgcagttacgcagtccggacggtaaaacagtaaagtggagtactggtgaatatgtcatggatacgttgtgaacttgtagccatggatataagtatccccaacggcgcatgcacatgcacacgtcatctttgtcaagcaattaacatgagctgcaaataaatacaaggcgagcctgaccctcgtgagggttggaccgtctaaattatcaatatcaaatattggatgtggatatttatttatataaacttggaatgagtttaagtcttattggcatcagaccaaccatgatatatacatatttatattcatgccggatgaatcacacattgcctcgtgcatgtcatgtacgagagcaatttcttctctctctaaattctatcagatggatgggggtgattctcaaaattcttgaagacaacaaaaacaatgctagccaggagggcgaggcatgcagattaaaacacacatctacatcatggccgagtgtcgacgagatgaaatggctaatttatcaatatttgtgctatgtccgagaccgacgaggccggacaacatattggctaaaagctaacaaagctatagccattcactcatttcatttgtctatgaccgacgaggctagacgaaatcatggctgagtgccgacgaggccaggtcactatactattaacacgtctaaaatggacggagccggatacaccgttgctgggcaccgacgaagcaaaagcaaccacaaaatccatgtttgatgaaggccgggatacatgactgagcaccgacgaggcaaaagtcacccgcttcaccaaattccctccacacaccgacgtgatggtagtgtattgtgattgggttttggcaaaacaaagccacccattacatattcactatattcaccattaaatctgcaccaacctcaatcttgggcgagcaaataattttgaagacgacgatcataaagcgcagcttaatcagaggtattccataggctcgtcctatggatgtaattaaccggcagcctcattgctaggcgccgggaatcagcagactgcacgcaatctccagttagcatacctttccattaagcattcctcgcgaaggcaaaaggcgaacttctgtgggagccctcctatgtattttgtaaacattcatgttaatgaatcatgattaataaaatacagggtttctctattttctgtgtgttcgttgatttgttttcatcaaacaactacatgtagacacgggcgaaaagatagcacccaccacaaaacccaaggaagttggcaagcctgcaaccaacgaacagatccctcctcatcctcttctcaaatgcacggacccgatctttcatcagccttaattaaagagagggaaaaaagaagaagccatgagtcacatttgtatagttgtacccctataaaacagatcttggcagctgagcaattgtacctctataaaacagatcttggcagctgagcaattgtacctctaagtttatctctaaaatcagacttcaacaaacatactccctctatagatgttaatgaatctaaatacacatacatgtctagattcattaacatatatatgaatgtggacaatgctagaaagtcttataatataaaacggaggaagtactaaacacacacacatcaagtttcagaaaagcttagctgctaaagtcatgtttgctgaagtaatgtgtgtatatcatagtttatttttgttgaaaagagcaagtcagaaatctgcatattcaccaatatggttttaaaacagcaatatccaaatgctactcttaagtttgaacatactcgcattccaaacagtgaatgcgcgcattgaaaagagccatagcggcacagaatttataagaaaaatatacttaattattttaagtcttaagcagtgttgactgaatttaaaacttgttacaaagaaatctttcaaggttaatagaacagatattaaacaggtactcacattagagtccagttcttcagtaatttatctccaaggtctgagactcactgtacttcaaaaattagttgcagcccaaacactctgcagtaatgctgagacggttagaatttttcctagcttgacaaaagattaagcctgctatttgaactagggaaacatatgcagataattaataacttattttctcacacatgcagaaaataacctttttttctcacacatacaaacaataactttttttcttctcacaggtggcatagtactacttatcagcttattcagaaaaaaaaatctgagaaacttatagtgtgaatgatcgcattgagcaaagcttaagtgaacgtatccgccagcaggatttaggaactgtaaagggcacaaatcgtatgtacaataaaatttaatctttttaccaaaatagatatgccaagacgtatgtcgttcatagctagcaaggtcaattttggtagcacagaaaaacaaaaggctggttctgcatcattaattaaccaatgtatcaatcacacaaggaaaacaggggaataaaagagtagaacctacaagtcagaaaaaaaccgacgtcgacggtaaacagcaaggggtcccaagaagagaagcggctggttggccaacgccgatttttgaatgggtggcttgttctcctgccagatgacgacgctagtgtgcaaatcaatcatgactaaaataaaaaaaatgattatattgaaaattcactcagaacaacccagaaatgatatcgccaaattcagaaatattcagaggaatgctcactcaggcatttttcattcagccttgtgttctgatgatagaagaaacatggtttatagagctgtttcacaatgaatatctgctcaatcaagaggaagcatttctcattagttttagtacacaccatgtttagagaggtgatatacgtttttagaagctgaacttcaactgaaataatacatcaaggggttagaactgaattgagtatttttttattattattattttacctatgctgcaatctaaacaggcaccccattctaaataatctgaaaactcaacaatctaaacaggtttcccattataaaattataaaacacatgaaattggttgtaccttcaattcagggaaggaggttttgcgagtgcgaaacacctgttcgtagtgatatgggaatagataatggtggcagcgccgtaggctgaaatgacggtgagacggccctcttgacagaagagtcttatactcaagcaattccttacactgatgagatgaaaccaattcagggagaaagcttaaaaaataaaatactgatgacatcccatattttagtggtgcaatcaatatagaaaacattgtcattatattcatcagaacttggacatgataatataccataatgattgtttt

SEQ ID NO: 40200 - DNA, 10565 bp, Oryza sativa
cgcggagggaaggggggactcatctgggccactcgattatttgtagatgaatactgatagttggatttgatgaatgagtaatgtaggtgtaagaatgagttggtgcaataaagttttgttttgtttaagaggaattttactatccttgaggagtctcaaggtaccaccaggtatctacctccttaatcaattgatatccaccgttaattcacaaaggttaatttagggacaaaatttattattaacaaggatagcttagtaattgaccaatcaccggttctccatccactgccaagcgttcacgatttcctttccacgatttcagtgcttaaccataatcaattccaatcccaattgaacgagctcggaggcaaggagcaggggctgcgcgcgcgacggcggcgaccagcaagcacgtgcgaggcggcgaccggctagcgcgagcaatggctatgaccagcgtgcggcggcggtgatgtcgactggctgccgcatacgtcggctacgatgggcgggcgagacgggcgcgtgcggcggcggagacggcgaccgactgccgcgttagtttgctgtgactggagggcgcataattcagcagcgacctcagcgtgtgtgcagcggctgagaccggtgggcgcgtgcggcctcggtgagcggcgggcgcgtacggcggtgacaagacatatcggtaaaagtattacataaacgtttaactacataaagaagcacaacgttcttcctcctctgctgcatgaatgcagcttatcttgaaacggataggagtaggatacagatctaaaaaaaagacgattttgtccttagccatacaaatcaattataaaactcaattaccattttaacctttcaccttacatactttgcccactcttttaatacctttcttctagtaacttctctcttggagcgttagatcattagagatcaacgatcctaattaattccaagtatagaagaagatctcaccatttaaatataaccgtctatttaaaaagggtaggattggaatatgtaattgccagctcctgcttgcaacaccatcgtctcaaatcattcgctatatgttgcgccacagttatagatggccaaatgagccacccagcccgacacggcccaataggggtcggggcaccatgctgagccagtccgaaggcacggacagcccatcgtgctttctttaaaataaatctatttcccctccctcttttttgggttgtgacatatatatatatatatatgtatatatatatatataattttctaataatctactcgaacgcccatgtgttctccttgcggatttcctcctcctccggcgtgaagtcgttcttgatcccaaactccttcctgatctgctccggcgacttgcctttgatcaggttcgccgtgtgctggcagcacaaatccagcaagctcttgatgttcaggaaattggacgccaggagcaagccgtacagcatgttcttgtccacgtcgatcatgaactcggcgtcgaagctcttcagctccttctcctcgtcctccgcggcggcggcgtgcttgacgcagtattcgatgaccttggcgaggaccttggaggcgacgttggggagaggcaccccgttcgtcgtgcagtcgttctcgatcatgttggagacgagctgcgacaggctcgccgccgccgacggcacgttaaagtgctcgccgtcggagctgattaagaggatcgtgtcgtcggcaacctccttcttgtctgccgccattgatctcgctactttgaaacacggacggacgaaactcgcggattgcaaagctcaactgtttcttgtctttcttggaacgtaaacgttgggtgtgcttggatcatggcgagagaggaggtggtgtgtttttattgcgtgaaaccgcgcaaaaacaactcggattcggtcatgtggagtcgaaatccaatccgaattcaattgattttcggtgatttccgcgttagtttggtgtacgtacgtcgtcgagactcgagagatttttaactggactgatcttcggaaccttcttccatagtctaattagactccttttggaaacgagtactctaattatttctcgatattaattaatttacaattattacagtagtaaaatgagattaaaatacgactcctactcggagtttaattatctcacgctgctttatgcaataaatacaatcacgccgcgaggttctatctgattaacaccaaactttccaagccatcgaccaaataatactacttcaggattagattatcgtcagaagttcatcaacaatggcggcagcagcagcggaggccacgaccgatggcggcggcaagatgatcatcctgatcagcgccgacgggaaacgcttcgaggtgacggaggcggtggcgagccaatcgcagctgatatccaacatgatcgaggacgattgcacggagaacggggtgcgtctccccaacgtcgacggcgacatcctcaccatggtcgtcgactactgcaacatgcacgccggcgacgccgccgccgccggcgacaccatgaaagcatcaagcacggaggaggagctgaagaagttcgacgccgagttggtgcaagccctcgagaatccggtgctgttcaagctgatcttggcggccaatttcttgaacatcaagagcttgctggacatgacgtgccagcgcgtggcggacatgatgtccggcaagacgccggagcagatgagggagacgttttcgatcgagaacgacttcacgccggaggaggaggcggcgattcgccaggagaacgcctgggccttcgacgactagctgtagctgcctacatcatcaaatttaatctaagcagaatttaggcatatatatatatgagattttcttagttttatgatttaggtgttttatgctaagtaattaatcgcttagatgttttgcttattatagtactgagacttcctccggtgcttgggagttatggtgtccgttgattacttgccagttgccatctaacggtctgtgataaaaggtatgtctcagaaggtataattaaaaaaatgagcaaggtattaacttgatgattaggtggaaggttagattgataactttagtttcatacagattagagggtggggctttaatcagtaaaagaattaggatcgataagccctgcttgctgataagaacagctttcttcagcaagtaccatacggacgaaacgccaccaccactgatgatccacaatgaccatgaattttgtatacatacacagattcaacaaactggttgatcgagccatacttgtctttgtgtatggacgaaagaggattatatttgtttctttggagtctaaatttagatgaggacctgaagaatcaattagggaaaggggattttggacaagtgttaggatttatgatctcatgtactaaaacgcaaaaaaaaattgaattacctagaaacgatgcgaacgacagaatcggagataagtaataacttgatgcaaaaaaagagatagacggttacatgtaaaaggagttaattatcggtgtttattaatgttttctattcctaagttgcccttaacagatcaacggtgggtgattaagtagtaagggaggtaccagaaagtagtaagggaggtacctctggtacctctcaagcaccttaaaagctctctatagtactatgtacatttgtaatcttttcgaatcctaatttatagagatcttcttctgtgcttggaattaattaggatcgtttatcactaatgatctaacgctctaagagagaagtatcaggaaaaatgtattaaaagtgtggaccaggtatggaaggtgaaaggttaaaatggtaattgagtattataattgatttttacggttaagggccaaaacgtctaattttcaataggcaaaatttgcctcagaacactcaaaaaacgtgtaattggctgggagacaccacgaaaacgtgacacggctgatagacactacaaaaaatgtgtaattagctctaggacaccggtcgcattattttattatttctgggtcaaaagaggtgagatatttttctaaattcctggattgccccttctctttccttccttttctcccactctttccttcttttcaccttcttgttgatttcgccgagaacggcatagcagcctcaaagccgcggtggggcgaggtcggcgcggcgtggtgcggcaacatcggcggccagggcggtcgatggcatggcacgaccatggaggcgcggtgtccagctagatcgatggcgggtaggcgacgacagtgccggtgtagcggggcgcggctgagcggcagcaccaagcgcaggcggggaggctacgatgggtcttggcatcacgacttgggtcccggcgtcaccactgctcaccggagaaagcggaatcgaccatggcgatggcggcgggttcagatcggcgccgatgaagaaggggtgtgatctccttctccggcgcaccatttttcggggtccttgaggggagatagagaggaggatgaggcggagatgctggcgcgacagcttggcccggcttggtccagataagcgggaacggcgatgatgtcgctgcggcggtgcacagagcgcgctccagagctctggtgggcacgacagcgttcccgtcgattggctgcacgaatcgagaggttgtcaaagcgagatttgatcggcatggagagaagataatagaacatgaattagataggaatggagacagctcgttggtgatcggcggcgccctccttctcggcggtcgacaacaaaagagagatagagagggagagctggagctctcttcctcggatggcgatgcagcagggacgagatggcgatgcgtcgaactcagccggcgccgatctctctctcggctgtctctggtcgatctctctcccgtcgcacgcccaacacgacgagatgaggaggctattctccaggttcggcaagatctagagggagaagaagataagggcaaaactgtcattttacgttgtttctctctcatcaattgaacaaatattatactataatgtgtccagtgtcctgcagcaaattaccacatttttttagtgtcctcgggcaaattcttgttttcgtggtgtcccatagctaattacatattttttgagtgtcctgtagcaaattttgccttcaatatatgtatatccttcctatatatgttctgttctgtattccatccattcgtatcgctgcttggttcgaggcgtcggtggaggtgacttaggcgctgaggcatagggggagagacggaggcagacgggcaccccttacagcgtcgacgaccgtgagctcggctcacaggatcgctagctcgcggcagccgcccgcgccatcgccgctttggagctctcctcgtcgaagccggacgcacccaccgatcgcagccgctgcacgcgccctggggttgccgccgccgtacacgccctacggtcacagctgactaatgtggcagccggtcgccatcgcagccgccgcacgcgcccgtagcgcccgccagtccaagccgacacacacggcagccggtcatcgtcgcgccgccgcatgcacctgttgcgcccgctggtctccattaccgccaccgcatgcgcttgttgcgcccatagcgcccgcccgtcgccgactcgccgtcaccaccgccacacgcgcccatcacgcccgctggtcacagccgccgcgcacgctcccgccggtcgacgccgtcacacaagctgccactgccactaattaagatacccctgttaatataattttttttcctaaattaccctttatgaattaacggtagatatcaattgattaaggaggtacctaaggtaccttccaagtaccgtaaaagatctctaatttataatatgcaacaaagttagttttgttttgtttgagaggagttaccatccttgaggaggtaccagaatgtgtaattgccagttcgtgctcacaacaccatcgtctcaaatcattctctctgcgttgcgccacaattatagttggccaaatggcccgcccggcccggcatggcctaggccaagatttgtcgggctggcacggttcgacctacacaccaggtcgtaccgtgccggcccacgtgctccacctatggcccaggcacccaataagggtcgggccgtgctgggccggcccgaaggcacgggcagcccatcgtgctttctttgaaataagtctatttccctccctcctctttgggttgtgacatatatatagctaaaataagtctattttacgtccctactctttgagtcgtgccatataatacgtcgatttgtcttcctattctctgtgccctgtcttacatatggtcgaaagtaagtctatttcacctccttgaacttcatgtcgtgctaggccggcccaccatgatgaggcataggcccaggcacagcccaacagctgggccgtgccggcacgggcctgacagcaatcgggccttgccgtgcctggtccgtgccatcgagtcaaaacctcgtgccttgggccaaaggtgggtaaattgaactattttgatatttagagagtgttggatacccggttttagagtttgctatgaattttagacctagacaggacttgaagggtgtaaaatggattcatccctatttttttattacatatatatagaaatattaataaatatataattttatttatgctatttttagactaaaactaatatagttctccttatttctaacacatactttacatcatgatattcatagtccaagtctttaaaactttgacaatagtctttgttcaagatgacaagtattatgaacccctctagaagtacaaatttattgatactctttcttcctaccttctactcatttgttttctgcgagtaaacttcccgaatggctagatgtacaacacgttttttcgcaaaaaaaaatagtaaaattaattttaaaaaaatcatattaattcatttttatgtttttctttaggaccaattgcatatttgccactcgattgaaccggtattgtgaatatgccattaaaaaaattgcaattgcaaatttgccactaaaaatgatttgaaccctacctacctgccattggattgacggcatgagctaacatcgttaaaaggtataaacattatagcatctgaggcaacaaacaaaagacaagaaacatttggctaaggctccatagcatatcaaatggatgctaactgaatttaattctccttcccattccctctaatgctaacttaagtggcaaatttgcaattcatgtttttctaatggctattccgagttagggggtggaaagtagtgatatatttgcaattctcccttttctttaagctaagacttaattattcatgcgctaatgagccaccttgttttacgtgcgcgggaaagaagcttccagcccctaccactaaacacacggcctaatactggcaccttccatcatggtttactagcctgtgatgtcgcgcattcgcgtgactctatgcctcctgttacatggtacttaggagtggcaatatgtttttatgggtttctcatcgctcgtaaaaaatataggtcagaatgactaatattatgctcatacaatagatagcttaatatttattacaaattttgtatctgagtgagtcattgttttataggttttcacgttgcatgaccccttattttgaataagcgcacactatttatagcctatgctgaaatattttgtaggtttttaaggaatgaatttgatttcattttatattcatgtgaaaaacattaaacctatattcgggcgatatgattgtgcatgttcttgcagcaatttttgcctcaaatatgttaacaattaattgttagaaacaaaattaatcgtatgaacgcacatttgtatatgttcttaaatagctgaatcttgacatgtgaatatttaattaggatgagggtttatttgtaaaataatttattttattacatgagcaattcataaattatttgcatcctatgcctattctctagcttttttccccttccctctttctttcctcttctagtagctttatctccggaagcctctttaattattatttttatcatccatctaatccaacggtccagattcatttattctcaattcatcaaatgatgtcactcatcctcaattcattttgagtttcacttttcattagttaagatatcgatagctttagtgttggcatcttcttgcttgatgcaacaatactactattacttaagtaatcatgcacatgcaacacatgtaataaccactatgatttaaaacaagcatattgcccatgtaatgcaagatttccgtcatattttatgtaattcagaatccataataaaaaaggtaaatcattcatgatactatattgaaatttaatgtaccaacaatacacataagtctctatataaaaatacatacaacatacaaaaggatgaggatcaatggtctccgaactagcactttacacattgttgatgcaaaaaaaaaataaaaccctggcctaagagatttgcttaactctagtgaaaaagcttgccttcagacctaaggcgtgccaattggtttaatactgcaaccaacaagaaacaagataaacagttaaatttataaacgatagccaatcggctggagggctgatgacatatcgtctttaacctagccgatgcaacctggtttgaatcagctgtaaggtgtagcaataaaattaagaccctaaattcatgtcatcagctgtaaagattaacattacataatctatgaatcatcattacttgaaataacagtgattgggatagatagaacttaatcgagacagtataaatcacttgtatccgaagttatatgaaataaagattatacgagttcatgtcatagctgatgaaagaatttaagcatgtatcggctatagcttcaatacaaccttatactggaatattactctaatataaatatattgaacaaatatcaatctaatgttttttttgcggggaaatatcaatctaatgttagattaattataacaagaccgatgataagcataatatatttagatgattaagattccaatataagggcagatataacttgtaaagcaatacaaagcaaagcaaaacaattatatcatgtaagatcggtggaaactccgattctatccttaattacaatcataaagtagcctagagattatggttctaaacatgacttagtaggtcgaacccaattgatgcaacactaagtgtatagagaaacataatatctagacaatcaagatgatgattgtttttcaggatggtggatatgttatactaatctaagccaacaaagtaatctagccgttatcgggaaaaccctagaaagtgatcgaccaatataagtacaaagtattgtcaatctagattatataacatatatgataactcgacattttacatgagcaagattagagtgtcataatgatgtaagcacaaatcccgaaaatgctaaccaccataacaagttttacctcttgtcgaagatcgtaatcgatgcagcccaactcaaaagcaagaactcgtcgaaaagtaaagtaatgaaaaggtggcgatgcgccgagagtatatatttatacccaaatacataactcatccataacggacacgactcacacttcctattacaactctaaccgacgaacaagtcccttaggtggactcttaataaggaaaatacttaatatcctaattaatggatacaatttcctatctcggactctatccttgcccagcaatatcattgatgctcttcattcaaatccgacattgattatgagaccaatcttgccaatatcggttgtatcgactcaccgtgttcaactcgatatcagcctatacagacttccagccgatgcaaactctgcttccagaaatatcgcatctcttccaaatctaattcagtgtttatctccaaatccaatccatatattaccaaatttggtcgttaactcatatcttccaaactatgttgatgatggccatagaaatcgctaagtggggaacaaaaatcttcatttaccggcccaccaccgtcatttgactttttcatattataagtaatttgactttttcctagtcaagtttgactaagcttatagaacaaaatagcaacatctaaaatatcgaatttgtttcatttaatgtaatattgaatatattttgacaatatgtttttttgttgaaaatactaatatatttttctattaacttggtcaaacttagattgtgttttcgagacaagaagttttttggtagagtcttggaaaattctataggtcacatatttcatctatttgagtttaacttttctatggttggttcttgtgggctcctaagtgtgaaaaaaatatcaaaaacataaaataaaaataaaaaagttgcacgtctctcttctacactagagaggagaggaaaaatatggcatgggtagagggtgggggggggggcggcgccagcctcattggcg

SEQ ID NO: 40201 - DNA, 4832 bp, Oryza sativa
agaggtctatttattaaatatgtttttcaaaaggaccaaattgtgaaacatccaggatgggagacggcctcgagctgtcgagcatgccggccggtcacctactagccagcctcggcggtgcgcgtgaagagcttcttttatgtcctcgagggccatttttgctcgcctccacctcacccacatcgttaacattttcttgcccattccgagtgaagcttctgctgcttcgatggttcaacgtgctcgactaaggcgaggtggtgcgtggcacggatgtttgcgagacggcgttcacggcaagcactagatcagcgaggatggcatgttcagcaccctatgctgcaatatgcgtgccacgcccggtggccggtggcggtgatcgccaatcgtcatggcgaggatggcgagcatgcggacatgagcagcgagatgacaatcgaagacgcgctctggagtctagactcgctcgacgacgtcggctggcgcgcgcgtacacgtaccggaatcgcgcaaaggaacatcgatcatcgtaatggcggattccatatccccacagcgcgttcaacgtgctcgacctcagcgtgtctgacttggggctgatcctggccctccttgttggcgcgcgcactcgtgaggcacagcgctgccacatcggtctgggactgggatggcggtcggtcgttggcgtctcgttccacttccacgctctcagaacggatcttggggaagcagagcacgtacgtgccagcgcccggtgaggtgtgtgagtactggatcaacgacgacaagttaattaggcaccctgtccctgtgccggcgctgtgcgcccttcgaaaatgatcgacgtgctgcgccaggtgccggtgatcgccactagccgtgcatggcaacgacgatgagcagcagctatgcaccttaaccggccggtaatggtgcaagtggagcaggctacgccgccaacacggcttcaattattttcacataatcactgccctagaatggaactaatagggttgacattgtagtttttagttcaatcgtcatgctaccatataattgctgcttcagtaattgcatctcaaacagcaacttatatggaaatgaggcccaagtcaatactagctcaatacagaaaaatagaatcaaaatgctactccatagagcaaaacatataaccaaatttgtttaatccataaacaacaatagctcagtacagaaacgtatgctatagagcaaaacataagaactacgcagcggttgccaccacctcctgctcacgagcgggctcgctcctcgcctcctcacgagcaacacgatatcgtcgctgcatctgccgcatccaccttacgaccactgcagcagttccctagataaaactagttatcatttatgattcatcgctcttcttgccaccaatagaagtcctatcattgtcaactagtatttaatgagtttggcccagtcgatcgagcccagtagaagataaagtgccccatgcccgaggatcgtggtgaaggtacgggcgaaaaccatgcgtcgcatcacgacatggtaaccccggagcttggccctcatgtcgtcgtgggagtgaaggagaagatggaattttttttatcaaataccctccattttcattaatagaacgtagatcaggctacagcacataaaagagaaaaggaaggtaggttctgctacagcgactaggccatataaaaaacaaataggcgttcacaggttttacaacaaaagagcacaaagaaatgaagcccatctaagctaagaagcaaaagactcagtattttctaactatccagacactgcatttagtcctctctatcagcaagtttcaccccttcccaatttgtacccgacattttaaatttgttggatgaaatagattctgattacaataaatttgaaatatatatgtttgaaagtttgttgatacagtctcattcacatagtagcaaaaaagatacaaaacgggaaccttgccatgataagataacccctaaaacaaaactaataagaaaaacctgcgaaaaacaataaaaagaaaaaaaagagagaggtcttatatagagcataagaagtatgaaaaaccccaaaaaaagctaaagcacttgagagagttgattaaataaattagggtggactagttaggcttacaagaagcaagattaaaacattgaacgatagagaagtagtttttgtgtgggagaattttgattgggttaaaggaggaaatatttgggattatagagacaaaaataaaaaggaaaatatttttttcaaacaaacaattgtgaataaaaatgataaggagtgggatttgatgattgaggctgcctagaaagaaaacaaagaagatttcctaagagaattgacacatgaactgaattgggaaggtaagtataaaagagaaaagaaagaaataatttcacaaatagaataaattgacagaaaaactaaagtccatgggatgaattgggaggacagtgaactgagaagggagttcgaacagaagttaaattatacaataagagaagaaagggttaaatggtttcagagatgcaaggatcaggaaactatagacggggataataatacaaagtactacaatgccaaggcaaatggtaggaagaggaagatccatatatatagcctactgcaagagaggaatgagcaataaaagatcagcacaatttggttgagtacatcaccaattattataaaaatctatctggtcatgctgagacaaatatcatgtcccttaacatggagggatgctcagagcttcaggaagaagacaaagaagatctgattaaagaaattttcaaagaggaagttttggcagttgtgaaagaaatgagaaaaaattgggaccctggtcctgatggtttcccccattgaattctatgaacatttttggggcttgattagtgctgatttgatgaaggttatattagatttccaacaagggctcattgacataaaacctgaattatggtgtgataatctagtctcaaaaactcatttacagatttagaagtataggccaatttgcttgttgaatgtgagttttaaaattataactaaagtgttaatgatgagattggttacaatcattcaatacttgatagccaaaaaccagacatcattcataaagaacagaaacataatggagggggttttggtcttgcatgagagtttgaattccttacatcagaaaaaacagagtggtttgttattcaaggtagatttcgaaaaagcatatgacaaagtcaattggagcttcatttttcaagttctgaaagcaaagaaatttcctgacaaatggtgtgattggattatgaaaactgtgagaggtgataaggttgcaattaagatcaatgattagattggtccttatagtacatataaaggtctcagacaaggtgaccccatgtcgccattgctttttaatttggctgtagaagcactgactatgatggtgtagagggtgttggtgatatgtcctagaggcaatcatagagatgattgtatcgcatattatgtttacatatttatctgacattgttccttgaaatagataactcattattgattaatgaatatgtgattctttcatgagactttttatgttgtatgttactatttctaaaggatctctgatcaaatatcatatgtggaacaaatatgtttaaatgatcagcacatgtattaattgatgatcatgtctcatagatcatggtataaagataccaaattaataatgtggacacatgttggggaacatgttgttggatagacccaacaagagactgcaagagccatatgtgttgtgtcatcagtgatatctcatttaatgttggtgctgaatccttagacctgagattatcatggttctcgacatgtgtagtagcttacttagagactgctaaacactactccgtaattgggtagttataaaagtagttttagggtatgctatgaaacatgtagtgggatatgaataatcaagatgggatttgcccctcctatggagagatatctctgggcccctcgatgttatagattatggaagtgtatggctatgccaaagatgattgaggagtcaatcacaaattatataatctatcacaggttcgagtgaatgattgagctaatagaggatggcacatatctagccttgagcttaatcgatgtcgtgaggcaaaggggttcatacaagtatacactagaggttcagccgatgtgatctttatgtatgcccgatgggtcaatacgttctgctaggggccgctgttgacacgtggaccgaaaaggagtttttaggttacagccgagtgtacgtgaacctatagggttgcacgcttaatgggccggaataagggaattggatggagatccaatatgagcttaattcggatagggatccaaataggagtcctacgggccttggaggcccgagtcattggatcctatatattcgtgactggtgtgaccgacggatgtattgcatcacgtgagaaactctagccgccactcccctctccgagcaaaccctagccgcgtgggggtgctagcacatctgcacgtggtgttccgtccctgtacgtgtggataccggtagaggcgccgctgttttgcggtgctgatcggcgtgggagaacgacgaggagaacgcacgaggaggagaaggtcgagccggtgcgatcgactacttcgtctacatcgacgcgcgctacatcgcgagggttccttcacctacttaacactttcttccgttgtgcagcgcgtcgagtggtaatgatctatgatctaatact

SEQ ID NO: 40202 - DNA, 9925 bp, Oryza sativa
tatgagatatttaggaataccaattgatcaaaaacacattctaaataaggattgggggcgacagaaaagaaaatggagaagaaagtgggttgctggcaaaggaagttgcagtcaatagggggcaaagttactctaataaattccagtctgagtggaacacctcagtatatgttgtatttttatagaattccaaaaggggtcaaagaaataatggatttctatagaagaagatacttgtggcaggaagatcgaggaatcagaaagtaccatatagtgcagtggcctgtggtgtgttcacctagagatcagggaggcatggttttgttagatttagacattatgaacaaagcacttctcgggaaatggctttggcctttggaaaatacagatggtatatggcagcaattacttagagaaaagtatctgataaagaaaattcttgcaaacaagaagttgaaaaatggtgattctcatttctggcaggggatgatagatattaaggaggcattcatgcagttcataaggaaaaagccaggggatgggaagaatattcttttttgggaagataattggttgggtgggagacccatagctgaacaaataccccaggtttacagtgtcactcattcaaaaaatataactctagctatggtaaaagaaaaaggttggcaatcaattgtttttagaagaaacttaactggagacaggctgaggagttggaatgaataaaacaaagttacaaagatgtgataatatcaaactgtctatacaaaaaagataaactaagaatggggaatacactctcaaaactttttacacttttttgaaaatacaggatatgatcccaagattgccagggaagcacaaaaaaatctggaagttaaaagttccattaaagataaggatctttatctggcttctgataagaaaaagcatcctcacaaaggataatttaatgaagagagggtggaaaaaaggagctgagttgtgtcaattctgtgataaaaagaaacagtaaaccatttatttttagattgtccacttgccaggtttacatggaatgtggtgttctgtgcttttgatttaaaacagatcacaagtctcaaacatatttggggagattggatacagggcaaggacaaaacaacaagccaattgattctagtgggggttgcagcagtactttggtcaatctggaaacatagaaataatgcatgttttagtcaaatttatcctattgatccaactgaaattattttttgtgcttgttactggatatcaacctgggctgttttgcagatttcggaggaaaagcgaagaaagctgcagtggggggtacaacttctaaaacaggtcacaaatgagatcttcaaatcacagtatggatggagaacaggatcaagaagattggaggggtgaacacaactggacttccagatggggaggagaatgaacaaaaacaccaactacgtgcaatatctggatagttggaaaatactaaggcttttgcttcttacttcctccatttcatattgtaagactttctagcattgctcacattcatatatatgttaatgaatctagacatatatgtgtgcgtagattcattaacatctatatgaatgtggacaatgctagaaagtcttataacctgaaacagatgtagtagcttagatgggttttcctttctttgtgctctttttttgtttgcaagacctgtgaacgcctgtttgttttggatgtggcctgatcgctgtactagaacctatatttcatttttctcttttatgggctgtagtctcatctgggtttctattaatggaaatggagggcgttgtcatttgataaaaaaaactccaattgtatagtgagctgattgaccatcgtctccttcactcccacgacgacatgagggtcgagctccgcagttaccacgtcgtgatgtgacgcatggtttacacccgaaccttcgccacgatgctcgggcacaattgttttgctttgctttgtattgctttacaagttatatatgcccttatattggaatcttaatcatctaaatatattaagcttatcatcggtcttgttagaattaatctaacattagatacatatttgttcaaaaaaaatattccagtataaggttgtatcggagctatagccgatacatgctaaatttgttcatcagctatgacatgaacttgtataatctttatttcatagaacttcggatacaagtgatttatactgtctcgattaagtttgatttatcccaatcactgttatttgaagtaatgacgattcatagattatgtaacgttcatctttacagccgatgacacgaatttagggtcttaattttattgctacatcttatagccgattcaaaccaggttgcatcggctaggttaaagacgatatgtcatcggccctccagccgattggctatcgtttataaatttaactgtttatctcgtttcttgttggttgtaggatcaaaccaattggcacgccctagaccctaaggcaagtttttgcactagagttaagcaaatctctcaggccagtgtatgtttgtttgcatcaacaatgtgtaaagtgctagatcggagaccattgatcctaatccttttgtatgtcgtatgtatttgtatatagagacttatgtgtattgttggtacattacatttcaatatagtatcggtgaatgatttacctttttctattatggtttctgaattacatacaatatgaggaaaacttgcattacatgtgcaatatgcttggtttaaatcatagcggttattacgtgtgttgcacgtgcatgattacttaagtaatagtagtattgttgcatcaagcaagaagatgccaacactaaatctatcgatatcttaactaatgaaaagtggaactcaaaatgaattgaggatgagtgacatcatttaatgaattgagaataaataaatctggaccgttggattagatggatgataaaaataataattaaagaggcttccggtgataaagctactagaagaggaaagaaagagtaaagggaaaaaaagctagagaataggcatatgatgcaaataatttacgaaatgctcctataataaaataaattattttacaaataaaccctcatcctaatcacatattcacatgtcaagattcggctatttaagaacatatacaaatgtgcgttcatacgattaattttgtttctaacaattaattgttaacatatttgaggcaaaaattgctacaataacatgcacaatcatatcgtccgaatataggtttaacgtttttcacatgaatttaaaatgaaatcaaattcattccttaaaaacctacaaaatatttcagcataggctataaatagtgcgcgcctatacgaaataaggggtcatgcagccgtgaaaacctataaaacaatgactcacgcagatataaaatttgtaataaatattaagctatctattgtatgagcataatattagtcatcctgacccattttttttcgagcgatgagaaacccataaaaacagattgccactcatgtgtaccatgtaacatgaggcatagagtcacgcgaatgcgcaatatcataggctagtaaaccattatgaaaagtacgagtattagattgtgtgttctgtggtaggggctggaagcttctttcccgcacacgtaaaatagggtggctcattagcgcatgaataattaagtcttagcttaaagaaaaacatagaaaggaattaatataaatttttaaattaattttgctatatattttttttgtgaaaaaatgtgtggtacatctagccattcgggaagcgtactcagtgaaaacaaatgagtagaaggtaggaagaaagagtatagataagtttgtacttccagaggggttgataatacttcatttgaacaaagactattgtcaaagttttaaaaacttggactatgaatatcaagatctaaagtatgtgttagatataaggagaactatatttgttttagtctaaaaaaacataaataaaattatatgtttattaatatttctacatatattgtaataaaaaaatagggatgagtccattttacacccttcaagtcttgtctaggtttaaaactcatcccaaactcttaaaccgggtatccaactgttgatgcgaaaaacacgaggcctgaaagatctgcttaacttcagtgtaggtccaaaaatcttgcctttaggttcgtaagcgtgccagttaatttgatcatgcaatcaacaagaaacaaagacagaaaataacaattaaatccataaacgatagccgatcggccagtcgctgatgacgtatcatttatatttgagccgatgtcatatttgaatcgatcggcaatcatgaataactgaaaaagaactaaatctattcgatcggctgtaggtattaacgatatataatccttctgtcgatgtatatttaaatcaagtgattgggatagatcggtcgtcatgccgagacagtataaattacttaggtcaaaatatacattaacataaagattataaccgttcataacatagccgattagatagatctagcatgtatcggttaatactctgataccactctatattaagatattaaagcaggcagaatatatcagacaggaagcttaatataccgaaatgcaacaagatcttaacataaagggcggatttaacatgtcaataaagcatataagacataaagtagttaaatcagataagatcggctgaaaccccgatactaccctaatcgactaccaaaaacaggctagagattgagattctcatcacgacttataaggtcaaactcaactgatgcagttataagtatgaaaagaaggaccatatctagacaatcaagccgttggatgtttcatagggtggtagatatcctatataatctaagccaacattgctatttaacctaatcggctgccttccaatgatagatgttagttgatcgaaggttaaatagcaatattatcaaagattatataagatatatgataactagacgaattacataaacaagattagagtatcataaagatggaagcactaatcccgagaacacaagccgccataacaagttttacctctagctgaagatcgaaaccgatgcagctcaacccgaaagcaagaactcgtcgaaagtaaacgaagtaaaagggtggcgatgcgccgagattgtattgaacgtctattatttgattacatgggttcgggtcatatttatacccgagatacaaaatatgtccttgtcggacacgactcttatctctaacaaactctaagataccataaatctttgcggcagacttttgccaaacttatgtataaggaatttacataaaatatcataattaatagatacaattgccttttcagtactcaatccgtgcgtggcaatccatatgaagcaccctaattcaacccgataacgtgtaccgaatcgtattgtcggaatcggctcaatcggctaaccttgtccgactagaactctaccgattctagttgcagccgattcggactttagccgattcttcctctgtttccggaacggtctctatcttcgattccgcttcggttttatatccatctccgatacttaaattaccaaattcggtcgttaacaccaacactctctaactatcaaaacagttcaatttaccctcctttgacgggcggcacaggagcacggcctcacgaggcatacggcgcagtgccagagcatgggcacactgcggcgcaacgcaaagagaatgatttgagacgatggtgttgcgagtaggaactggcaattacacattccaatatcctacccttttaaaatggacggttagatttgaatggtatatacttggtacctagtggtacctcctcaaggatggtgaaattcctcttaaacaaaacaaaacaaaacaaaactttattgcatattataaattaggagtcgaaacgattacaaatggagattttttactgtccttgaggatgtgaggtaccaaatcttgaccatcgatcttgtatcatcggacggctgagattggagcgtaccgcgtcgtaccgcacgcgctggtttcagcggtaccgctgtggggggaaaaggtattttcgcgttatcccgcaacagcgagagagaaggggtcctttgattccgctcgattccgccgagcggtatcctctctgggctctctttccttagttcgtcttcatctgcccatctctttcgttctctcggctctgtttccttctctcatctttctctccaatttcgttgtgggcgcacgcagagggaggagtgcagatgatgggggatggcagatccctagaccccccccccccccccccaatctggtcgtgctccccttcaagcaattgaggcaattctgccgcaagtagggtggggctggtgctgtcaacagcgcaacagcggttagattcagctgctgcgggagtcgtggcctggaaaacggagaggaaccgccagatcgtagggccacaccgctacaccgccagatcctggagagtttggccaccggctggaatcaattggttgatgccgaagctgtcaagatgggtgatgtatgtgttttccgtttcaatgactctgatgatgagcttactcttgaagtacatgttcttagttagtgtgatggatgaacatcaccattttgcctggcactgtgtaccgccactcctaagttagtatatatgatgtaatcgtgaagactatatgacgatgtgcttagtcttaatgttcctgcacttatgtactgtgatggatgaacatcactattttatcaagcaatatgtactgccttcctatgatgtaattaagttagtggatgaactatctacacatctgtttaatcctaaatggatgctattcagtttgctttgaaaattgatgttctggctgcttcggttctggcggctatgaagttctttcggcattggttcttccgtgtaattctgttgtgtaattcggcacccagttacacacaacttcaactccaggcgtgtggtacatgcatatttcaaactaacaaacatcttcaaatccaggcacactgcatggatattttgcacttaaacagaactgattaatagctactcgtacagtttagctcaagtgaaaaaaacataacatgcaagtacttctgctccaatacaaataatcttgccagctaatctatacatacagcaacacaggcgatggcgtggcgacgaaacgattggatcaaccggcgatggcgacggaactgacagaaggagaacacagtaggggattgcgctgctctgtccgggatggccggcggcggtgggcggtgggcgaactaaaaactcccagccggcattggcgccggcggcggaactaaatggcggcaacgacggatgattaggggctacggcggcggaactgctgcggcggaggacgaaacgctccgccccgagactcgcgctctgacttgacgggaagggattgcgacgacggctcgctgcttgagcgtagccgacccagaggcccaatcagcgaatacctccttttttatcctatcgtgcccctgccaaatcaatggctagatttgattggtatctcatagtatcttttcaaggataggaaaagagctcatcaccgcctcctcctccggcgtgaattcgttcttaatcgaaagcgtctccctcatctgttccggtgtcttgccggaaatcgtgcccactcggccgacggccgctgccggcactgcgccgcggctcccgcctccgccggtgcgcccagccggcggccgcccctgccgtgctgcccccgtgctggcgtggtcttcggctcgccgcgccgccgccgccgcacgccgcgcccgccgcccgcgccgcaacgcacgccaccactcgcgccgcaacacacgccgccggctgtggctgtctccaagcaaaattagggttaaggtcttagggaattggggatttttgggaggaggggatttttgtttggaaatgggctcagttccagcccaaatagaccgcgggccgagtggaaagggggaggggagtgtaaaatttaggcccaatacaacagaaatggtaaaacaaggcccaaataagtagtttaactctttttctttatctttttcatacatttttttagataatggaatataatcccggcctttactcaaatagctacagccaattattatatcaactcaacaaaaactcacacctgaataaacaaaagcatagacgaactaataaaacacacacagcataaacgatcacaaaaattattgaattctatttgtgaatctccatccaaagttggcgaacagctgcataaccaatgactcaagattacgacatgcagctttcattgacttgatttcttcatcacacttttgtagctgagcccaggatcggagccaatatgttgtcctgaaaagaacctgcatataggatatagatggtgatttatcaaaaaccatatcatttctacacaaccatatagcccaacatatagcggatgctctaacaagaataagtttggtagattttttataactcccacgagccaattctcaaaaatataagatatactatgaggagtatataaaccaacattaaactgtagagctctccaaagaaattttgcataatgacactctacaaacaaatattgaatagtctcatttctcatgcaaaaacaacatttcaaactaccatgccaatttctcctagataagttatcctttgttagaacaacccctttaagtaggtaccacataaaaatcttaatcttgagaggcatcttaagtctccatataatcttattcctctcaatgttgccattattaattaaagctaaatacatagaccaaaccgagaatacaccattttgatggaaattccatctaaaaatatcattctcctctgacaaatgaatatgaacaattgaagcacataaattatgccaattgtttaaattctgtcctactaaaagctctcctaaaagaaatattaagtgaaacaagagacataacatttgcaattgaagcattcctcctacgaactatagcatataacgacggatacctatctttaaaagaataattccctacccatttatcttcccaaaatttgacttgtacaccattattcacaatccaggaacccatatttagaaacttactcttaactttcataagaccagaccaaaaatgggaatccccttgtttcttctcaacctgactttaggattgattataaagatatttcattttcaatagatcctgccacacaccctgctcgtttatgagcctaaacaaccatttactcaaaagatattgattttgaatttcaagattatgaactccaagaccaccctaatctttgggttgacaaatcatatcccatttagtaagcctatacttcttcttgtgttcatccccttgtcaaaagaaagtgatctataataatcaatttttttgaagacctccttttggaatctcaaaaaaagaaatcataaacatggctaatctagaaagcacaaaattaatcaacaccaacctccccccctccccatatgtttacctttccaactactaagtttcttttcaattctttcctcaactgttttccaatccttgttactaagttttctaaaatgcataggaataccaagatatctcatagggaaattcccaagcttacaaccaaaaatagtagaataaagctcttgacattcctttgcctgaccaaaacaaaataattcacttttatgaaaattaattttaaggccagataatttttcaaaagtcgatagtaacaattttagatttttggcttgtagtagatcatgttcaaaaaaataagagtatcatctgc

SEQ ID NO: 40203 - DNA, 4908 bp, Oryza sativa
  unsure (1)..(4908): unsure at all n locations
tgatctttttcatatatatatatatgaactatatagtatatatacctattttttgtccaaaaatcttgggtatacatctgaatgccctttaattatagctgggctgcccctggtagaacctcgtgtggttgtatttattgcttaaaccagcgggagataattaaactccgagtaggagtcgtattttaatctcattttacttctgtaataatgtaatttaatatcgagaaataattagagtagtcgtttcgaaaaggagtccaattagaccatgggagaaggtttcgaaaatgagtccagttaaatctcttcacgacgtacgtacgtttgtacgtactcaaaactaacgcggaaataactgaaaatcaattgaatttggatcagattcggactccggatcaccgcatccgtcttgtttttgcgcggtttcacgcaataaaaacagaccacctctcgccgtgatccaagcaccaaacgctaacgttccaagagtcttggggtccaagacaagacaagacaagaaacagttgagctttgcaatccgcgagttctttcgtccgtgttcaaacttcaaagtagagagatcaatggcggcagagaagaaggaggttgccgacgccgccgccggcagcggcagcgacacaatcctcctaatcagctccgacggcgagcacttcaacgtgccgtcggcggcggcgagcctgtcacagctcgtctccaacatgatcgaggacgactgcacgacgaacggggtgcctctccccaacgtcgcctccaaggtcctcgccaaggtcatcgaatactgcatcaagcacgccgccgccggggaggaggaggagaaggatctgaagagcttcgacgccgagttcatcgatgtggacaagaacatgctgtacgacctgctcctggcgtccaatttcatgaacatcaagagcttgctggatttgtgctgccagcacacggcgaacctgatcaaaggcaagtcgccggagcagatcaggaaggagtttgggatcaagaacgacttcacgccggaggaggaggaggaaatccgcaaggagaacacatgggccttcgagtagattttcctttgggaaaatatttatgctaattaattatgtcatgttgctgcgaattactgctctaattagttactactaggtagtagtactagtagaggttcagataagaaattagaggaatattttgagtggcttttgcttaattgtcagtaacatgcatgcattgcatgcttatatatattacctttgtactaatagtttcgactcccctacttatattctgcaatatatgaagtgctcattaagtcattagtgcaaactgtttccttgctcttgtggttgtgaaaaggggcttctaattagaagccgatctgacgtagggactaatgtggaatattttgatccaaagtagggaccaatgtatgaattgaacttgcaacattacacttcataggggccgatttgaaaaattcttggatcgtgcatgcacggcgtggattaaataatactcgaagcggtacgagcaacttatgcagaaacaccctttaaatatattactgtttaaatgaacccccctatttggaccgctaaaataaaattggtagcgatccaatcctcgggtcgtcgtacaccgtccgatcaaaactgcgtggctcagatcggcgaccggcttccagtgggtttggtgcatttttacaaaatagcccctgcgtgggttttaccaatacgaattctctccgcctcgtcgtcccgttcatcgccggcgccgccgcgccgccgccgccatcgtctccaccggccaccgccactcctagagcctggatgcccctccattcgcagttcgaatccacgcatccaccgccgcgccggaggtaattttctctccactcccttcccttctcgttgctgcaatgctgctactaagggcaaactcgatggcaaccatggatctgtacgaacgggaagaagggagggttagggtttcattaacgggcgcatactaataaaacgaccgcattggggaacgggttagggtttggggatttttgggttaccggcgctgatccccaaatctccaatgtgccatgattatttgaagctagacttgcctactaggatcattaattcaatttgacaatttcattggcatttgtgttttatatttcttgcggattgcgtgtgcttaggtatttcagttgctgtgtgaatggaaaaatcctgtaatttaatttctgacccatagctgttttgaaaaattactgatccatggttgtgtttgcaacgaagtctgatgatactgatgtagaatttattatacttctgtagtatgagtacttgttttgttgcgtgtgtctaggataacattttggtttagtgcatttgcatgtgatctatggctattacttctcatgtttgctgttctgttggcttgatctaaagagaatcatgtgtcttaagagtctgtcacgagtgttctcttgtactgttcttcgtgtgttttcctcccatgtccaagatagcatcacaagattagtactgtacatatacacaaattttagtgaaactacttgctgtcacctgtcagcatccagatgatgttcaacatgaatcctatttcttgccagtacattggacaaacatcacatgagatgtacaagtccctgacagtaccgtcatgttcagtaccgtcctggttagtacgactcactgacaaccaaatcacagattcaagtgactggatttacagagaaatctaatttgcaactctaacttgcaagagaaaattatgtaaacaattaaggcagcattgacacttgagcaattgagacatgccatatgaacttggaggcatcaaggcgaggccaaccatacacttgcatttgctacagcgacactagagttttcagtcaaaataatgcactcaactcaacacacagaagagtatccatctaatgctagagacaatgaggctaaactagattgatgaaagatcctcatacacagacttgatcccaggtctttcagagaccggccggatgcatctcaaggcaatgcccagcacatccttcatgcccttgacagaaacttggttctcagaatctgaagccatggctggatcaaagcaatctgatccccgaccttcagccacccgcagacggacccaatcagtcaggtcaacaccaccttcagaacccgagacaacatccccagcacacctgccagttaggagctccagcagcacgacaccgaaggcgtacacgtcagacttgaacgagggagatggcttcttggacgctgctagctctggggcacggtagcctagcacgcccaggtcgaggatctgctcaacaactccagcctgggtcatcaggcggtgcaggcagtagtcagcgacacgggcattgaggtcaagtccgtccaacaagatgttggtagccttgaggtttccatgaggcatcgctcggtcaaaatggaggtagttcaggccacgcgcgacatcaactgcgatcttcagccgttgcgcccaggtcagtggagggcctctccttcctggacgatctgctaggtttcagaggaacataaagcttagttagagactgaacatattggtaaccaaccagtcacatgcatttgcagatggagtatacaagatctctaagcctgatgtgttcaattgcagaaatgagaaaccagtaaatgagagcattaccgtacaaaaagctcgcaagacttcctggtgaaacataatccgacaagatcagtttttcatgtgctgttggaccccagtagtaaccacgcaagccaacaacattgggatgcctaatgtttgcaaacttcttggcctccttcgagaactctttcttgggccttgcaacaccttccctcagccatttcactgttaggaagacaccattctcaagtgttgctctgtacgaagtcccgtggctgctcctcccaagaacctcagccggtgcccttgacaattcctccggtgtcagtgtgattgtttcatccaggaagtgcaactcccctgctaacctgtcaggtgatctgacatccaaccgtgccaggccttcctgggtgtatgcctctccagaatctggtgaccaagagaagcggctacctttggatggggaaaatccccctacacctgacagcttctcttcttggcttagtgcttcagatgtagagccctttcgaggagcaccaagctcatctgctgagaccaccaaaccacctttgtcatcctttccttttgtactggccatgtctttgctagtcttgtggaggttcttgtctgaaaccttttctgagctagggaactgccgtgagatttgcttgtaatggcaaacaatggcaacaaggataaggatgacaagagcaacgatactagctgctataagtgctattttagctgctgcactgagtgacctgccaccagctgaaccagaggaactgccagacccagaagagctagcaggatagtctagtctcgagttcccaggatggaaggaagattctggaaacttcctcaagttcactggaacaacaccagatagatcattataagaggcattgaatgattgcaatgtatctggaagtgcatcaggcaatgacccagtgaactggtttattgatatgtcgagagcagtgagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40204 - DNA, 780 bp, Oryza sativa
acttcgtctttttttgtcctattacatactccgtattttgcactgtctttctgcgcctgtggttcttacgtgttaacattattgtcctttagttggcactagtatatatacatatgtccaaataaaactgcctctttctgtcagttgttaaataaagttacttctttctgtcagtagctacttcccgtttctcttaactagtccttatagtcctacagctgcagatgtcttctagttttgatttatggtcatagttatgcttttaattcagggatgattacttatattaataacatatatttgatgcatcaactgttgtctgcatgccttgtcataattttgttaatgtagagaatcatagtacaaactccggtaccaattcctaatcatttatgttcattatgcaggtgataacactggcgaattgtctgtccaagcaaatattctagctgcttcatgtgccgggattgcaacagctgttgcaactaatccattgtgggttgtgaagactaggctacaagtaagctatatcgtagtaacttatatctgtttatttttccctatatggtatttattttcaaaacaactttctatagatttgtgactttgcaattttattaccttacttttgggggtgggggtgcggctatggttcttcttgagatgagagactaataaatatccggcaagtttgtagaagatggtgatacaacttggctcacagtagtatatactgcttatacgttgtatttgctacttgcttggtacatgatggatata

SEQ ID NO: 40205 - DNA, 5377 bp, Oryza sativa
ttttcttgtcaaattgtggcacgcagtctctagcgaacaaattgatcccttgcaactgtcccatcgttatggatatgacttgttggacatgtgaaggatgtttagtatatgacaactgtgacaacaaaacctaataatagccattggaaactcatatttcatgtgattgtggaagtgtggcaatgggccatataattccctttttttgggaaaattgtaactgtgccattataattttacaaaatttgagatatgccatcctgacccacatgtcattgactcacgtgggtcctacatgtcattgagctttttatttttgatgttgtcttgatcagaaacttcccttagattgaagagtcaaacctcattcctagacaactaactcacaagtgagagacagggttggctaatcatttagttaatatgagtccattcaaaattagtaaaaataaccacctgtttgaagcatgttttctgtctagaaatcattactctgagaatagggtgaattctagttactttgtcattacatgaacgctgttatcaatgattcaacataattaaaataaatctgagaatgctgcccactaaactattgaaatctttgtgaattgcatgaatgtttataaccaatgattgaaaaactatttggcatagtatattttgacctgataattacagcctgacgtgaccctgcttgtttctttaatcatttttgcataattttgggcataggatcttatttatagcaattgttacatgtatatatgtgtcacgttggatgatgtttaaaattatttatgtactctatttacatcttgtagacacaagggatgaggacaggtgtggtaccttacacaagcatttggtctgctttacggcggattgcagaagaagaaggtatccgtggattgtataggtaggttcaccttaatcatattgcatactgtcttggtcagttcgtttctcgttcttttcattaaaatatatgttgtctatttgatctctgttttatatgatgatagtggtcttcttccttctctagctggggttactcatgtggccatccagctcccagtctacgagaatgtgaagctttactttgctaaaagaggtaaaaaatcttttttactatacgaagtttgagtaaaagactgagtcttcatggcttgaagatttacaaagatgtgcacatgcttttcagacaacactacagtcgataagctcagcccaggaaaattagctatttgttcatcaggatctaaagtagcggcctcaataataacatacccccatgaggtatttttgttggtcctatgtttttcgtaataccttttcttttgagtactaaatggttttctgttgaatacatgtgtctcctgctacagatacctgaatagacacattgatctcttctgaagttgacactttatttctttcaatttggtcacatgttttggtatctatattttggattggtgaaatgtttgttaaaatgggaaagtgagttgggttgttgctaaaataggaaagcaaggaatgttgttgcttaaaatgtcaaatctattctaaagtgaataaataagcagagaggcagagaggcgtagatgaataaataacctccttcagacactatttagtgaaagagaagatgaactaacctaatgaagaaaagatcactttctagtggaatttacttgacttctttttggagcaccagtagctaggaacttgaaaaaccccttacgttttattttcagttatagtaattggcttatattggcaggttgtacgatctaaattgcaagaacaaggtcctgctcgtcatggtgctgtgcactacaccggtgtaatcgactgtatcaagcaagtgtatcagaaggagggaattcccggcttctacagaggttgtgctacgaatttgctaaggacaaccccgaatgctgttattacgttcaccagttatgagatgattaatcgactcatgcaccagttgctgcctcactaagcaaaagcttaaaaaccagcatatctccactgagcttgtaatgctggctgagactatcttcgacatagcttgggtgtaatggttggtgatcatggttgcattgccatttgcccattattgaagagaaggcggctgttaagcacagattttggtgaaagagatcggcatacgcagaaatttatgttttggtgcgaggttaaaatatttcccttgtttcatgtgttctaaattgttgataggagccaattgttgcctccttatatgctgacctgctaattgtctcatttgtttcgatttaaacctttctgaagaatactgaccggctgttatagctgaccaatgaccatatattgtcagatgcgcctagagttttacaagaaacaaggcctagccatcgggatcggatacaatgttttgtatatccctttgttatgtattcccagtgttaccgttgactatattattcaaccagctaattgctcgtttgttgctgtggtcttctgaaaaaacgattgtttgcttctatggataccggtacagcaaaaataagtgtttttatgtagatgcaccttttgccctagcagcaagcatggtttggagttgatgtgatcttacatagttggggaaacatactaggaatcgaagattaagatggccatatggccatacaaaccaaatacggtgtatagctatgtgatcaatagaattgtaggtactggcttttttttcttgcgccgatcacattggttgggaggcaaagataagttggggctgaccgccagcatctgtcagtttcacatctcttgaggaaaagattgttaggttagatagccataatacaaatttttttataagctaagcaaaatctgagagatgtaagacaatcactcatgagggacctctaaaagcaagtgaaaggggtggcgcccccggccggcctgccaactgggaggcagcggtgggcgcccaactgccaccggcgatgaccaaaggtgcggcggcgggcacgggagacggtggaaaggaaggggaaaaaagggaggggatctcactgagcgtgggcgggcaaagtgacaaagggagcatgtcggcggagaggattggcagcgatgcttcgggacaccgatgaagacggcgctcccgcggaggtcaacaagcggggagcggtgaccggggacgcacaagacctaggaaaggttgggaggggttagggagaaggggatgcctggtaactacaataagtgatggctggagtccgacgatgttggtattttgttacggtcatagataaatccgcaaccgcatgaatatcgctgtagcacttcacattggaatattctaaggatatcgaatcacaaggaacatgtgagtacaatctaagaacatgattcaactaaggaaaacaattaaatggtaggcttacgatagagatgattcttatggattaattatcttaattaatttaaggtacaattctatcagttgctttgggcaccgactttcctttggttttcaggctgagtccgacttatagctctatgatgtacccaaacgtggagtaacacgaagggtggaaatgactatcatcacttgccgcctgtctcactttctgtggagcacacaataaatgaaggtaatgtctaacctagacaccacatctacgttatcgattactactctagcctcgaccaagaatttcctttttcatccagagtcttagtactagagtgctcagtataaatacgaagcgacgagcccacaatgatgagaagctaccttacttaaataagaaaagtaaataccataaagaaatctcaaatacttattttattgaagaaaacatccatcgaggtacaagtcgaaggagagagtgccgacagctccagcactcctccgggactccacttgagagttgagagagtgtcgacatctctggcactcatcggaactcccccgaagagtactgtgacaaccggagcactcctttcaaagcttcccctcactctcctcctacattctaactctacaagaaagtagcctaaatatgaaagtaagttgtactccactcaagttgtgtaatttgagagtgagagtttctcctccttatatagtgtcaagtggttgttactatggtggttgtgaggtcggttcacccacaaccgctatagggaaacaatcaccatcctccaagtggaaggtgtggatgaatgggcacaagggtggtttggctgacccttggcaccgccattcaccctctctttcggttgggtcactgtccagtgggccctcatgacagtgcacgatggttatcctcaaatatgtcagttttgctatggtttgtgaacccttcaatccatgtactcgcttctaattggccagaggtatgtttcttcgcatggtgggtggtttttgttcataattcacctttatacaaatattcaccaagacttatggaaatggttagtaataaccactacctctaagtttgatatctattttatattctttcatttgcttttatgcatgaattcacaatcagatctggtacttaaggactgttaacaacacccccacacttagcttttactcgtcactgagtaaagatcatggatcacaacaaagatatgattctctttgtaatgatacctgcataataattattccaagccatacttgtacttgtgaatcttgaagtatctaccacgtcatcttgggtgattgaagaacggaacggtcttgattcaagttacctccactcctcctgatgagtacattgggtttttcgttttgctcataaaaacataactctactttattccttaattgtttgtctcggatcactcaatgtgtataattcttcaccaaggtattgattttgcgttttttttcttatcctacttctaataaggattatgtggagctcagggtaggggaaagaacaaaacattacttacatcacatatctatactttctatatagttagtacccactaactcctaaagctcaacatgcaagtgtgccacatcatcaccgactaacaattattatctagagtattttagatctcatgctaacatgacatatcatttgtaattttgttgtatgtttagaactcagcatgcaagcaatgtcaaatcaccatcttcacatcattttcacattatttaaacatatactcgatcatttttataatgtataacatgcattcatccacatattccacagcaaagcgcgtggtatcaattagtattgcaaaatcaaagagtcaatccatggagaaaacaagacatacaaacttgatcaagatgtgcatagtgtatggatatgtggtggtaagtggcactctaattttgttgctctctcatttt

SEQ ID NO: 40206 - DNA, 9521 bp, Oryza sativa
  unsure (1)..(9521): unsure at all n locations
aggggaggggggagggggctcgtgagcttgcgggagatatggcgacgtgggggaagtggtcggcggtgtcggcccgagcggctagaggttagggtttggagctgataggtgggccctacttgtcggcgctcaagggaggagggaggtgtagtagacttcgcaatgggggaggaggcgagctaggctaggcatgaggaattggattgggctcgtggggagtagaatgaagccgaggccgaggacgagggagaaagagtggactggcatgaaacatttcttgtttgtaatgatgtttgtattattaaaattacttgttgagctctaaaaattcatggaaaattccagagagtattttagggcatggagaatattaaaaaaatattcaccgtcatgatttctaaaggaaattttatttcccacattaactttacttgataaattgctttaacatttaatgtaaaatctagaaatgcattattaaatgatttttaatccccgaaagaaaatcggggcgtgacatcggcgttggggcttgccagtgaaaaccagggttcaaaaaccgatggaatttcacgaaaattggtcagcttacgtgaaaccgctagattgacaatgcccccgtgggccgtggctggctttccgacattgtggaggcgagatcgtggcagcaaggaacaacagcagtagccccatcggcggtgcacttgagctcgagtgtcgagctgcagcagcagtagccctagtcagccttggcaatcacggtcgctcctcttcttgtggtcgcttagcaagccctagcgatgaccccttgatcacctaactgtcacgaagctcgagggagctgacggatgttcctctcatgacacccccaccgctagcttcctgatggcgtgacagctagatcggggcaagtggaccagatcagggcaatgaggagcagtagtagcagcaaccccagtggcagcggtggctcctcgtctcgtcatcccaacgagccccaacgccgaccctttaccactgccaccgccgacgacccctccaccactgctgtagatgtcgccctaccaccgccggccttgctaagctagaggaagagttggggaagaagataagtctgacttatgggtgccacttgtcaacctctaagggttgaaagtattttggtgcatacgaaaacacgttatgaaaaacccaatcaaactgtgtccaagacatatatagtagcatagttcaaatgttataaaatactaatgacacacaaccgaattgtgaataatagtgattttcaatttgacaagagttataataacatagatccaattaaccttattatatatggtacacaaatcatacactctctaattctgtggcttcttctgttcttacgggttgccaagctatttgaagccacttgccaataaaagtatttttttttctaaaatcttatttggaaataattttagaaaggtttataaataaaaaaaatatttttttgagagaagataaaagaaaatattctctagcattggcacgataatggcctgtttagttcgcgaaaagaaaatttttaggtgtcacatcatatgtttgaccgaatgtcggaagggtttttcggatacgaatgaaaaaaataatttcataactcgcctggaagccgtgagacgaatcttttgagcctaattaatctatcattagcacatgtaggttaatgtagcacttatggctaattatagactaattagactcaaaagattcgtcttgtaatttcctctctaattatgtaattagtttttttatttatctatatttaatgctttatgcatgtgtccaaagattcgatatgatgttttttgaaaattttttttagagaactagacggggcctaagccatggtccatgaagagtagctaggtgacaatcgagtttaccacacccgaggcgtgacaccatcccggtgaacacgtcgtgagtgaggcgagcatgaggtaccaaaggtccaggtggatggcgatgaaattaaaaccaaaaaaaaaaaaaaaaagggggagagcagcaactgggctggactccgctaatagaaaaaaaaaaaagaagggcgtaataaaaacgagacaaaaccgcgtctcgtctcgtctcgcccctcgcctcgccatcttcctcctcccccacctttccgcgtgcctgtccgccccttcggccccgccccgccccctgccctgcgccctcccctccgcctcgatccgatcgggggaagcggggtaatgtcgtcgccgtcgccgtcatcggaggcggcggcggcgcaccaccaccaccaccaacggcgccagcatgcgggcgccgcgggggggagcgggctcgtgccgctcgccgcgctcatcaaggaggaggcccgcgcggagcggccgatgggcagcgggagcaggatctgcgcgcgcgacgaggaggacggcggcggcggcggcggcgccgagggggggcggcggtggcggaggccgctgctgcggtacgggtgcgcggcgcagtcgaagaagggggaagacttcttcctcctcaggaccgactgcgcccggccctccacctcgtcgtcgtcctcctcctccttggcgtcctcgcctccccacaccttcgccgtcttcgccgtgagtttgtgtgctccaccgtcgtgttcgtgttcgtgttcgtgagtgtgtgtatggcagtgcggctcgatttggcatttcggggtgcctgcttcgaattttccccttccggtccttgggtttgtgctcctgagtagctaaatagccagctagtggggtattaccatcagccgtggcatgcgaagcttggatttcgctcccgtttatggggtgtgtggttgctaaattgctatgctgtgctatgtatatgttatatagtttcagatcttggtatgctagttctttgtatggctttaggcatgctagtgagaccttggaaattgcaactacgcatgtaaccattgtatggagatgctttgagttgtgagtgccgggattggactgttttcacaattcactaattgggtgtttctctgtctgtaggttcttgatggccataatggtaatgccgccgcaatatacaccagggacaatctgctcaatcatgtccttagcgcaatgccaagaggactctccagggaggagtggttgcatgcgctcccacgtgcgcttgtcgcagggtttgttaagactgacaaagaattccaacacaaaggcatgatcctgtatttggtgtttgggatttacctctatgtataagttatgccaaacgttgaggcaattttcctttttggctatgcaccaggccaaacatctggcacaactgccacattcgtgatcattgacggatggactatcaccgttgcttccgttggtgattcccggtgtattttggatgctcagggtggcgctgtttctttgcttactgtggatcacagactagaagaaaatgtggaggagtgagtatctgtcgcttaccattaatatggtattttatttagaggctctgcaagtcagcatgcattgcatattctttgctttgcaaatggaatatgaaagggttaactagaatatcttgcatgactgttttccatatattatctaattagttatttgtattgttctattcaatttctatttagaatgttcatatgtcttcatgcaactgctacttctcccttcaataaaaaaaatgatatcctgtttctatttgcacacaaattaagtggaccatgctactacaattactggagttgtacttactactaaaatagttcctcagatcaacaattaaacggtatggagtgaaaatgtgtccatttgctgtattcttgattttcatttagactcgtagtcttacacaactccaagtgatttgttgttttatatttttctgttaagttcctttgtccctgagcaatagcatgttttttttttttggttgactgctgaatagaaaagtaacttgtaagctttaaccaaccttctatataaaatgattgtaggagggaacgtgtcactgcgagtggaggtgaagttggaaggcttagtgttgttggtggggcagaggtgtgtttcactgcctttctgttacaacttacaacgatatggttgcaaacatagcttgctatgctatgtaagatagctccattggatacatgtgcttagttttggaaggattacaaaacaatgctaacaagctgtatcacccttttatcagattggtccactgagatgctggccaggaggtttatgtctatcaagatccattggagatatcgatgttggagaatttatagttcctgttccctatgtcaagcaagtgaaggtaaaactttgacactttgcaaatagacgcctggaattcctcctaggtttctgtttggcaataatatatttttgacagcccaacaacaaagagacaagaacacatgttcctgctcgatgtcctatgttattggtggaagatagctaactgccttctttattaatttattgttattttccgtagttgtcgaatgctggagggaggcttattattgcatcagatggcatttgggatgccttgtcatcagaggcagctgcaaagtgttgcagaggtttgcctgctgagcttgctgctaagcaagttgttaaggtaagaaactatctagtgttctctaaattcttagcaatcctgctgtaaaactagttattgtgcctcgaatgggtaccaaattactaatgttgcatcatcagacatgtttccttataaatgagttgtttccctaattttttaggaggcgctcaggacaagagggctaaaagatgatacgacctgcatcgttgttgacatgatcccacctgatcaaacaatacgtcatccatctccaccaaaaaagataaacaagttgaagtctttaatctttagaaaaaagacaaaagaccatcctaataaactgactaagcagctgtcagcagcgggtatggtggaagagttattcgaagaaggttcagcaatgctatcagagaggtcagttgtagctctcctctaagagtgtttatgaactttctaagtgtttcactgctagctccctgttcttgggtgtaagcagctggattcatagtcaaccatacatcagtgtttatgtgtatatacatcagtagtttattttcttgagctaactaaccactatgttagtccagtagtcctgttttaagtatagcatgacgccatgacaccctgtggattatatacccagtcagattggatcgccatgacccagtctcttgcttgaccaagaccattaacacaggttgattgagtccataaacttggccgtggtattcttgttgaaggtcaatgaagtacaaagctatttatcatagtacaacccacatataggaaaaaaaaaagaagctgttctccttgagcctaataatccatctgagcagcattgaccactcctgtagcctaacagcccataaaggcttttttttggatttaaaaacacaaacaaacacggagggtttatggatatattgcaactacacaggccgctggtgccatgaatgtgaatggagtatgagtcgttgtccgccatcctcttttctcatgttctcttctctcaagctagcaagccgtgatgatggtgatcagcaactttgccagtgatgaatctagcaagcagtgatggcaagggggtggagatagcaagtaatggaggtgttaactgacatttgtagctagttagttcaggttcactatcatcttgtcctctattgtctatcagcagtgatcaggaactagcacagtctggtccggttttgagccaagactgtttcagcaagggagtctccctgagctagtgaccactgtgaagggctggttttgtgctgaactgacattattactggagcagttggatgaagttgaagccaataaggtctctctgtggaacccgactagtctatgttctacaacccatttaaccaactagcgcacgatggtattgccttaggagggaaacatgtactgtaaggcctgttttctatgccataccgacaatgacttgttttattaattctttgaacagtcggttgaactggtaaacctgtgttcctattggggaaccactaaagtgagttattcacaggctaacatctggttcagttctttaaactatgcctacgatccctatcctgacagtgacaactctggttgaaaccataccagatcgattttgttttcttgcaagtcacacccaattggtttagtgtcacactgtcaccattagttcagtttgactaagcaataagtgtgttcaaactatgcaaaagttcacatcagtggttatcatagtcaaaaggaataaattagtgatcacagcccccgtgtgaaagcactggaaacaagatccaattaatatttgatacatattggccactgacacagtgccagttagaccctttctttttcagataatagttagaccttggtttgaacacattgtttaaaattgtgcttcgtcttggctcattggctgcgtttttgtttcaatttcttatccatctcattccctcccagatcttacttttttttggttcaattcagatgataacagaacacaataatcctagtctgctcacctatgattttctggtccattgtactcctaattttggagtgcacatttattgcttactcagttctctgatggtactatattatgttggcccaagattggcgcaacttacttcctgcaagcacaatacttgagcaatatgttccgatgtggtgacacacttgtcagatgggatgagctcattgagccctggcattagtattgttcttattatttaatattagctctgggagagttagacagtaactattactaccttggtaagtaacgatcaagtaataatgagcaaatacaaacaacttgagctgatcttataggtggacattgcatgcttcatgcttatctagaacaaggtgaggatgcttgaaaatggactgcttagataaatagcatttttggtttgggaaaataggccaatttggtccatcaagttccattccagggtcgctttggtccttgaaatttgattttgtccaaaccagtcatttaactttaccttttgggtcaatatgacccttgggcccaccttatgtgccatgtgggcaagacagatggcaatccttatcgtgaaaacactatttgtccccctatatctctagttagaaaaacatcatgataaaattatccagtcatttcctagccagtcgatcgcatacttgttcatgccaaaagacaatgataaagcgcaggggcgtgcccaggatttagaggttgggcgttcaaaatatgaagggtaatgtaagttcttttaaacacccaaatgcctaataattggcttctataacatcaaacactagtgtttgtacgatatctaacatatatataacacaaaattgaggctaaattcacattttcatagaattgatcattacttgaaattgttcaacatatagaagtgctaatagccccttgtccctcttcatttttggacctagaatttaatagccaactgtacttctattcttagaaattaagccattgcacaagtctaaatcctggtatatatacagtaagcatctaaagccattccacaagcacaagttcctacttccctaaatggctaaatcctaagtgtgaaattgtgaataactcagatgagtagagcaaatcaactattcagaaaaattcactaacttctgcttgagattttagaaggcagagcagatgagtagcaatagttgtcagccgagctcacccaacccaatcacccttgtggcctcactggcttgccgcctagcacaccgtccagcccgaccccttgccctgtcactgctcggcgcctgcacctatgccgctcggccactgtgcatacctccttgccactaacatcgtgcagccgtagcacgcgtgaggcgtgctgccattgccggtcgtcgccaatcagccactagcagcctgtgccacaccgccagccaccgccacccgttgcccctgccttgtttccgcccagcgccctcggccgcccctgcagcaccgcccggccaccgcagcccgcgtggtggcgcgccgccgtcacccgattgccgctgctcagccaccagccacccatgccatgcccacgccaccgccacccactgtccctgccctagctagggtttggtttatgtgggtgccttggtggtgggtgggcctggccggcctgtttggctgtttgggagtgggggaaaagttgggcctaggctagcgaatgggccaaaagataggggaggagggacacggcctagtaacgtggcttgtttgttctatgggctgattgaggtcttttttctattttttaacacatataccaaatacatagatatatgttagttttttgctaaaaatcttgggtatacatctgaatacccttgaataatgcagggcccaccccctgataaagcggtcagcttgttctattctcaaataggtatacaagggtaaactagttttcaccattgagatagccaccaagctgaacttatactgagttgtcttgctaacatggtgctctcagtccactattaaaacaattctttgtatgtgtacacaatcaaccattcctttgtccccttcgtattctcgtatataagggaggattggaggaaccctgttggctggtccaccaagttgccaaaatgcttagagtcttcctttcaacgtgggaatgagatgaggaacatggagaattggaaatagataagctacattttttttgtgggggtggtgggggggtgtacattattctgtttgagcacttagatcacaatttattttgtacagcttagaggaataccctcttcattcatcctttaattgaaaggaccacaagttggtttgtacaagccttgtgtgagacaaatccaatgttttgggagtggttagtaatgtcatgcacataaagattataatgctttagcattttaacttgttcgttttgattgaatcagctgttcgtcttggttgatttccctaatctgcatgaataacttgaacaagctcttttgagcttgtttgcttgctgctttatatatatagatcagcttatgcttagtctatatgttggcaaaagtccatgtaactgctgatttaccacccttcttgctgactattttgactgttagcttggtactatactgtgctacacataagaataatgcaaccatatgttttttgtaatgtgatgtacaaatttctcttcagctcgggttgtttgcaatttttatttctaatattcgttcactatctttctttgcagagatcttatgctttctgtccataagacgtgcactttagaatatattttctgatttcatatgctttttactacgcaggttaggcaatgactcaagtggtcggagaacatcatnnnnnnnnnnnnnnnnnnnnnnnnnnnnnnnnn

SEQ ID NO: 40207 - DNA, 10370 bp, Oryza sativa
  unsure (1)..(10370): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnncctagccacagaaatgatgtatgaagcattcatttgcttttcttcatctgtacagaaagtgtaaatttttcaggaaacaagatctgaccagcatgcaccagaagcagatcataatagccaatctagcaatttgtacataacagtggtggtaaaacaatgaatacgcatacaagaacaaaatgcatggagcatgacaatggggtaaatttaaacaggtatgcaccaaaggagtaatttaaaacaggtatactgggtgacaacaataattcaaaaggagacccactagtttatatttccacattaaagactgaggaaaatatgaatcacagggaatgatggaaatttgcaatagcatcagggaaatgacctttttctcctttggtaacaaggctccaattcacaacccgaggttccacggcaccaagtaaattgaggaaaaatatgccacttgaaaggcttctatcctgtaagtattacattcagttaaaatctgaaactaaaaggcaagaaaaaatagtagagaatgtagtcgaaacttgaaaccattgtatattagtttgataataagatcaggattgcatatttcattattaacaaattatacaatggcagacattgaagaaaactttgcggctaactaaccaaggaagaaacagtaatatgacattatcaattaggaaatatatcaaagtaaaccaaccttgaaactctccattcgagaatgctttccagaatcctttacttttttgtttgcccaaatcagtatgtcgttatctgtgatctctttaccatttgaatggaatctcagattctttaacaattgaaggatattgtacctcatcaattgccacagaaaagctggggaaataaagtaccatatgattaccaaattatacaagtgtctatgcaacagaacatactcattgttgagttaaccagcagtttaacaagaatcactaatggagcaatctaaatgccctccaaaaaatgaacagttcagcaaagcatcaacaagtaagtcatataaaattatcaggcgtcaaagtgataacaattatcagacaataatgaggtcctatgtaccaaacttgattgctattatcaggtacttacagacatttataagcatagtccaatttgtttcttacatgtttatgcagatctggtcaagttatcatttgcagactaccaggacaatgcagcaatgccaatatgactaaaaacacattgtattaaattgatgaaaataccacttacctaatatcagtttcttgtttccttgcacaatatcattaccagcaatattcaccaaggaaaattttagttctttcccaatcttcagaacttgattgcaattttccactttcctgaatggtaattttattgggggcctatttgccattttccaattaactgagccaggagcaatcttgtcaatcacctcaagaagcacccatctgtcatccccagaacaaaatatcagatagagcatcggcttgggtgacgattaagatggggggagataactttaatgtaagacctacccatttctaagatcctcaaacacattgttgatgtatgtagaaattccaaggctattaatccataaccggaatgacctctcttccctcgaaacttgagcatcatcagagagtccgtcgacaaaggaaacttgtttcatttgttttgacagcccattcctgaagtaaaaggagcaaaagtcaaatactttcatgtagttgttcccctgaaatttttctggttgctaacctgacatttcaatccctgatactaagaacatcaattttcatgcaggcttcaacctcagtacaagacaacaattttttggtaatcatacagcccattagaacagtcaatctcattttgtgacccaaatgacttattactacatatgttattgttggctatagcatatctgccagaaaagtaatactgatagtccattgtaggtcagttcaaagaagatatgttgccaagaaaacaattccagaatttctagttgaatccctttctcaacctgtttcacgccatcacactgacaaggatgatcatgcatagattgcattcctttgctatgctatgaacaatacatattgatgaataatacacaaaagaaaaatcataaacctatattttatggaagcacacaaggttgaacaaatcatgcaaactgaaaagggatttttgtgtttcaaattgacagttttccgagggaaacaccactctagcgcacctttagtgagtgataagatgaaggaaacatgggatgctaacataacattactagtagcttcacgaagataatctttttccaaataattatcatatgttaactgtagtatttacacaacaatggataccatcatgtctatccctatgtactgcctttatttcatattataagtcgctttgcctttttttttctttagctttgaccaagtttatagaaaaatatagcaatatttttaacataaaacaaagaaactatcaaaatatattcaatgctagatttaataaaattattttggtgctataaatgttgctatatttttctataaacttggtcaaactttcaagaagtttactttgaaaaggtcaaagtgacttataatatgaaacggagggaataataaaaaaaccaagcagaaattcaatttctttgaaaaaatattaaattaaataaagaaattatgagaactatctataccttttctggaaaatatgagccacaaaagcaagatttagatttggtaaaccgtcgacaatgtcttttggggtcagatatcttttgcagcccatcctatctgcatgctcaagaactaatcttgctctatgaagaagatctttaactgacattggggatggtttagcactgcattcaggtgccaagacattcagtagacaagcatatgcctcactatcctgcatttttatgttacaaaaatataagatatgcattcttcatactgggatgtagatggaactaaagaacagataaaccaatatttatccatcaattgactatagtggaatttaacaaccaaaaatttgataaccggaaaaaaaaaagtattcatgatgttacatgaactatgagaatgaatgcatcatgatgtatgattaattaattattgaccatagtgttataaaataaatttaataacataaatatgtaattcgataaattaacatttttactgcactaactacattttctggcaaattagatgcattcattctatacatcagaatcctaaatgatcaaggaaaactatcgtggcatgtgaatgctaacatgtagaaaagatgtcacagctagcaacaactaaagaagactggttcatattggaaatcaagtgagcatacttttatatctgatgaaaaatttgttactgttctttggaaacctcctttcttcaattgaaagttcatccatctgagtaatattttttcaggagataagctcataagctcctccatctcctgcaaaaagcacagacatatgaatttgagttattttcccatctgacacaaaatcagtcaccagtgtattagaataaatatgaatcatgaactaccttgctgtcttcaactaattctaccaattgaggtgtgctcttcaggtttacatcagccaaaagttgtatctggtagtcattatgttagcacagtcagtgagatacatgaagaaataacagaacttcagttcttgtgcgcaacaaaataacaacaggaacacaccttaattatttgtgatatcaaacccaagataaggtgaggctgcaagcacataagagagttttcataagatccatgcacaacttatatgaatgcttgagtatataaatggagtgaaagcaggtgtaatcaatgaaatgcacacaagaacaagagcagacataaaaacaatgcaagtatagcagaagatgcaaaagtatctgtatttactagagcatgtaactagtaatatgcgaatctattcaagagaacaaaaatggcataagttacaagtattctgaacaaacaacaaaattcaagaaagtgaaacctatcacacaacatatatttattcatgtagttgattctttctttagtggatttttcatggtattatcgaaacaatttcaagtatttgatcacaaacaaaatagaagggcagatggataaccataccaatcatatgccaccatttaagcttttacagataattgtgccatggtgttccagtgacaaccaccaagaggtacagatataaaactaattaaagcaaggagaaccaactcataatgctttacagttctggccatcacatggactttcagtctagtgtgtcccaacatcccctacttgaacacacacacgtgcgtacccgcaactaaaaagtgaacaaactgaaacattcagctttattctgaatctcatactgtcgtaaatacgttaatgtactaatgtggtgatcacacaaaagaggacaaggaattgaattaaagaaacaggcagagtccagtgcagtcctacccttccctcggcgaggtcctgcgtgccgatgttcacgacagtgcagccgatggccttggcagaattgaggcagagggtgtggttctcgttcttctcccacaggttgagcagcttcttggtgttgatggcgcgctcgtcgatcgtccccggcacggccaggttgatgagcttgctgaatcaaaaagcaggggggaaaaagagaaagaaagaaagtcagatcggagcacatgtgagtggatcggagtcgaaaaggcgatcgatgagatgagatgaggaaatggaccataggagcacgccgtccttggtgaggtggaagaggtgatcggtggccggatcgatggggagcgcggtgttgaggaagggatcctcggcgaggtaggcgttgatgtggccgacgtaggaggccttctcggactcgctaatggtgtggagcagggtggtggtggcggccgtgaggaacgccgcggccgacgaggaggaggagcgcgcgatgcccccgccgccgccgcccgccttcttcccggcggcggcgcccttgagccgcagctgcatctcggcgtagacgcggaggaagagctcgaagccgacgccctggtgcggcctctcgtcggcgcgtgcgacggccttgagcacggacgcccactcctcctccgtgagctgcgccgccgcaggcgcgctgttctccttctcggcgtcccctcctttcccggccccgacgccggcggatgatagcgccgcaggcaggtcccgcagccgcagcctcccgctcggcgccgcgtcccgcagcgccgcgtactgtaacaccaccaccacacaaacaccaaccagaaacgcgaatcacgatcaatgcggcggcggcacggcggcgggcggcggatcgagccgtggccatggacagggtcgtcgtacctgggcctggagggcgcggaggtcggcctgcgagaagcggcgctgcaggtaagggtcggagacgacgaccagcccgtcgagccccatggcgcggagcggatggatcggaggagagaggcgggggacggatcggtggccgcctctctctctggagtggtggggtggcagctcagaggagagagagaggggggatgggccgaggaggagggggaggaagagcgttagttggtttcaaaataaagcaagaggaggaaggagatgatgaactggtgtgtgggtctctgggattcggggggtaacggaaagccttgccttttgcgtgcctacagagtacaaccactcacacagtcacactagtggggaggaggaattcaaattccgtgctgggctttgggatttccacgctcgctggggtagcagtagcagtagcagtagcgggcagtggctggctggcaggtggggcgcgcggggggcgtgacagctggtcccgaccgttgctgtttgggaaggtagcggggggaggagaggaggggggcgagttctcagcggctcattcgctgccttggcttcaactgatcatcatcaatggcgttggctgcaaactgatcgtcagtggcttggctgcaagtgattactgctttgactcttcgagtttgagctcaaaagatgagagggagcccagtgctcaatattagaggcaatttttttatacgtaagttgctttaaaaaataatattaatttatttttctaaaaaaataataaatacttaattaatcataagaaaatatatcgttccgttttacgtgtgcggaaggtgagtttccaaactatcctcccaaacacagccttacttcataataatttgttggtttgttcagataattgaaacttaatcactacgatattgctctaaatcttataggttttgttgtacagtgttagtgcataattattggggggccaagctccaccttgcccacaatgaagctctgttgttgtggggattgtcagataatagttgaatttgttttttttctcaccccagagaagccaccatttacacaaaagggatcactggattttatctttgagtgagtaccctttcgttggagggacgaaagaatttctcattcatttcggaggaaaatcatctgtaccattttcatgccaaccaatacaattttcacgtcaaatgtgttttggatcgttgttttcaatcaatatgggtattatatatcaaagtaaatgcatatatctagctaatttaatcctatttattaactccaggaaatagacatctgggagcatttaaacaatagccagttgtagcgtggctggagtgttgaagtctacatatgtagccaagtgcaatttttatgtcgaatgtattttgcaccgttgatgtgtatacacgtaggcaaaaaccaaagtagatgcatcaattgaaggaatttcgcaggaaatttagaggatttgaatccttggaaattatttctaatgagatcctttggaacataggaatgaaacttctgaaatcctacgaaatggtttcctatgtccctcattccatagaaaaacaaacacttcctctctctctctctctctctctacactctctctaattcctgaaaaaattatgtgttttatttcctatgaaatattcaaagtagggttcaactttctaactgagtgttggatctcaacctccaacaatatgattttttttgcaaaattcaatcaaattttgataaaatttattgtttgaatttgaattcccaaataccattcaaaatttcactcaggcttttgttgctcgtcgaaacctcaaaacttcatggtttttcattgaaaaaaaaaaaccttgattaaagacactacctctaacatttcgttgttttcgaatccgataggattctattggatatgacatcatattcctacatattttttgtccctgtatttttcaaaatcttgcattacaaagaagccataatcatatcctattcacttacttaagagttcatcagagtttgttgtttggtagagctccaactcctaaatttaggtcctatttagcacagctctagctccagctccacccctcctagagctggagtttagcctaacagttcagctccaccaaaactgggagtggagttgggtgtagctttctcacaaaatgtactggagttgtggagctgggtttaggcaactccacaactctactccagactcaactcctggagttatatttaggagttggagctgtatcaaacaggcccttagttccaggagttgggtttgaagtggagttgtggagcagcttaaacctagttccatctctctagctcattttgtgagagcgctgtgctcctattttaggtggagctgaaactatttggctgaacaccaactctaggagaggtggagctggaactgtgccaaacagaccctaaaacagtatgatgaaaacaataagttgcaagtactggtcgagtattgtggattggaatatcatgtcggagtgaatcacacatgaatttaaaagatgatgtatttggatggctcatagaaaaacaattcggttttttggatggattctagagaggagagacagagaggagttgcattggatttctcaaagtaaaaagaaaatgaaggttgagctcatgtgctaagggcatccacaatgtacatgaaaaccagtccataggaaataaaaaattccattcagctatcttaacacattgtgcaactagtctatagcaaagaaataacaaaagttgtccatagcactatgggtagtccatagacaattaaaaaatcatagttatgccaggtgcatgcatactgcagcctgcagcttcagctccggctgatttttttttttgcctttagtgggacccaccttaattgcacatattgtggtggtttctaaaactatgactctcaggtgtgggtcccacatctatagactagtttgccaaatacattggtgttgccctaatttcctattgaattgaggtataggattgaatccaaaggaattggcaacatccaaaacctatgttctaaacaacctacttagaaaaaaaaattccttagtatttcaatctgccaaaattcctacggaactctctaagatccaagtagccctgaaatcaaaagcataatgtcactgtagaaatatcacaatgttgctgcacaaaagcataattcacatatactatataaacagaatgcacttaatggttactgaagagaaatcatcacagatcttccaaatcgttagatggtacttgatgatatatcaactattcttccgtacgtacccaaacgaatcattttcttgctatattggactagtcctcagtaagatttacgattctgattctccatattgcaactgtaatcagctgatcaatgttgtaacatctctttatttctccttttctcttcttctttcttatactggaattctctcttcttttgctgtatttttattttctttctctcatccctcctctccatgttaccttttctctattccttttttctttcaatttctgtatctttgacccaccgttaaatacaggttataaggtagagtctcttcaccattttgcgtcaaaaaaaaaagtcgtgtgacaatgtggcggtgccgtctctgatattaccagccggacaaagcacgcaatcttaaattgattgcgatcggccaaagtatataaaacacatatatttatatttatgggagataaaatatgtcacattgtgtaatacaattatataataaaataatctatgagtaaattgcacctgcggtacacaaatttaagaggtgagtgcaatctctactatttaccttttgaaccaaatatatcgtttatccttttgaagtagacatattgtttatttactattaagcaaactattttccctccttggcccttgctaacgatgcgttgccaacttaagaagaacttgtttttcattgccaagtgatcagaatctacaaggtgctcatccatgtcaagcatagacctatgttttacaccaagatacatgcttctgagaccattgcctttttctaacaacttaatggatgtaaagaatataatgatgtaaaagtatgttccttgacaaattattctagttatgtcattttcgcttaaaaagccttttttttttgggggggggacaacattatcaagggatttatatggcattaacttcaagtaatcaatatttacttataaattaccatagcacaattgatggcgatgattgacaaattgcttaaacctccaagaaggaaaacctgtttctttagctacaataatccagcatgattttttaatgagaaaacataaatgcatggctacgaaaataggcatggtattgaagcaccatatgtaggaactaaaaaaaaagaggatctgaatcagttccattgatcccatcattaccaaagataaaatatacagtacttgcaaaaaccttttcgtctaacacgtgaatgttaaacaccaggcactgtacgtgtttgggactttaggtcatgtgctacccattgattgttttttttaatattactgatactagctttgtcgaaacagaaaatactgaactgtacggatgtaccctattctttgcttaatagtgcttgcttttctagcaaaagctgagcaacctcacttagtgagtccatttccaaacctccaatagttttttttaagagtgttccaagagttcgtgacaaatattcatgcactttcctctttggcactgttacttttggtctggagtttattgttctaattctgcatttactaacata

SEQ ID NO: 40208 - DNA, 15317 bp, Oryza sativa
ctttcatcgttcagtacaaccttcacacgctggttacagataattgcttgtgctggagctaatgaacacctaacaactatgagagtgacacataaatgatgatgtccattatggtatcaagtactgaattaggccgttgatgacctaccagagaaagctaaaagggacgaacctccgaaaaaacttcaaaaggcagggtttgcctccaagtttggattgagaaattgctcttgtgaaatcttcaattcaggatattcattcaatccacaccttgggtaaaatgctcttcttttgtttcaaggagctttagggtgttgattacctgtaacaagaagcagcatgtccctcttgatggtggaggaaatagacatgttgcatagaaaagattcgaagtgtaccttgcaaatggaaggatgaaagtttatgtgcagttttaatccgcaaagggaagaaaagatgccgacatatttgtaatatatggctttgatcatcatcaatttgcaacttagaatgtagttgcaattattagataagaacatgagcaagatggatgtgtggcgtcaaccagcaaggactaggcttttgaactctcttgatgtgatatttctgatatcatgatgtatatataagcatatatgcaatgcatatgtaccaaacaagctgaagtgcatgcacacattatatttatggagggcccttgaggtgtggtgcaaatgatatggcaaggatgctatcagagacagttgtttcttcatcctagtgatacaggaaatggcatacagcatcatggaagtgccccaaataccaatggaacttcttttcctctcttgtgggaaaattggaaaaaggggatctgaagaaattaccttcgtagatgattgaatgcaggctttatccctgaagttttaaactgcaaaaaaaaaaaaaggtggcttctggttttcagacctttcagacacaacacaaatgaaacagacattgtggaaactgtatggagcaagagatggggggaccaatgtatgttcctgcaaaagggaagtctcaacagcccatcacttagtaggcaaagcagcagcaacatgtgggggcaaaggaccatgcccattgacaatgagccagtcatgtaatgccagggaccaaatggtactgtaggtctctcatacatggatgcacggtgtaatctcgaagtatgccaatcttcgggtggtaggagtaacatgataaaatacatagagttgagaaggatgacattgcacacttgagttgcgccaatggcctacagctacaaacaaaagagtgaaatgttgaagaactaaacacgataactgcaaatattacattggactgactttggctcgtgatccaccattgataaatggtgagaaacagcaagcttcaagcaatcaaaggtcgctttcatgaccaatatgatcaaagagtaatcaaccagtatgcattagggtttctttccagctggcacaattttagcatgtcacttgtgggaccaagaaagagacatgaaaattcttcttgagattcagaaacctcagctttaccactatcattttctggaatagcatggatggaggtttgcgttagaagtgacaacacaaatatgaggtgagtcctatcaaaatattcagcaataaacgttgagattgatagtgtaaataaaaatatcacaactcatggtatgtaaatcactgagagaaaaaaaatattgaaaatgaaatttcaaaaagtggagcagcaggtgcacatggagatggaaccccccaattaggtgcaaagaatatgaaatgtccagaatcagcttgacaagattgttaaagcagaaaatcttcatactgtgatactacgtagcttcttatatgaaaagatctagggccaccatggaccacacctatttagtgaccaactaggcttcctatcatttgaacctaaaggaaaagaacaataatggaaaaactggagtcgaatatcgaacataacaaatattaagtcagacaacaatgaagtccgatacttttacgattattaacaggtaatattaacaaggtttggactttctgaaagtggtaaatagatgatacctagtgaattggaatttgggaaagggaaactccgtgagggcagcaaattcttcaaacaaatacgcccatcgtatttgcatcatggctttgatatcacaagccaaaataagcacaaggaatatctgaagcaacaattttcaaatatcgggctgaagcagttaagtcttgtgtcttacactcctcgtctctcgagttttgtggactactactgaaaaatacctctatgtgttacgtgattcatcaatccattgaggtttaaaagatgagtgttaacagattgtactaagtcaaaaaccaagaatgggcatggacaaaactatgccaagaaatacaaaaagcatacaccccagaataaaaaagcagtaggttggatgaaatatttaagccattacaaccaccgtttacatttccaacattgatgcactcattgtatgattagctaaaagcttgaaaatacaaaaatgagaataaattgctagaatgcaagttaaaacataaagtccacaatttatttacaataaaagggcaaagaaaaggtcttacccttatagcaccatgggtgtggtgagtatttctgatttcatttgggagaactacgggattatttatggatgaatagagaatatgaacttggttgttatcatcaatgcaacacaatacttcttgagcatacatatcttacttgactatttcttgaaaactttcaaaaccaacttcatgcagctccaggatcccttaggaaagcctggaaagcatcttgagttcttgacctagtactgcaaacctgcaatactaggatttcagtcggtctgtgcattttagaaattgcaatccaacacatcatatgataaatgatgtttattttacattttacgaatataaatctgaagcatcggttgttcaaaaagctttgggcaacaagcaatgaacctaccaaagattcaaatatagtttctgtacatgattgcagctcaaaagattatttagttataaggaaaacattcctcagcaggaactaactgatcaatgtcaggactgggaacacattgaagaagtatttgatagtagaaccattcttcaatatacattgaataagtatttggtagtagaaccattcttcaatatttcagtcatactattgctcaaaggaagagaccattcttcgagtcataccaatttaagatctgttgctaaaaggaagagaatgtgcagaaccttgttcatttaccaaatttaatcagaaaaggggtcccaaaatggggcactacctgctaaagttcacctccagtgtctcaggcagaagtagcagcatattatttccagtagacagttcgttcagtgctggcagactctgtcaccatagaactagttcgagaccagtctttcctacaaaagagaacagttcactgatctaatcataattatcagggataattgactacagagaaccaagcatcataagtgctcctctaagtaatagaaaaaaaacaagtaatctaaatagcagactactaggcttggaatcttgtatgtgccccttaaggaagctaataagaatttaccacactaccaaaacaaagtaatcaaaccggtatagcatcttttaacaatatatttgactatgccaagcagtttcattacatgatcatatcgtttagtctttatttatcattcagatcatgcaacttcaatagttggccaccttcctatgtttgctacatctgtgctgaagttggtgactagaatactccaaaaatttaatcacataaaaaattaatatccaggttaaaaatgaattatgctatcaatgtcacatcaagtgatctcagttgtttgaacaaaatttcagaacaagaaaagcctcaaatgtataaaaagataacaatatgtgaaatgataagacataactggaattgatctatatatcagaggatagttatctgaaacaataaaatcatttttaaaatcttaaaacacattcacatgtaccgctagaggatagagacatattttatgtcactcttggaatattttagtttttgacacaaaacaatgtgtcgatgttaaatcgcacatattttttcatcatgtccaatggcacaactgttgtcattgcaacaaaaaatccaaaaatatttaaggatgaacaaaagtaatgtagttcatagcatatttactaacatagataagctaagtacaatgcttaatttcatatttctcaagatgactgctttacaaacttacactagtgcgaaaaaaaattggccctaccatataatctcgtacccacagtaaaaaactgaaccgaattgttccccttccccacttattgcccttgtaagtccatacgacaatatcactcatcaagtcctaataccatgagttgaagtcgatcagctgtactcccagactacccttgtccaatataatcctccttggttcatccgattcagaccattgtctagcaacagcatgaaaatttgatattagcacatgacttcctggattttctgggtcaacctccagaaggtgcagagctactttgttgcctctcaacacatccatgttagctttacatgcattcaacatagccacacagatggaaccagaaagctcacttcgggttataatgaaactacaatagagataccatgcctcatcattctggcctgcacggcctaatagatcaataaaacatgcatagtgctctggtcccggattaatcccatattgtcttttcatcaaatgcaacatagctcccccttcatccacaagaccagattgtccacaagctgaaagaacagcgagaaatgtaacttcatttggcaagaccactggtgcaactttctccatccttttaaacaaacctaatgctgcttctccatgaccatggcaactgtaagcatcaatcatactggaccaggaaaccacgttcctgcaagccatttggtcaaacacaatgcgagcagccattgtccgcccacattttgcatacatatcaatgagtgcattacataagatcgtctgtgaagtagacccatgacggacagccttgcactgcaccagcatactgtacatcaaattcgctgtcgctgagcaggcagtgagagcacatgtcagcgcaattccattaagctcaatcctccccagaatcaagaaagcgtccatgaatgatctgctgttctccacacagcctgaaaaaacagcgttgtacagaacaacatccttccggcaatccgtgcacagtgcactgtgcacatgaacaacctcatcgcttcctcaacaaggacatagctcatatagagatccacaagcgccgtcgccctgatgacatcgtcctggcatgcaagaacgcagcgcgcgtggacctgacaggctgacagccagggcggagggccatggtgcagagggtcgcggccgtgggcgcgaaccgcgcggtggccattccccggaaggcgtacgctgcggtgccggggcgcgcgttccaggcgacggcgtcccgggcgggcatttcgtcgaacaggcgggacgcggcggctgggaggcccgcgttggcgtaggcagtgaggagggctggagggcggtggccgggatagggctggagagggaggaagacttgatgagggtagcatggactacgggagagtcggacgggtgggaggagaggcggcggagcagcgcggcgagcggcggcggccgccgcattgcgcattgcatgggatatctatgacgggataaacgctgtatttagctccggttccagccggcagccgctgccttccgagtcgtggttagagcaaggataatggattaatggtgagttctttctcccaacttttccctgctcatatcctcgtgttccgcgtacgtttttcaaactgctaaacagtatctttttcatgagaaactagaaagcaaacacagcctaatagtagagctcacttcctacaattagtttattttaaagccaacatataaaatatattagctataaaattggctacaattttcttctcctctctatctcacttatacatttaatgtatttgtcctgaagcttgtgttaagctagctcttgtatgagagccaacacccttgattttttctgttacctctcttatttacgtaagcttataataggcttatagcttactattatccttgctcttatctggctttcttgaaacatgttgttgtgtactctttcttctcgattcctgccactgcgaccgccaccgcaaggtttggtggactttggagttatcccgatactggcgatatgaatgctagtatcttacgattatatcaagccgaaacaattccgatctcacatagtatcttaattttcatagtatctcaagacaacatggatagatgacacaaactcacaaaccccacgaggcaaaccaaacaagaatgtagatttaaacgcaaaccaaaccctttttttttaaaaaaaaagaaaataaatcaatagctctggtcaccctatatacttatagaaatccccactaagtgtagttaatgttatttttctcttctcttattaagccacatcaccttaattatttttagccattggatgacaaatctatagttcaaattgtctcttctttcttctctcataacaccaagtaatctcaatcatttttaggcctcaaaatttataagtatcaatttgttttagttttaatattcatatttcatcttatttgtacatattatgcaacttaatttcccacagcaacgtggcagggtattcatctagtttatagatatagtaaacacatactctctctttcatctggtcaataccagtagaaatgtagaatctcttagctaacattcaaatctttagatttggatttactccgtgaagttatgcacctgcaactttgtttagtgcaatagcgtagtattgaattttcggtaatgttaatagcaaccatctgcttctagtcaaatggtcattcatcttaaaacatacttatggattccctttaagaatctcaagattatgaggtctccttctgagagcatgagcaatgggtggctctgggtcgtagtcctagctcacaccatccggctttcattgcctttcgaacccgcgtcgtcccctaggagagagccagagatgcgcgcttgctcgcgggggaacgcgcccctcggccacttttggcggagccacagagccaggctccgcattgggcgcaccgtggctagggaagtagctcgtggacaacgctccctacccccgtatttccctattcaccctcgcccccctccctcgccgtcgccttgagttgcgtcgcactcctcctctttctctgcctcgccttctcttctcctcttccatcctcgctgagcaagaacgcaaggattagatctgagattcgatcttccactcaccctgccataaagagcaagaaatcggagcaggacgagagcagcggagagtgaagaggagatggagatggagtgggcagtttctttcacttctccctctctctctgtacacgtctcatcactttggactccgagccaacaaaatgcttaaacaagtccaaaatgtttctctctctcatttctcacctctcccttcctcttcaatgtgactgcacagagggcaaggagaccgacaaaaaaaaacaaaaggagcaaagagcaagagaagtagtactccagtgagggtgtcggtgggctcaaaagaaaaaaatgtaagagagaaaatatatagcaatggctacgtggattggttggattggtgcacactgttatgggttaggccatctataatcggtaccctcaacgcgtacccttgcaaacggtgcctcctttccaccgccgggtcattccctgggaaagaggcgcaacgcctggcagaggaatgcgtgcctcggctgcttttctggagccaccgctcgaggctacgcgttggaggagggcgtggctcgtggacacggctcctgctccacaaatttccccttccaccctcggtctcgttgctggcagtggggaggagtcggaggcgacagcgacggcgacgagcgacggccgccaccatctccttcccaatctggccaggaggggggatgcagatccgtaggcgccggatctgctgccccccgaccggcgacggcgcgaggtggaggagattagggaggcggacgacgcgagaagaagagaggggtagtatagtaaaatacctacgtgggttttttttggttagggacactcgtgggctactaggggtatcattcattgtgaggggagtttccctacaagtatcctctagtgaggacactttaggagtggctcacattgtggatgcccttagagtatctccatccagttgcttcagattttgaagagtccagctacaggtatcctccattgggatggagtggcttcagttagtgagagtaccaatggagtagctttgattgtagatgccctaagtgctgaactcaaggttcatgaatccatgaacttaacatgcagattgttacaaagaacattgtttggcacgtataaatctgaacaagtctatgacagcggcactctcaaagaagacaaccgctgactaaggtggtatttggatccagtttagttcctatcacatcagatgtttggacgctaatttggagtcatgaaccataaacgagtaactcagtgtaaagtttgcattactaaaactgtactctgatcagaatgtacaacatgatttacctgttttctatacagaaagtttgacctaggattacaacaaaaatatgtatgctttactctcagcaacggaaaatgtattttctgtctaccgtgacctccccgccttaccaacaatgaataaaaagaatttccaccttgatggttgtgaaaaagcacatgttaccagagaaaatggagctggaaaaaaatatgaagaattaacaactgggcatgtatttgttaaattttaactgggctcatcgctgccttttgctttgcctcgtaacatatctccaaaaccacccagcattatacgaccaaaccttgtgttctcttgctgagtttgtggggtaggctgagagggggtcgtggcagcagtatcatgttgttccccgctctctttcttcacaaggaggctgctctcaccaaagaagctgctcatcgatgatgcaatcccaagatgtgctcccattaccttgccaaggctctcaagtttacctcccgacctttcgcgggctataacttctagtgcttccttgtgtgcagggtctagagcatccagatcttttaacaagttctgtattgacggcaaaagcagatcacgtacgcttgtagcaggaagatctgcaacaaataagagaaaacacatgtaagaaatggcagattaaactatatggccaagccaaaacagacttatgactatgggttttactaaatatcatcaattaaagtccctagttaaaccatgactgggcagtgctctactaacaactaataaactggtgtgaatcaaaagccaaaggagttgttgattctgtcaacactggtaacatgttctacccctctaaacaaaatataattaagttttgttcaaaaaaaagaaaatataattaattaatcattccattcattttgttcacttttataagttgtattttgatttcaaaaggtcaaccttttagactttgacaaacaattagccagattataagtactttcagtatgaaaaatacaccgcaaggatcatattcaaaatgctttcacacaacgctagttttacatcttttataactacatattatgagacatcaatggttaaattttaattttgaagagtgtcaaactaaattgtcttatggaagtaaaccgaaggtacaatatatgcttgtaaagatttaactacaacacagaagggcatgattgcttcactctcaagcaacagcacagctgtatttacttataagtttatgccttaattctgccctgtgatgttgaaaactgaaattatttagaatggatttgcaaatgaaaacatagtctattgttcaaaagcttctgttggcttcatcaatttaccatgtacaagatggtactccatctctatattaggtaatcaaggatacagtcaacctttcaaaacattcaccattaatagacatgccaaattgtatggattaactgtatgaaaccaatgtatttgggtttgtcacacaaatacttccgttacatagttttatttttactagtatgctatggtaagaacccatagttatacctaacattggacattgtaaaaactgaaaaatgacttgatagtttaagacagaatatgacagtaacaagctaatatgggatcaaagttggatatgcaagtgaacaaactaatgtaaatggaattcctgatataatatgtcattgctaaatacttttcaaacgcatcttgaaatataaacaaaatatactgaaaatacatgcagatgccgacttgaccaaagttacagggttgtggtataagggaaggattagctagttttggataaggctaacctgtagcatccacagcacgcagtgcttcacagaatacatttgctatctcacgacgccgctcaatatcatttccagtaggtggggcgctcgttagcttaaatatcttagttaaaagatgtatgtaatgtcaaagaaaacagaacacacaagcaatctaatgaatcatgaaaaaatggtaaagactttagaaattaaatgcggttgataggatatattcacgtagtctatctgttgtatgtggcactgccactgcaagtgcacgaataacagaaacagtagcttcatgtgatccatcttcaagaaaagcatccatttgaattcgtatcttgtcaacaacctgacagcaagtctttaaggcaatgcacgaagtacataaagtatcaaagaaaataaatgaagatgtatacataccatgtcatttttaaaatgctgagcaacagctccaaatgcttctatactagcatattttaccgtcaagttttgatcagaaccaagggttataagtgctggcaaaacatgagttgatgctactttcacactgatgtagggtacctgtgtgttaaaacaatcaaggataccatgaggaacatatggaaccaagaaggcaaaggtggtcaaccctctaagaaactaccaatgcattcttgtaatgaattaatgatacgcttacaagtgctttcagtagagctgcagcattggtttttaggttggcatcagagatcacaaccatctcccacacaatattaaatacagcaacatggtgctcctcaaacatgctacataatgataataagtgagacacattaacatagagcatatcaacaacatcgtgacactggctgcattatggattcagttagttaaagcacgaaccaaaggaaccgaactgcgtcaatgatctcagcagtgtgatgcatagaaaatgaaccatccttcgtgttctggataagtaattttctcaaatattcttctaattgttgacgttttgaaggataacccaaaataccagataacaacaatggaaggacacacacaattccaagtttttcggcaatagaagtttttggacgcaaacctgcaagatttaaacacaatacatacaaatgttgaacaaaggaaaatttaaaccaaacagccttgccatattaatacaggatacttaccacgaactctagactgggttgccagaggaaaataggtgaaatcactgctgtcaatatcccccgctgctacaagaaatacaggtagcataacgtgttccagataatctatgccataacgtcccgatacatccaataggtactaaaaaagtttcaggaaatgattggtcagaattttatacatgataccatgatggaaggatatgcataggtgttgatgtgatctgtagaatttaccttcctgatcaccgttcttaagttatcctctttagcaggcaacaggcaagcaagcttgatcaaatccggtagacactcagtgtgcatccattcaaatgctgaccactctgtgtcacctctgtcaagtgtcccaggacacaattagttgatagaagataaataaactctgatggttcgattaaattgatcgtgcaataaacatcctaattttgaccactgatataactaaacctatctagattagccattcgaaaatgatgccactgcatatactttgaagatatcatgtttttacaagttccttcatgtgcataactgctgaaaataatgatcaaatatacactttggagaccgttcaatttcaaaaacgtcatacatttaagaagagagggagtagtaaagttttcacacaatattacagaggaagacaacttacgctgcatacagttttaggcaggattttgagaagtagctttctggcatagtgcctgtagaaggatcagcagcaaacgggcaagtagatatagctttctggtgaataaatggtagcaactcggtcaacatgcggaggaggacatcaatgttccaacgctcttgctctcctaaaacacggagatgagagtctattgcaccttcaacccctgaaacgggcggacagcgctgaagcataacaattgtgtcagaacacatgtggcacttcaaagaaactataaggttcccaaaatttacaaacatgtatacctgagcggatgccaggatatgtgccagtaagattctcaatatctgatccagtttatctccccatcttacaacagcaggaacaagttccttgagagcaacattcacaacagcccccgaagggtcacagaccaactggaacattagctcctcaacctaccaaacaaacaggaaattaagaggacttccaaaataagtattatgtttcattgatttgtagcgcagcaagctttcaatcaaaacatatattctccactaaaaaaaggaagttctgacgggttaaatttaactaattataagaaaccaaatttcccagttattggctctaagcatttgcaggacttaccttataatatttatccagatttggaaacagaggaagcagcaatgtgaggttatgtgttgcagcttcccttacaaccgttgcagaatcttcaacaagttgttgcacaatggataagataagggaatcacgtatctcaggacgaacatatactgctaattctccacaggactgggcaacaagcaacctacgctcctcatattggtgatttatctaaacatcaaccaatttagcattatgtaatattatatacctaaaaaggttaaaatatctgccacaaattgtcaaatacctgttcccaacattgtggaagtaactcagtttctgtcctcatctcacctacactcttagcaagctccacacaagcctgcgtgaagaggaaaacagttatgtgaataaccacaatttaacctagtactataagtttgcaagctgcatcatgagaagtgcatgtgccatgcaccaattattgcaattgtaggaacttacatccattatgatgcgtctctgttgtccatcaggacgtttgattagattgaacaacgtatgagttaaggaatcacgtacatcactatctggatgtttttctatggcacagatgatcaacggaagaagctcctacaacagtgcagcaagtaacataagttatacttatataaagattgaaacaaactacaagggttacaggtaaacctcacgatggtttataagcacataaggaacaatctttggaagagcatccgaaactattttgatagtctccaaagcctgcatggttggataaaaatagtttgcttaatgaaatttgcaaagaaataaatgtgaaaacttcatacagaccgaatatatatcaagtcactaaccatcttatctgatgattttgtttataaggactctctactttctcggtatgaactttatcgtcagttagataaacagatatgctatctgaatccccctggctattaccagatccatgcagattgccattgacagataaatcttcaaagcaagtgtttgtgccagatttatcttctcctgaagtgccatagccactgttctcagcagttgagcaggaaacttctgcttctggacctggggaaccttcaaggctactttccatattttcatgatctttctttttaccctcagctagactcacctccgatgctagcttacttgttatggattcggatccttttagattgtcatgttcactgctcagcactactatttcttccatagaattggcaggaattaaaccatcagtatctccagaagataatcgtttacttgacctagtcccttcaatatgcatcttaagggacgtaatttcagctctacaatcattcaactccttcctctggacatccaatgattgcttcaagtcttgaacctttcttaaaatgtcagtgtagcaatgttcagaagaattgaagtataagataactgggttatttctgagagatcattaccgttttctccttctcttttatgtccttgtgtgcagcttccaaagactttcttaaagcagcaatctgactattagccacttccctgctctttatcaaagcatctttttcagcaccaagactttcattgtccttcagtagcgtctcattttcgcggagaatagaaatcttttcctgtgatatgtaataaaagtgatgacttaagaatatatggaagttatgggcttgcaaggaaaaacagagtctttaatgctcagtcatgtacttctgtggtgcctgttttcccaattacgaagaatgaccaagtgatcctaatcacgttggaccatgatacaagtcttggataagaatctaaaatgcactagaaacccccaggtttatgattgttactgcaataacatctagggctagtcaaatattgtgatacctcaaaatggtcacagaaaaatgttaaacatatcaaatgcatcgaatgctaaatcctgctacttattgattctcgaaaatcaattttaaaatactcttgcactgcactttatgaaatgaacattgactcatggcttatgcagcggttttatttcattttgtgtcactataactggattgcacattgttcatgaataagataaatgtgtcaactatatgcatactccatagaatgtaattattactaaacttgaatatgatgtaggcccttcctattagcacgttacttggattctgtcaaaggattgcatga

SEQ ID NO: 40209 - DNA, 5553 bp, Oryza sativa
cttttcagcttcttaagctcacataatcaacaaattaacataaataaatacatgcatattgtaggtcaaaaaatcatacaaggatctatgttccagtgccagtagatttacatttagcagtacatagttactagcataactcaaactgtgcactctccagctggtatgtgtgccctgatattgatcattacctcataattaaggtacagtgcaaaaaatgctaaaaagtacaatttattgtctcaaaaaccagttaaaagctatgatgcgcgctgtcagtaggacctcccctcttatatatgtatgtctatcagttagcaatgaacacgatgaatgatgactcactttgaattatctagtaaaagctagataattagatgtcaccaataaatctgcagcagagcgctcaccgcaagctagtggcccttgaagaggcaagtgttttacttaaaagtaactagaatatctcaagcttgtttgtggaaaactgatcaaagccaatgcatcagttctgttcaaccttattgaattgttgagtgtaaaagttcctacagatacccccagcataagccacattaatgcttataaccttcaaatcagacctgtcttttgtttatttcctgttaccctttatgtccatggtacttcttcttatttcctttaaaccatatagcctccagctgacaagcaaatgccatgacaacaaggacaatattgttcaatacaatcccaattcccaaagatcactgagataaacaccctctcgcgtatcacagccatatttcatcctcacatgagatggaattttcaaagttcaatatgtaagccacagaataatgagataattttcacttttggcacttatctgagtaccaaatgctttaactattgattccacttcaatcaaagaatgtaaaaacagaaaacaatagtttttgctccatgccatcacatgaaacacaatatcacgctatatttgtcatttcaaggttacataccggtagcatttgagccatcaggagaagattctttctgcttttgtaactcaagcttcaacctggaaagatcttctctggctagccggagatcataatcagtgagggccaacttttcttctgccgctattttctcttccagcaagctctgtggatcagcacctgtcaataaaaacatagagataatcacctcacagactcaatgacagatgttagaacattagattgaacacaaacaccgcatctagtgtacatggataagcttgcacaaaaaagtgagtagattgttgagttataccaagaacagacccaaacatttacctgtaatttatttgttctgatagcattgcttggcccataatccatatgctactcaattttaatgatattattaagtagttgcaaacggtgacataaacaatgaaactgccacgccttgtgtggtctaagtaaatttaattgtactgttcaaattaataatgccccttcaactgcgaagtaactaaccaaccaaatcgtctgtagaatgtaagtcgagcaccaaggcacatacacctaacataccaacaacaagatgaattcaacagcgccaattcggacgtaatgcagggatattatgaacataatggcaacacaggaagcagggagcgccactacgccgcgagatccagccagctgaggaaaagggttgggggggaagggggggtgcaaatgcgggggacgcaggggctcaccgggcggcgcggaggacgcgcgggcgacgaggtcgggcgggaacagcgcggggtcggagaagaaggagcggaggcggagcgcgtgcgcgtggcggccgtcctcctgcagctcctgcaacagctcgagcgccgtgaggtggtacctctcctccagcaggaagttcaccacgcagttgcacagcgacgcccaccgctcctcccccgcccccgcccccgtcgcctccatcacctcgggatctggtggtggtggcggtcgccggcgccccacccggtcaatcagccgccggcgacgaggcgcgctcccgccgcatgcggtggtcggtggatctcgagagaggccggtgggtcgggtcggaaactcggacgagacgagagaggcgaaggcgtgtgatttttggaagggaagagaggaggaagaaagaggaggagatcgacggagaggatcgaggcgcgcgctgacgtcagctcggctacagaccgctggtgtgtctgatgtggacacgttgcaaatttcaaatgggccgaaatgacgaaggcccatcaggtgccggcccatataaagcccggcccttccttccacctgctagtaatctcacgaacccttgcgccgtcggtctctctctctcgctctcgtccccgccgcggcgccgccctgctctccccctagggtttgatttgatcccatcctactctctcgtggtccgcggccggattgtgcgagctccgatcggagtgtgtcttaccggtggtttcttgtgtagtgccgctgcgatttcggagggccggtagtccggcggcaaggaaggaggcggggcgcgatgaggttggagaagtgctggttctgctcctccaccatctaccccggccacggcatccagttcgtccgcaacgacgccaaggttcgcgcggtcatcctgccttttgctctttctttctcattttcatgtacagtatgttacgttttacggtggagaagcgcgcccttctgtgctcgggttttcttgaggaagaaattatcctttctaggatgctacagaatttgaatacagcagtccctgaagggatttaggtaccacggttgtacttgcttagaccaatctgtgtgtgttttgtagtactttgcagcattttttgtttgcagtatgtgaccctcattgtgtagtcacacctcgcattgcctgcccatgtcattagcgttgaaactaacgcctaaactacacaaaccaacaaagatatattggtctggaagggttgaagaatagaagctagaaagacagaaggaatttagaatttgtaaaacgttgggatgaatgtaacagctgtgggctcaattttcagaagaacaagagttagggcagaatgcagatttatgtaacccaaaaaatatgattatcaaactacaagatttgttgttacctaaacacctcagttttcattgccatagtatttataaacaaatatatggttatccaacccatggtggccctactgcatgtgtcactggctctctctctctccatctcttttgctttgttcagagtctcagagagctagttgtcccatttccacccaatgtatagagtagtccaatggtggtatatacttcttcactttcttccacacctatgtttatccatccaatttaacaatgtactgtgtcatgttcctgtcttttttcttgtttttcatagtaccaatgaattaactggagtagtggacaaaataatcgttgttaaatttattactttgacacatatgtttctcattcagtatttttctcctgctttatggttttaatagtggtggatgctaaaagctgaggtctgttggataacaacgctgctttcgtccaaaataagctgctagaacatatgaattttttagaccatattatagtaaaagtaattacattaattatgtcagtcatcaaagagatgtgggccgctagattctcctgctggttccattatattaattattgcactcccaaatggactgaaatgctatgtcatttttctcaaatcggaatcatcacaaaatatcaactcaagagacaaaatatcaacacaagagatgattgagaggagaggaaggagcgagtgggaggccaccactgcccctcgtcgcctcgctgccgtggaggtcccgagctcggggccagatcctgagccaccgctccatcgggaagatgctgcgccactgaggatccaccgcgcagccgctgtgccggggagcagctgacccgccaagcggccagggagccgtcgacctgccatgccgccgggagccatcgacccaccggatctggcgaggagcggggcggcggcaccctgatgagaaggaaagggagcggtgagatgctggtgggggagcaactccccctgccacctcccgccccctctcccccactacctctagttgtggccgcagccgcttctcgccccaccgcaaagccggcaggtgaagaagctaaggaggaagccctctcggccgtcattggccctagcgccggcggcaaagtgactggggaggattggtcgcggtggagcacatcctcgcctctcccggccatggtggctgccgtcgttggcgagcctctcgagaggaggaggtgcgcatgaacggagagtaggaggatggacgtagcaggaagggggagggaagagccggattgaggagggggaggaagatgcgagaaagagagagaacgatggagaaaacgagaataggagagaaagaacgacaaaggggatcgatatgagggatccctcgatctgatccgatctggtgaccttatctggacttagttttttactatgaaaaaaccgaccggtctattttaaagaaaaacatgaaaaccgaataagtgaaccaactggtgaggccataaattttgcaaaagcaccactcatcttttaaattttagagcgcagtccaatttttgcaatttcttctcccccaaatatacctatataccaaattaaaaaatttaggtccttatctatatatatctctatctctactacttaaaaaattgaaaacgtttccgtcatccgcaatagcgagaaaagggcaaaaaaaacatgaaaaaaaaggaaagtccgattcaatctatctaaaattttccaccgcacgtgcgatcgatggcaaaaaatgagtctgcatcaaattcaagaacacaagaaaacactaagaaaacgctgacgccgaaaggggagggtgccgccgaaccgccaccgccattgcagggatgtcgggccgccggctgctcccctcccactggatccggtggaaggggccgctgggacgctgggccgccaccacctcccctcctggatccgtcggaggggaaagcgccgcccgccaccgtcgagccctcccgcggccccatggcgagggagaggaggtgagggtggagaggcgccgctgcctgcggaaggagagccgcctcccctcccgttagatccggcggaggtgagggagctgcccctgcctgccgtctccctcccaccggaagggagggcgcagcccctacctgccgcctccatctcccgccggaagggaagagggggagatagagcggtgccgccggtggggttgggaaaggaggagaggcggagggggagaggcgccgccgccaccgttgagagagaagggggaggggaaatgtttttagggttagggttgggctgttgaacttttatataggtcgggatcaatcaggaccgtccatcagatcgtatggctacagcttctcccgcgtcgggccaaatgccactcccaggccgccacatggaataagttcactttaggtcccttaagtt

SEQ ID NO: 40210 - DNA, 12686 bp, Oryza sativa
tctagagaaatgaatattgctgccttatttctcgtgtttcatagtaggggggcagaggggtagttagggcttgagccctatgccttgctccataatccccattataatcttatgaaaatgctctgtaatttgtgataatatttgagctcctgttagctgaacgcatgaagattttctggctccaccagtagcaatgaatttaagtggacatgaacaaccattgttaaatttgatgcctatgtttctcattcagtccttttctcttatattttatggttggaatagtgatggatgcctaaagctgggcctttctgaatatcaacactgttctctttcaaaataagccacaagaacatatgaattcttttacacaatatataagtaaaatcaattaaattaattatgtcagtaacaaacattttgtcggtatgctgtaacaacattttttttgtcggttataggaatgtaacattttttttcccttgcagatcttcccttgcattcctataacaagctggattttgtcggtatgctgtaacaacattttttttcccttgcagatcttccgcttttgccggtcaaaatgccataaaaattttaagatgaagaggaatcctcgtaaggttaaatggacaaaagcatacagatgcttgcatgggaaggacatgacgcaggtatttgcttgttctattttcgttcagtattaagtagagagcacattttctatgctgtgaaccactttctatgctgtgaaccacatctgaatcgtttgaaatcaggactccacctttgagtttgagaggaagaggaacagaccagagcgctatgaccggaatgtcactgcacaaactcttaaggctatccctcttattacaaagattagacatgaacgccataaaaaacatattacagagaggttggcatctgttcttttggctcagtctgttaattcttgaaattatctctttgcttaacatatgcactgaacttttaacaggcaaaaacagggtaagacaaagcaaagggagagagatgctaaggagttggaacaggatattcaaatgctcccgaagaaggataccatgctgtcaacacaaaagacaaaggtcgtggtcaaagtttctcagcagcagaccgaagaaaatcttatggaagagtaatgaaatggaatcatgttgcatgcgctctcattttgtcatctttatgcaacacttgtgtttctaattgttactttgcaagttgtatttgactgattaccagcaagttttgcacgtactgtgtgcctgtgtgctttgtgacttccatctatatttgagccttgggcctagtaatggtgtctgtgcggacttgcgctaagcccaaggtggtgtgcaccctagggctaaccctaggatatctctaatcatatttattttatttagtagccattattgtttagagttggattttgcttagattattatgccaaatataatttcgcagctaattcgatttgtagaactccaacttcaagtgcctaatcatttatttgcaattgaggtgtcatgtaccatggtgctgcaatcgctggattgtgtgtgtaagtgtttgccaaatcgatttttatccccacctaatggaagatcgggtagcccgttgtcatcaataatctaagaactcaacctttttttatcagatctagaggaattccttcacatctattctaccatcctctatgcagctggcgcaacgacaacgttttggtaaactacctatccactacattgaaaggccctgcctgctcatggctcatgcatcttcccaaatcttcgattggatcatgggcaaagctctatcaattcgtggccaattttgccaatttcaccaatttccagggcacatacaagaggcatccaaatcgaggatgaccaccatgcaacaagacagagaaacggtgaaccccttatagcaagttcaatagtatagcctggctccaaatcatctatagccaatctaatagcccattcatacaatagttacctataaaaatatacgacatcattaatatccggtcctatctctcatacactcataacgtattgcagccggctacaaatctgtagcccgctttcttctctcttttctcttttcttctcgatacgtggttatagctggcttatagcctgctattgtacctgctcttagggacttcatacaacgctttaatgagtgccatagcactattcccaaaatcaccaaagccttcatcaacacggaagagttatcatcactcaaatatggagtccaagatcgttataccatccaagagaacatggaagaaaacttcagcaatgaagttgttcaaaatcactgataactcatgcagacgaggttgactaacaaaactaaaaggaagatgtctgacgagaagttactcgccaagaaagaagaatctggaactagaaagacgctagaacaatccagaaagcggaacaaatagcacaagccaaaaggagaggtcctcgttgtacagcgagaaccacaatattttctaactccgcgagatcctggttcctgaactccatgtgttcctgtgagaaagagtggaaatatctctatgcattctttaaatgattcagcctttaaccacatggcaagacgaacttttgatcatcaatttgggggcaaaatttggaacggaatcatttcttaacactacttaataaagaatatgagaacatccaagtctctctacactggtgatgaaagaagaatacaggttcaagagaagattctacacagactgaagcatgttggcaccatgcttgcatcaattcaccccctgtcaatcctggccttgaccaacccagaagctcagccacttcacctttggtccagagcaccaaaatttttatgagattatatgatccttctacctcatcttaacaaggaagatgggcatatctctgcttaccaaagttgtgtcttctccctgatcatgtttgaaatgggctgccaacccatcagccatggcttcctacttgcagggactgcaaaattgagctcaaacatctccttgctgatgttaccaccctcacagaaaccaaccagcctggccactatatcggcgctctcatcaatgtgagcttggtcattggggtctgtccagagcctgttcacaagctggagcttccgctgcttcgcctccaggggcacctgccatttgatgaagaggcgctctcgctcttcttctgtcagccttgagcccatccttctcgcgaggaattctcgctcattcctcaatgccttgatactgcaacatgaaatcagataattggtttatatatcacgattcgatatcagttatgactaatgaaacatttgactcggaaaaacattcatgttaaggcttttctatcagataactaagctccatcttcactatcaacatataaggtttctcagtaagtgttcttttacagaggataaaactactgtgagaaaacagattacaaggttttgcttccagcaacatccattttaaaggcctaggggacatgactcttttttagaccttccaacactattttctttttctggaattaactaacatagcccgtaaaactcaaagaagtaaaggctaatatttaccttgaggctaaagaaattgtggagtcatcaccagctgcaggacttgcatcgcccacctcagcaaaatgctgttgcaaccatgtcagtcttctaacttcgacttcaatatatatctgatcagccctatcccccctgaataataagtagaactgggtcctgtgtatgattgatacatgacagagatcccacagttggataatgtgctgcatctgctccttaaataatctgtcccatgaatcaggaccatcctgtagagatcctgcattttcctctgaatcttcttccatgtcatttgtcttgccttcattcgattccaactccaagacctgtagtaagattacaagaaaacatattttagtggtgaaacaaagtaacctttgcatgaacaaaacttatgtgtgcaagataaacgatcataacctgacagacaagcagctgcttttggtattgaagttttgcaactctctccttcagttcagtgacataagcccggatatttctaacattctcctcagcagcattttggaacatcttctgcatctttttcatgttcactgagctggatcgcctatagcgtggggtttcatcacgcgatgatacatctccagtgtcttcactcttagtaggagtagccctttctgaaccttcatgagacacagtgtcaccctctggagccctattctcaacttctggctctaaaggcctactagaagagaggggagagcatggtgctcttatcagatttggtctgtttatgttgctcacgcccagtggaagaagcatcctcttcttcttctttgctctgttggactttggtgtagtctcgttacattgtgtgccaacatttggaagtgacatcaccaatctatcaatagacctctgtacattttctagtttagcctcaagttttgcaatatcattgtcttgcatatgaagtctactaatttcttctttcaaatcagatccatttccttcatctgtgatcatgtcaacatctctgtcagatctgacagattgcatccccctgatttcagcctgtagtttagcaatagtttctgctgcatcttgattgccatgtttatggcattcgacttctttgtgcagtacttcaatagctcggttagcctcaacctcaagctgctgttgtagctgctcaagcttgcgaatttcatgctttaacataaatggagcagtggctgattgtctaatcgagctccgtatcttcattttgttacttggctgtagtgatccagaatatgtgaggcatttccgtgtcctttgtggtgagtcaaaaggattccatccctaaaagaaaacatgggtttcggaaagattaggttgacagtaaatgaatgtggttctgactggctgatatcctttgaaagaaaagtaaatttgcaaggaaagggcaaatactcactggctgattatcacccatcttcttctgtaattcttcaagtttcaactgtgcattgtctctttgcttcttgagttcctccatttctttttccatctgcagtgttcacttaattaggtcagttacaaaatggaaatgattccagtgaacttcatccttgagcatagacattacctgtctaatcttcctgtccctttccattataatgatctcagaagaggaggcacgatcaggggttctcagctcagcttcgagtctagcaacttccatctgtaggtgcttcaccaattgcttatctgataccacctgtacgtaccaaggcccaagggatgaagatttgcattctcataagtaaataaatgatgcatcacagtcacagatcttaccatattaacttttgcattattcgtaacctccttggcacaggttgcaaagaatagagtatttctagattgttctacatgtgtttgcgctggactcatggtacagatgatggctgttcttgcatttccacccaaagaaagctggagaatgcgtgtcaacttcgagtctcgatagggtatgtgtccacttcttttatccgagctgcattgaaaatttagagtcagtctgctaatattcccaataaagatatacttcattatagtttcctgttcaaaccaagaaacggtaaaaatacaaatatgcagtaaattatctaagtagaaaagaggtctcaaactgtgtattagcatgacactgcaaataaattatctagtttaacgtgttcatgacactgcaaataaattgtctagtttaacatgttcatgacactgcaaatacacaatgctgcttattagtcctgccataccaatgtcacttagccaacacattcaagaacttacaattaactgtgttgcagctatgagattttaataaaactcactttagttctaaatatgcagaatgattaaacagtatagtggcaataggacagagtacagagcaattgcctcccacttaaacaaagtggcctgggaatattttgatctgatgaatctcattagcatgttttagaaattcattaggagataagatacatcattaacatactgatatcattacaaatcaacagataacattagaactgagactaacccatgagtgcatcgaggtaactcagcgactactttcaagattggtgcagataagagataatagacccagagttttttctttctttctttagaaaatcataccttagctttctgatgacagtagtaagagtcagtaagctgcgatttatatggcagccttctttcagtcttgcgccaactgcatgtgtttgtgcagctcgttcacttccagcaagatcaacaaaattctgtgaaaaagcaacacatattattgagattaaaaaaacagcatgtacaccattgcaaaatgaggacgttatgcttaccagattagccacaaaagatttaacacatcctgacacttcacggagcctactctcaactgtctggatagagataatgcacaataattatttttctcactttcatgaaaaagatctaacataaacatggaggcttatttttatatataccagcctaatgatctggtgggaacgtgaactggtgtcatttagtgcagtctccccaacctgtctttgttctgcagtcataaagacatcataagcaataggctaccgcgtcaacaaaaaaaaaagtaaataaggcaacccatttcttctggttcttcttgaaaaaataagttaagacaatatatacagatagtagttaccttcacaaatactgattagatgcctaagatgttggctatccttggcaatttcttcttccagtttttctacaattgttcctttctgtcaaaccataacaatttattaaaggataatcatggcatgcaagagaatatgtgggggcagtgcatagactctgtcgaactggaaacaaacctcaggatcatctaacaagcgaagattggtagactcaggtcgtagaagatccttcacaatctcattgtaaatttccatagcagatatcttgatgataaagtccctctcaggagtctatgcaatcaacaaaagcaagaaacaattatgtgttatgtgcattttagaaagcaatatagatagcatgattttgttgctccatgtataaaaaaactcacattttctatgtgcctgtatatatcatttacagcactctctgtgacgcctctcatggtgaatgtcttaccactgctggtttgaccataggcaaaaatggtggctgcaaaacaaaggaaggtaaagaataaagagtagataaaggatcattcaactttattcaaactactgagtgagaattaatttaccattaatgcctgtcaatgcagacatagcaacatccttagctccctcttcatacaccacttctgtctgggaagctggtccaaacaccttgtctggaagggtaagatggaatttaaattagtcaatttagctactgaggtaacttcaaacttataggattgagatatgaagtcattgatcaagagtgtcactacaaacataattgcttgagatatgcagtcatgaatagatcactgaaaagcctaccgaaagtgtaagaggtgggtgcagcccgatcctgtggggggcccttgtacaaaattgtctggttatcatcgcactcccatgccacctgatccttcaaggccagttctttcttgctcaatggtcgcaccctcactgtgacaaaaatcttctcctccttgaccctagtgctgccaccaggggttggggtcgacatcggtgtgcgctcaatctttgatgcaggggtgcttggaggtcttgatacacccattttcgctagtaaattgcagattccttgaagtctggggaaaacagcaagaacccagccttctcacgaagctggcacaaggcaaaaaatggtcagattcaatttatcacacagttgcacataatattggcaaacaattccgggaagatagctctgcagcaacaatgtgctgacctagccaacacaactatttcactattacaaaggaaataaattacatagtcaacacacaaatatttcatttattacaaacggagtaaattgcatgttttacttcaccattatgagtagtattacaaggagatctattaccaccattaatgttaaattttaaaatgaaaaacgaatgaatggacggcactaaacaaggcaagcacatctgcacatgtgcgggtgttttttcctaaaattatagcgtggggcgaaaattactcaatttcatacataaagctgtgccaataagatgtaatcttcataagaagaaatgtgttatctgcatcgctcgggtcacattcagatacaccccaatctaaattacgaaatggtaccgaattcaaaaacttcggatcccctctccccacctccaaaaaaaaccccacaatttcagattagggccatgggccgagaaaaacacgcaaagcaaaattggtaagaaataaaatgagagggagacgaagtgtattaatatttggaaagctcaatctagcaagtagataccgatcttaaaaaaaatctagcaagtatattcatgtatggaaattgcaatctggtaaactgagttcacaaacaaaaaattccacgagttagcgccaaaataaacagcattcctttcatggacgaacccgccctgtaacctccgagcggcaaacccgaccaacttccgttctccatccgccgcgccgcgcgaacgcacgggaggccacagcggcagatcggccggttccgccgccgccagcatctgcaccccccctccttacggactcaccacctctcggctactccgtcgggcccggcgggaaaacggcgccggccgcaggcagagcagaaccagggggctcggaagagagggagacgcacggggacaagcagaagcagctgaggaaaaccactcaccagcgcagcccggggattggggatccgaccgcgcaacccgccgatcgaggccactgccgctgcctgctgccgccgagagccgccgccggcggtgggcgcgcgcccgacgacgaggaggcggaggcggaggagcttctcgccgtcgctggtcaagggcggcgcgtgcgatgcgccgctcaaccaccgctcgctagtgctagcgctagtactactacgtagtacagtttgaattctctccggctcggtgtgcgtttcagcgttcgtttgtaggggagagagagatagagagagaaaataaaaagaaaaataaatcgagggggagcggagcgagcggggtgacccgtgcgatgtgtgggggagaggccgagtgaggccgcaacggctagttttggaaaggggcatccgaagcgccagtttctccggggggacgtgcggctggcaggtgggccatggggcggagttcggtcgtcggacccaccagtcggtgactggtgtattatggtatgctttgatttcaggtgtttttgtgggggggttttgctgctagctggcatcggtagggttacacagtagagtggactagacttggtttaaattcactagcattgtttttttttggcatacatggctagtgttatcagatgcaatggacatataaagtttgtagtcttttggattgtatatctactactattaatgtactgatttcttatatattttgaataatttgacggtttctttttattttaaatggttcaatcgtttcttttcatttccaacggctataattactaggattttgaatttgtcaccgttttgttcagtgatttgtgcttgtgacacatcgggccacatgtgctcagacgagtttatttagctttcgtgggctctagctagatccctagccaatgtgggctcgtgggttgtatttcgattgagctgactaggtgtgggcctatgtcaatggttttgtgttgatcgatggccattcgattttgctttagggtccgtgctgagactcgtagtcaacatgaggctcatgtttcactatttccgtgcctatctttttgtttcgttgatgttgagaaaaaaaaggacatacttctttttctttctagtgttgagtaggtccttttgagcatttttctcttgtgttgctcttataagttcttttttcctagatatgcctatttgcaagcatgtgattgattcatgagagggcaatctacggcgcttctccagttagtgtttctatgttattttgtgtgtgatttgaaggtaatgggaagagctcgcattgttgtgctcgtgttgatgattctccgagtttgaatcgattggtatttagcgagttgcgcttttcccttatcgatttgaattgttagctgcgagtttgacaggattaacgtttactcatcaagtctaaagtggtttgatccactattctaggtatatctctatgtacctaagttaaactaagagacgacttgtgaattgatacggtgttctggtgtggttgatgattcagtgttctgatgtagcctgtgtgctatagttaagaggcatttgctgattaattattggtatttcttaacgacattagcagaaatataattcccaataatggcgcagaaatactcttggtatattatgattacagagttcatccgcaagcgcacggatataccattgtagcatttcacccgagagtattccaagggtatcatatttatttaatcccatgggaagatcatagtagagagaacctgactaataatttatatgttacttgtaataatcatagtctaagcagggattaagataaatccaagggtagagtgacacataagtaggaagctactcattctcatactataatatctaaactaagtggaaagaaaatagaaagagaatatattcctatacttctaatatacatagtttacatacatcctagttatctgacatactagctaataccctatatccgatgccctcctgggactttgagaagccacccctgacttccgagttccttacgacagcccatcatgactatacaaccggggctaaatacgaaggagtatcatccccaggaaattaacttaggattatatacatatgcggaggattaccgtactgagctgtcaccatcaacggcccacctctcatccgcagcatataaccccaaataatgatatcccataatctagacaccacgcctaaactaccagatattactctaatatcatcgtcatgacatatagtaattgcataagcaaacactacacacgtaccaaagcatctcctagataagctagcagtataatcagtataacatgaacatagtgtaaatttggcattcatatacttggaaagtattccaataccataaatgtataaagaagagtattctaataaaagtacaaagcttacaaaagagaacagaagagctactagagccatacccgaactcttccgaaggcttctggactccgatttctactctattcctattccactagcttgagaacactaaactaacttgagagaatatgagagaactcttgcttgaggtgtatgtacagagtgaggaagtgaagtccttttatagcctcccaatgacggttatggcagttggaatggtcggaaatactttctaaccatcattggggagcaatcctggacgtccacgccaaaccctgcatccaacggagcagatgagggttcggccgaaccccctggttctgccgaaccatgggctggtccaatccaacccattttcggctggtagcctcctagacttctcctctctgcagacttgtgaattttggcccaattggtcgtgccatttctgagttcttggcacattcatacataagtccgatcctcaacatcgtccgattgatttatcgtctggtttgatgttgattcctctccattttatggttattctccgcaaaaggttagtgatccaaatactagttgtcagggttatggataccacatacctaatagtagttgactaaatctcggcaggatccaccacataccatgtcctatacggaaacaacctgcggatataggaggagttccggataagaaaagacaaccagagttctacatggaaacgacaaggactactcggattgtatccattttggtttccctagttctacttggacaaggggacacctatgggtataaatacaagcccccctaggaggagagggaggacaatcaacacatgaccacctcaatcaacatacacagaagatcaacatccaacacaatcaacatagaagcctagatacgccaagacacgccgccggatatcgacttcagggtaagcacggctagtaccctacggtatctccggatactgtcaggagagacgaaagcgctatctttgatctcgccgggcacggattcgaggagaaaggctaccctgttgtcgactacgagtcagatcgtcagaccgccatgtcgacaacagttagataggctaccccaaacattgtactggtgtggttatcatgaataagagcaataacggcttcggccaacaggatgtagggttattacctgacaattcaggggcccgaacctgtataaaaatccctgtccccatctcttttacctcagtctcgcatatatcctagcaccgacgatcccca

SEQ ID NO: 40211 - DNA, 1368 bp, Oryza sativa
ctagacatgcatgtatacaggttcgtagctagagtttgccttttttttgggacagactagtacatgtttaatagtgagaaatagttagtttacgagaatacctatagtaactggcacaaaaattatgttgtggcaaccaaataatttacttgttgataaacttgttgtttacacattcattggtgcactctcaatttatgagatgagtgatagtgttagatccatgactcactgtgccattctggcccttggagtatttatgttcctaaatattgaaaattgtttgtagttatttttgttatgaattgccacccttattttatttgaaatgacgtttgactagattctatatcatggattgaatcattcacaaaaaatgattttcttagctcatctattgttccaccatcttcaatagatcttcagttaatattatatcattttgcttgtgagagagtaagtggtatccacacaaaagatctagtatatatcaattgatagtgtaactctattttgaagatctatgaatggtgtaccaatatgtgatttacgattatgatcatgctttttgtttgtatattttctcccgtttctatgttgcttgatactagtcaatagtgctcttgttcttcactagatttggaacaaattaataattttgtgcattgtttagttttacatctaaatcatttgtgttttcaatctgaatatagtttatctttctaatgtgtttattggaattgaataaaatattatgtaattatttaaaaaaacattctactcttatttgtttgacatagaaaaagatccgaaactaaggttgtagattctgatatacacgtaaatactacaatgtgtgaaaatcacaagtagcatgtaatgaacaaattgaaaagaaagctaaacatacttttcaaaaaacctaatcataagttgaagataaattcgactttctattgtattatcctataatatgaaaattatcaagtgattatgctattttttttgtagaggaaaacaattattacataaacaaaatatgaaattgtattcgctagattttctatgaaatacttttttgaagtccttagtttttatttcaaagaagttatctgaaattgtattcactagattttctatgaaatacttttctggagtcgttagttctttatttcaaaatttgttttcaaactattatgctatttagaaattttatgtgcattatcagtttgttgtatggatttcccatcaagtagatgtaaactcttgtgacatttttgtttgagacatccgttcgtttccactagaaagagtggataaagttttggatattcgtgagcacgcttttcaaactgccaaacggtacgt

SEQ ID NO: 40212 - DNA, 19507 bp, Oryza sativa
tgtcctctgtgtttttctttatagcacaagcttattaacaacagatggcatgtctgttgaacacatccaaatttgatccatgtttgtctatcttaattgctttgtctacccaaactcatcattggtacatagcacaaaatgtcgtaatgctccagaagagttggattctattgataagttggattggagcaagtttttatttgaatggttgatgaatcacataaccaagcttgacatatcgaaaggttttggtggtttcatcttctatcttatggttagttttattccatcacattcttctgttctaacaactaccttcatcccaatataagtgcagttgtgtgtttctgtatccaaagtttgaccgtccgttttattctaaaattttatgaaatttttttaaaaaaattagtcacacatgttttatcatctaataacaataaaaatactaatcatattttttttcaaataatacgtacggtcaaacgttggatatgaaaaaccacaactgcacttatattgggatggaggtattatgtttaaaaagtgaatataatagtatttgttgatgttctttgtaggttaattatttggattttctgaacttctgtgtatggaatatacttcttcatattctaataacaaaaatatggtaaggcaacatcattaaggatttttgccaaatttgataaaatcgggaaagtggtgtgtggaacaaggccttgtacttgttacaaaatggtactgtttaaaatgtattctttgtttcacttttcagtaatttatttatttatgttgtgaggtaccatcattttccttattgtagttaagaacaattacttctagtctaactttcacttaatgtcaatttgcatctatttataatttttaaaatttaatacaaatatgtttacattgcccgatttcacgaataaatagtaatggtagattttcaattgggaaaatttgcaatgattaggatccaataaaccttaaaaactagagtaaatttcacaaaactatatatatacttgactaaattatcacaaaactacatatttaaatatttgtatcacaaaactacagatttagtgttaaatttattataaaactatagatttaaggcattgatcgtatctcaaaactacaaatttagtgatgaggttaccgaagaactacaaattttagagctcgtatccttggcactattgaggttatcaaagttgtagttttgtgataaaactgatgttaaatatgtaattttctgatacgatattttaaatatgtagtgttatgaaaaatatggtgtgacaccttttcaaatctgttttagacctgtttacacaaacaacatgtccttatagaatagcttaactatatcgttcttttttcacgaatcttaaaactgacacattcgatacttaattgccaaacaaatattatcttaatgcattattttagtctttatttagcattagtactaacaatattactagtaaataaaaataataataaacttggtaaagaggtactagtggatatgatacaccataatactataaatctgtagagacgccacatttactcccttcgtctcaaaataaattaacatcctactaaaatgtgtcactctgtatattcagatttattatacaaggatatgtcacatcttagtacgatgttggtttagagcaaggttatagtagcataggcagttggctccaatttcatccaactcagctatagctttctttgcaccttgtgaatacaataaataagctacaatgctggacccatcaacatcaccaggggcggatctagcatgggggcggcggggtctcgagcccccactactggcgtgaagactatgagagcccccacgaagatcccgctaaatttttttattatatatagatgggatgggacattgtaactctatctagtttgttcagaccccactgctatttctttctggatccgccactgaacatcacgtcatattaaaaagaatttaagcttcctctcagactcacactgtcacacatgcactccacacttactccctcagtactaaaaaaacaaacctaggatcggatgtgacatattatagtacaacgaatctacacagaggtatgtccagattcgtagtattagaatgtgtcacatccaatattaggttggttttttatgggacggaggaagtatcacttttctctcgaagtcgatgctggagccggcgataaaattgttgcccgccctcactctccctcctctcctcactcatctagctctcctcccccgaacatgttctactattgtactcgctcttattttgggacggatggaggacaggagagtagattctgaccgagtaactttgttctgtccgatgtcgtgctggaggagatgggccgaatcctaaaagccaatgagcaggtaggccgaaaagcccatagggatccagccatccgcgcaacgaacctaagccgtccgattctccaccatcccgacgatccctccatcccattcctcctccccttccgcgacacaaagacccgcgtcgcctccaactctcccagctcgcgaggttttctagggtttaccgctcgctccccacctcttcccccacacccgccgtcttccccttccccacgcggcggcggcgtcgaccgatcggaaccgggcggggagaagaagatggtggcggccatcagggtgcccaggagccagcgcgccaagagggagctcctcaagcacgcgccgaagctcgtaagcgcgtttatctccgctccccccgtgagcttgcggttcttgagtttgttctttttttctctctctctgatgatttgcgccgcgccgccaggttgagaccggcaagaagacgcttatcctccatggaaccaagaccagcgccgttctgaactccgtgctcgcggatttgttccacctgaagcgtgacaatgccgtcaagtactccaagaagaatgacaacatcaggccgttcgagagcggcggcgaaacttctctcgagttcttctccctcaagacggattgcagccttatagtggtaaagctcacttgttctgattataattgtaggttgttggtgtagagaagaaatagtttcctttgcacaagataggatcatttaatattcctagtggtttgatttgatagtgtggaggagaagtagaaccgtatacaatgagctactatgatgaacttctcaccgcttatatgaaacctatctgaaacctacttactccttgcctattcagatgcttttagtttgtccgtttttcttttaatgtggtagtaagatgatgtgttttcagagattatgtttcttcatcgttttgactgtaatccttcaattcttttttgttccagtatggttctcactcaaagaagaggcccaacaatcttgttttggggaggacttatgatcaccacatatatgatcttgttgaagtaggagttgaaaactacaaatcaattgaatcatatgtgtatgacaagaaactggcacctaaacttgggtcaaagcctttctttgccttcattggggagcactttgaaagtgttgaagagctgaagcatctgaaggaagtgctgcttgatcttttcaaaggagaggtgcgccttttgttgtatttatgttggcatgttgggaccagattatctgttgagcttcagcatgagctgtttgttgttgatacaggtggtagagaatctgaaccttgctggtgtagatcgggtatttgtgtgcacagcaatctcccctactactgtctacatgatgcactgtgctctccgtctaaaacggtctggcacatctattcctagaattgagctggttgaagttggaccttctatggatctagtagttaggcgacaccggtatccagttgaaagcttgaagaaagaagcaatgaagactgctgatcatgctaagaaggtaaacccaattgataattgtcttttgacctttggtgccgtgtaaactgttgtgatattaaacaactatagcccatgtccttgtattcttgccaaaaaatccttaaaccactaattcactatggttctcacaattatcaacatttttacagatgaaaaatgtcacgaaggatccagtgcatggcaagctgggcaaggtctacattccagaccagcaagtaagtgtttgttttgttttttgctgcaattgtaaaggttgaaattgccttttgacatgctaagctgattcgtggtttttgactattaaagatcgcaaagatgagtttatcaaacgatgtcaaggggttgaagagggagcgtcgtgaagccaagaaaaacaaggaccactcaaagaagcaaaagataaatcccgagtgaagaagctgaagaagttatttttagttgggaactatcaggttgggttaaggatttttggtcataactggttgggctgttgtgtttaccaagtggaagtcaccttgcgttatattgagtggtaaatagttaatgaagaaacatcctgtaaacccttgtaatggcttccacaacaatattgaccatgccagtgagcatggaattttgagtagctatatgttctgagaattttgttctacaattctgatttcttatctgtgatggttggtgaatttcccccatctacttgcgaaattccattatgagatatatgtagatgctttctaaatcctcaccctgatgataagatgtttcgggctttgaggaaacttgaattcagattgctcagcttcctagaacctgaggtcctgagctcacctaatcacctgagcttcttttggaacctgaattgatgtttgagaggaagcttttccatgcttcatctctttcgtgagaataagaggcggttcactaactgatgctccgtacaacgccatcgcagaagaaagctctttcaagacaccatcgaactaccaagcagttcagaagatggtctaaaattcagacagatgcagctttttctaaaaagatttgtcttctctaaaaaggcgtctatcaagtgtcaacgaggttcattcggatgcgaaattgctagttcgcgaccagtcgcccgcgagtcgtgcactggacccgtgtcgtacgccgtgtcgtacgtggagagagggcggcggacggcgcgttggctccctttttccttttttttttgtttttttcttgtttttctgtttttatttcgtaccttctgttttcgttttttttcctgtttttttctttccgtattttttcgggttttaatacgtacgtatgctagctttgtatacgcacaaatgcaaattttatatacacgtatacaaagtttgtatactcatatgcaaactttatatacgtgtattttttttgggttttatacatatatattacaatttttttatacacatatacaaagtttgtatatgcgtgcattttgtgaggttttatatgtacatataccaatttttgtatacatgtatacaaagtttgtatacacatatataaagtttatatacacatattttttttttaggttttttatacgtacacacataaactttataaactttatatacatgtgtatatattttttacattaaaagtgtgtacatataaaaaattatatgtatatatactacatatataccatataaattttgtatatgtatatacaaaatttatatgtgtgtatatatatatagtatatacatacgtatatacatgtgctgtagagaagagagactaagagaggaaaaagtgaccacgcaccgcgcgtggggcgcgactggtcactaatcagcgccccgcattcggatgccagttgcacccacattagctaaactagctaatacgctacagtcgagagaggaggaaaaaaataactcaagaaatttgtcattgttttcagtactccccaaacaaaatttagtctctaattctttgtcatgaatttacaaaatttttaggtttgatttttacgggtttttatttatttgatggttttcactgaatatgttaatgttgtattttatgtggggaaaatgtgattgttggggaggaggaatatttagaagaaatttttttattaaaatatttatgaaaataatttttagtttaaaaaatctacagatctagacgctccatgagggtgttttttgaaaatcacccttcttgaggacgagaaggggcctaactgtattcttttatttgtattaaagactattaacgcttgtttgccactctaattaaatttaaataaaaaggtgataaactacaaagcttatatgaaagtttgtctacatacactgtcgtttgaaacgtagatatgagattttgttagaaacaagttttagatttttgtaacaaatatttggagtcctaaacgatcttaaactaaaaggttattaactttgaagttgtaaatctcctcaagctctataattttaatgtaaagtttgatttcattggacttgatatgatatatttttaaattgtaaaatcacaacgttaacaagctatatggcaaaattgacatttaagtcccttgggtatatttctgtaattttaagaaaaataaaattttcaaaactgataaattctcaactattataaaaattgaatatgtttttgccagtattttggtacgccatccgtatttgagtcagttttaaagtttgttcgcttttggaattacaagttcgtgtatgaatcggattttaagtttgtttgcttttggaaatataaaagaagtcgtaaaataaattccttttaaaaaacttgcatgctaatttgagatgaaagtcggactcctaattgcagctcatgattttctaaaaaaaatatccaagcgaattcctacagtgaatttcatcctagctaaaccgtataacaataataagattaaaatagcattcatccgttgcaacgcacggacattttatctagtataaataaataaatttaagaattccacatctataatactccagcagagaaacaaataaaaacttgagaaatcggtttgctttaccggcccatggggcttaatgcccaaaacccatcattggcttctgctgtctgtgtacatgggccgccttctatctacgatgacaaactcctcttcgccgtcgtcctcacctcccgtgagagatctcctcttgtgcgggcggagatccacagccggcgggctcgacctcctcctcgggcgccatccacgcgcgcgcgatgttctccttcggcggcgggtcgtcgctgacgtcggtggtgccggacgcgaccccggccccggcggcgccgccgggcaccgggacgggcgccaacgcgcaggtgctctacgtcttcaaccgcggcggcgtctgcctgctgtaccgcgagtggcaccggccgctccgcacgctcgaccccacccaggaccagaagctcatgttcggcctcctcttctccctccgctccttcaccgccaagatcgatcccaccacgtactacgcctctctctctccccccacctcaacagagttcttggatcgaaccgctagtggtttggaatggattactttacttattgttactacctacaagtgtgcccttcagtgcaaaccacctgtttcttgttgcttgaaaaatgagtcaaatgaatgaactataaattgttgtttcactcactaaattgggtcagtgggagtaattcacagttatccgcggccaatttggcagagatttcaggctttgcagtagaaaattaagcaagggatcccttgcgcaaggatggtccgccgaaatcgatttaagattgggaatagttcatcacttcaattttacaactggtatttggatcaataatcgccacaataccaggagttgaactctacctcttctccaaagcaggagtttaagatggaaaaataaagaagggtctgacctctgatctgtcacctcttcatataaatatagaatctcaatactaacaccccaggtactcaacatgttaatcactaaaagcagaggaggaaatgtgtaagtttttaaaattgaacaatagaaaattcttatatcgtcattacaacttttggtgtgttttatcttcattcccagcacactgttctacactttcgtcgccctttcctagattttctaactgctctccttttcatgcccacgagattgttaccattttgatgaattaggtgaatctaaattgagcttaaaatgttatcagtgttctcatgatcactctgcacatcactatgcagagcagaaaaggggaatcttggggtgccactactgccgggccagggttgctcattttacagcttcaagacaaacacatacaaattgaacttcctagagagcccttctggtatcaaggttagtcaatttgtttcatctcctgccttccagttttccattcttaatatggcatgattttatctttgctggaacagaatgttgtttaataccatttgttccaaaacatatcattcactgacactaccattatgtgtagcttattctaattacacatccaaggactggtgatcaacgtgacacgctgaagcatatctacaacctatatgtggaatatgttgtaaaaaatcctttgtacgctcctggcacaccaatcaagtaagctttccctgcgaatgaaaatttgcttcacccttcggttcataacagcattagatatagctatcaggattatctcatcagaaaacaaaatgcattaatgtagattctttctttcaagagaaaattcatgcaaggtaggcattactttgtccttctacccattatattaggaatttcatgcagatgtagatatgaggtacttcctccgttttacaatataagtcattctagcattttccacattcatattaaagttaatgaatctaaatagatatatatgtctagattcattaaaatcaatataaatgtggaaaatgttagaatgacttacattgtgaaacggagggagtagattacttgtggcagtcattcctatcaggataccattctattgatttatttgcacaatagtgaacattttcgttaaataatcctaatttggtattggtagcttgtaaacttttgtttcgtttatgcttgagccaacctttccaaaattttgctatcccaagatatcggctacaatccaaacactcaatttcttccataacttttaagtatccttttagttttcttgtgactaaataaaactttaatagtatggtaataatatacataaaaaactatgtcaggttgacaaacttttcttatagtggctttcaatcaattttttctttgtttaccttaactgactaacttttcaaacctttcttaagcaggtgcgagcttttcaataagcaccttgatcaatatgtcaaaacattgatatgatacttttagaggtaattccctatatatgtctttgttatgccacatgtaccatttttgtgggcgcgcaataatgttcagttttgtccatagcttactcacctgtattataagttccattatagattttctggttaacaattcatatagttaacaataactactggatttgaaaagtttcctggcaatgttttttgttaatacacataagaagctttagatttgaggcatatcattttgtagttttacatgtaatagggtcaggcaatgattaattaagggctgctagaatgatctgatatgtagtttttttgaagatggaaaatttttcatcatcatttacgttggttatgtgttgtcagaacaaactgaacatccaattctgttttgcttttccatctgattttttaggcccttcttatatttagacacacatgcccttgcctaccattctttacagtcctcttatttccaatgttatactgtggttttcccttgcaggttataccgatcctaaatacggttaatgtcatatcttctgggtaactttggtacgcttactggtatcagtgtgctatttgatttattactacattaagaggtctagtgttccttgaggaatatgctaagacttttctatcacaaacattcccttgttcctgttgtacattgaacaatgctgcattacatctgttgaactgcacaaagttgttgatgttgagtgttcgttttgaaaattgagatctacatactctgatggcatgcgtgtgaattgtttatcggttatgatggattttcttcaacgtccaaaattggtaccacattatccttttcctgctttatgcgtgtccagtcagactagtagagaatcatcacagttcataacactccacaaagtccacagggctatggtttccctttcagggcctgtttggattggaggaaaaccaaggaaaagtacaggaattgtgaatcctttgttttgagcacttcacatgccgtttggaatggaggattggaccaaaccaattcctatgacattttcccctatcctttgaaatggagtactattttttttggagaaaataaaacatctgctccaagctaaaggaagttttcctttgaatgcaatctattggccaagagagcattgaggaagagaaaagttttagggccctttgaatcaaatgatttatgtaggaattttataggattcaaatcctatagggattttttctatttggccctttgattcaaatgatcgaaactttccgaatcctatgaaattcttatggaatgacacattgcatgtggattttgaaagaaacttagcaagaggttcaacctcttggaaaattttctttgagcctatctctctcatccaattcctgtgtttttcctgctgtccaatcaaacgatcattcatatgtttttatgtgttttgcaatcctttgtttaacactttaatttatgtcagaatcgtgtgtttttcacattcctctattgttttcaaccctgcgattcaaaggggcccttattgtttgctgttactgtgttccaaacaccacaaacctataattttcatggttcctctgtttcgcaattgcacatccattcatttcctattctattccttagttccaaacagcgcctcagtcggcataaagagcctgtttgtatacatccacagatactctgcagatatctcaaaagaaaatatactctgcagatggaccccactttctaaccaatcttcagccgtcgactcgaggctggttttagcgctgccagttttgagtaaggaaaacgtcgggtcattccagattttagggcccctttgatttggaggaaaaacataggaattttagaggatttcaaatgtcgggtcattccagattttagggcccctttgatttggaggaaaaacataggaattttagaggatttcaatcctataggaaaatttcctatgaagccctttgaaacaaatgattgaatcctatccaatcctttgaaattcctatggaatggacaatcctatagagattttggaggaaatttagcaagagcttcaacctcttgctaactttccttcgagtctatctctctcatccaattcctgtgtttttcctgtggttcaatcaaacggccattcctatgtttttcctgtgttttgcaatcctctgttttacacttacattcctatcaaaatcctacgtttttcctattcctacgttttctcaatcctgcgattcaaaggggcccttaatttaaaccttgctatgaaggaaagcttagaagaaaaaaaatcccgcatcctatacaccacccatgtattaaggtaccacagctatccacctagaggtgtaagtgggcttgtccgcgaacccacttataaccaaaattagtacgtaacccgcggatttgaccagcgggttacctattaatttgatctataagagcaggtacaatagcaggctataaaccagctataaacatattttaaagagataaaataggagagagaatagcaggtacaatagcaggctataagggcatccacaatgtagtgtaaaagtagtccataagcaatagaatattccggtcctcatcggtaaccctacagctttggttgatcagccaaagttggctttttcagttcagcataatcagccgtaaaaaggtgtccagtaagatcggatccactactaatagctggtgtttattcagccccaataagctaactgatgggcttgtgctgaagatcagcctcagcaacagcaaaccgatgaggtcctccattcagccacctataaccattgtgcaactagtccatatatagaaaaaataacaaaaggtatccatatgcatatggactacccatatggaataaattatattatctatctctactcatctctcttctcctagtgatacattatatccatatacattgtggagattgccataggtaaaaactatttatatgggtcctatctatatggatcactttgccatatacattggtgatgccctaagccagctataaacatattttaaatagataaaataggagagagaagagcagcgggttacagatctgtagccagctgtagcacggactccaagacgtaacgtgtgtatgacagataggaccaggtattaatagtatagtaaacaactattatacgaatcgactattaaattggctatagatgaattggagctcgtagttggctatcctattaaacttgctctaaatgggtttatggatcgacccacttgtatatctagatgcggtaaaccgaagcacgacgtgaaaacccataaattatcatttatcccttcttcctataaagttatcctccactaagtgcaattaatctcctaaaactcacacctcaatgttccacgtcatcattaattcacaaccgttggatcggtatattagatctcatctgaaccgtcggattgaacacaacacgtgaggcctatatatttcttccaccacaggaggcccatgtcaatctaccgcagcccaggagacccatgttagtctatcgcagcccaatgaaggatttagggttcggtgggtctcatcctcctgacttcctgagtcggagcggcggcggcggcggcgtagtgcggcgcggtcacacgcaggtggtggtaaggacagcgcgcggcgaggtggagcgtcgtgcatcctcttcactcttcagctcaccatgaatagcatccaccgtctccccccatcgaccaggcatgatctcttcttctatgattttttttgtatgaaaccgattcaataataatcgtattgtccgtcaatgaaaccgtcgccatcaaagggaagccgaggggctatgtttaaattttaataccatgtttaattcctttttatgctcctttcacctaatgcatgtttttattccaccactaatctctgcgatatcatcgttgatctagctgctggcaacatacgtttctatcagcagctagctgtcctagctagcctcatcagtttagcgcatggatgggagattgggaggcggcactgctcgatgtctctctcaccctcatcttatcgcccgcgtcaacgatatatagcgccaaccaggtccaggaagttattaagttctttgatgatacccatgtagctgaccttcttcgatgatactttgttcccatatctgattggttgatgttgatatacattgcaatgtgtaggcaccaaacaaagcagttgttgtgttcctctacatagagatttttacatcatctctgatatgtctcatgtttctgttaattatctcctatcccagtccactttcatgggctttaaagctgcactgccagtaaattgaggtggtaagcagccatcgaatcatccgctcctaaaattctaagcattcgtgacaagttaatagatgctacactaagaccttgactttgcaaccttcagtctctaattctctgcatgcatcatttactccagagttctaattaacaggatttcaggtgaaggccatctgtggatccaaaatatattgttctttggctaagattttaggtctggctgtttttctccatttcatataagctttttgaaaatatcccatattaaatatttctatttttgattaatgtaacatcccggcctagggcttaataggattaatagaatactcatatcaacaggttgcaacttcttttccggaagctgatctctaaagaactccgaggttaagcgtgcttggcctagagcaatttagggatgggtgaccgatcgggaaattcttcccgagtgcacatgagtaagcacaaagtgcgccgaaaagacttgtgttgccctgtgagggcagtctatgacctataaaagcctgggagaggcgggacgttacaaaatggtatcagagccgggcgcgtatgtcgcagttgcgcaggcatggtgcgcatggctgttgtggacctggagtggtcacagcatggcacatgcgctggcactggacacacggacatggccaagaggggacgttcctggcctggggttgatcgacgggggcgtcgatctctcttaagagggtgagggtgtaacatcccggcctagggcttaataggattaatagaatactcatatcaacaagttgcaacttattttccggatgatgggtttcgtgtaatttttgccttctttttttccactatattcaatgaaattgacacaccggtgccagttcattaaaaagaaaaaaaaatctgtgacgggttttatactttagatctttttctgttgcagatgagctgaaaaactcttaaaattggatagctcaaatatatgtaatatgtaattgtatttctaaagctagagccagatcaatctgcacatatttgttttatgctattccatctaatttgtaactgcttttgtttcatgtcatatatgcagttggtaaggtggtatacaatttgagctatgatatttcagacagactgagggcatatagaaagttaagctttcaggtgccatgatcccattcgcttttcaattgattaaatggaattattttgttggtaatctcttaacaaatactatgagtgatccggatgtcaagtgcccaactcctatgtatgcttgatgcttccctcaatgctcatatatataattgggtcatcttttagattttgaaccatccacattaggtgaaggtttatttttgctaaggtatgcagcaatccatgatctggaagcatacaattttatgaattatagtaatgatgcctaataaatatataatttttcagtcttttgtttctttcattctaaacgttcacaaccaatcagatctttactgtatactattgtttctctattttgaagttttggccagcagatgaagatttcatatactatcatacattgctgggaacagaactatcattaagagattctcagcaaattataagcaaacttaattagattgtttgcactaatgttgcacattgataattatacttctatgcccgcagtaacgcgcggggtatcaactagtttgatctataagtgaactcacgggtcggcccgcttgcaaccctatatccacctagcaaacacttcaaactttaaaggctccatccaaccaagcatcaaagtactccatgtgctacataactctaccttcgtttcatttatacattgttgtcatgaatatacatcttttaaaatacttcctttcttattaaaaacttgcttattaaaaacgccccttattaaaaaaagtaaattgcatcatcggtacatgaacttattaagtgggtgtaatctagtgcacgaacttgtaaaatgctcgttttgatgtatgaacttatccggtgcgtgtgaagaaaagcgaaaaggacactacatggctaatcttattgacttaggggttgactaggatactatgtaaacataaatttgataaggttgatattagatatacacattttcataaaaaaaaatagaataggatatagtgatagttaaaaaaggttaaaaaaaaccgagcaatgatataagggttaaaaatatatgaaattcactagagaccagatttataaatattacatgttttatacacgtatgcacgtcacattcctaatcaacatcagcttcataaaattaacataaattaatattgccaggttattttgattctcattcgcaagaactaaacaagtaagtgtactgaaacgactattttataaatttgtatattaaattacacgtatataccaagtttatgtatgaccaatgcaatttacttaaaagaaaactgtctacttctttgcttaaactttcctaagctttctattagtttttttaaagaataaggggaagaatttgatattttacttgactactcgtcttattaaaaaaatttatgcaaatataaaaaacaaaaaattatgcttaaagtactttagataataagtaaatcataaataaaataaataatgatttctttttttttaatttgacaaatgatcaaacagtgcaaacaaagtatcaaaatccttatattaaagaacaaaatattaaaatccttatattaaagaacgggagtatttactaacagagctgatgcacttgtaagagaagtttggacaccggcatttttaaggtaatttgactaatgaacatcagactgtttacacgcatcagcagctcttaatttgtgcattgcaagtctagacatgattagtatcaacattatattctatagaacaaacgatgcggatgactctaatttgctaactacaagttcccttcaaacacaacagtctgtagtgtcagacaggctcttcacaagtgtttacagacattaaggggaatatcatcaaaactcatcccccgtattcgtaggattacataagtagcctcaacaagtccaacaacccgacatgcatgcatagctcaacaaacaagcacagctaatctttttactgcctttttcttcagtccttttttgctttttttttcacttttcatctcaacttccctcaggaggatcaccgactattaagcataaaaacacagccgatcaaaccctcccctattaccgccatttacaaagcagaacactgcttgcatcctactatgggagctcacaccgtctctccgcatgcatgtgtgaaagctatcagccattcacctcccccttcggtgtatttacagctgaaaccttccagacattctgctgcaaattctgccaaggcgtagactccgtgccactacctgttgtatgcaccacgggaagcaaaaaactggtagtctggatggctggtacgactatcccgcagccagtcagaagcagcttgctgcaagaagcttgccagctgccgatctccatcagtcgaagaccatattgaattgctgaacttgtaagaagccataccaaaaacagatagtggtatagtcggtttgctaccaggaccccagtattttacagcaccaccgttatctggccaagagagcataaaaacttgagatcacaacacaagcaagcaataagtgattccatagtgtttaaacaagcagcgtgcagccacagaattagataaaaaagaatcaaactaacaaaataaaataagtgccaacgaccaactgtcattcattaatttcttcagttttatgaaagtattttttatctttaaatgtggcagaatccgcatgcaggagtaatgcgccaagcagtaaaaacagaactatcactgaaatgatatctcagaattatagaacatgtgctccctaactatgccaatcttttctaaatagattttggatgcaactggcagttgttaaatccttctaaacatcagcaccaggaaaaagagattgtcaattgcatgcatttgatcatttcaaactaaacaaataaaaaatactatcggaaaggccttttgagctcatattctcgagccaacacagagcaggtacacagaagacataacacatacttaagttgttgtacaactttattgtatttcaaaaacatttgtgccccctagacgtgtgctaaatcagactacagaagataaccgaatgaaagaacagcagacaggtggaagcatatctgtttgttttggaaatcagaacgatcataccttcttctggcccagttgatagccgatggaaggtgagaaagcatgcatccaaatcttttaatgttgggccagtagggatacggtaaattggatacctgcatgatgttgtaggcaactcagtaactagttactaccatactctataactgctagtctgctaccatgccaatggaaaaagaactcaccaagcaacagatatccaacttcgcggtgataaatcacagcttctaagggtcctcagtcctggaaatcttgctgaaagactggaaatctgaaagaacaaataaggtcagaatatttatatgcaatagaatattatagaaccgtcttagttaactcttgccttatcagtcaatggttcacgacaaaatggagaatcaaactcaaggtattgaaagagcaagcggccatgcaaatctcctgattcaccatcatcacttgagaagccttcctgagttagatgttttactcttccaagttcataatcactacttgcatcactgctggaatcatgatactccccatcactgtcatccattatatgtctgcttcaaaattttcatccaaacataaccacaaaattagatattgcacaaatcaagtggaccaagttatatcttaaagttatatcttactgaacagactaagtggtttctataacacctcatactagaattcgttagaaacataatgatagttaataaattagtaaagggaagcaaaagcttgcctgcatgatgcatgtgggaatatgtaaaaaatcatgagcaactagagctataacgcacattaagaagtaaccgaagctcattatttttcatggcattatggaattcaaacacaatcattttagtgaactgctaatctaaatgaacataacaaatactgttcaaagacaagatcaatggagaggctaaattgtgttttggggaaatttctctacaaacacaatattaatgtcacgttaaaggtttaatgaacaaaaaggaaacgaacataaaaggatggaatgtatggacgtatgaaactttaacgaaatggttaaggtcgttcccatgcacaagttaaagttgcaaacattgatctgtcacaacatcacaagctagttttgacaatgagaaataatattattatatatcattccaaatccagaatcataacgacaacatctcacgattaagtcacatctgattgaacttcactaccttcgagtctatacaatcactacaaattgtaaagttggaatgtcatagaacacactgcaccggattaaaacctcctgattgttttggtaaacacaagacgccagaataaaacaagtgtggaatttcatgctaaaattctctgggccatccattttatgcaaatggacaactaatagcttcatgaggtaaacattcactaccatgggatcattaacccgataagtgcttcctaacgacatgtgtgacagcaaacagtcaggtat

SEQ ID NO: 40213 - DNA, 5828 bp, Oryza sativa
gcaccgtacgcactccactccctgtacgcctcccacacgtctctgaggaagaagtgcggggcctcctcccgctcggcatccacgccgcagccccgccaccccctcgcggctctctgcatctgcatcccaaatccaccgccgattcagaaatggtcgcactgccgcaagtaattactacgatctaaccctaccacgcgaggaagtcaaagggcagggcgaaccttggaggggaactgagcaggcacgaacggcgtcacggcggccacgaaccgctcaaggttgcccgcgacgccggggggcgggaccggcgccctcgccggcgacggggacggctcctcggccgccttctcctggtggacggcgggggcccacctcgccttggggagcccgtggtggtggtaccctcgccggaccctggatgcgtcgtagaagcggtggtcgccgccgtgcctccggccgagctccacggcggtgcccatcatcccacgcgcggcacggcacggcacgacgcgacgcgaccaagcacaccccgctcaccctccctggacgcgctaatccggcgaggaaggcaacgaatagacgaaaccctaaccctaagatttggggaaacctgctcgattggaggaggcgccaagccaagccccaagccaaaggggggaagaggagaggaggaaatggaaaagaaagggagaggaagcaacccggcgccgaggggtaggtgcatttataggaagaggaggaggaggaagacggggaagcgcggggggcagaagcgggatttcgcccgcgcgagcctggtatgccacggctcgacgctggcgggtgggccccgccctccccccgcgggcgtggggcccacctgtcagcgcgtgaggcgggacgggagggagaagggggaggagaggaaggtacacggttgcgggatcctccgctcgtgattggtcggcggctcgcctctccggatcgaccccggattacgcacgcacgcacccaatccgcacgctggactgggctctagtgctctacacgcgctcgcgccgcattactgacatgtgggaccaggcgaccgcggggcccacgttacagtgggtgcgtatgttctggggggggagcgtggcgggctgaccccgatcgggcgcactggacgggacgccgcgtgtgcgggcggcggaacacgtggacggcgggggaaaggggggagcgtgtgggccctgtcctgtcggggtcgagctcgagagcctcgggatcgggcaggtggatcgcgtcgtggcgcgacgaggggagatagatcaatcgcgtcggatgatgtttttccctggcgcgcacgcttctcgggacaggtcgctgacaggtgggacatattggacgtagtaggctggtcggtactatgtcagtgggaggcgtggttttggagtttgggcatgctgtgttgtcaaacaacgtgtccgtggacggttggtatttctattgcgggaaggtacggctaaaacgtttaaaccacgtgatttaaccacgaggttatggtgctaacagaaccgtccccttgcacacgcagttaaaaagcatttccccgtcgtgccaataggcaaacgctccccatcttcgacccagtggagtagaatttactaagagcaagaataatacagtagagtccacttcctactattattccatcttaaagccaacatatataatgtattaactataaggttggctacaactttcttcttctctctatctctcacctatacatttaatatatttacttaggagcttgtgttaaactagctcttgcatgaaagccaacatccttgattttttattatctgtcacctctacctaagcttatagtagatttatagctcactattatacttcctctaagggcaattgcaaagactgacactaaaaaattataaaaatgcaactataactgttattcaattagcaactttacaagattaaaaaaaacggtggcaaatttacaaatgccctaatttataaaccattgccaaaatttaaattttatagcttaattttatagcagcacaccaataaaaataatattgtgagatggatatgataacagtatctaagatgtatgatcttggtgttattaatacagtgttgatccttagttgcaaacacgatggcggtaaaactctaaccatgctagcattaaattggactcatagtcacaggcaccactaaagggttatttggttgtttgatttggttgtttgaaccactctggcacgctattaggtataaagagggtagtttggttgctacttgggctacgttctttgcaaacttttggaggaaaaattttaaaaaccgaaacgataaagctcagtagcacacgattaattaaatgttaactattataactgaaaggaccttgatgtcgcctagaggggggtgaataggtgatttttaaaataaatgcggaagctaaaacaaaacagggtcggattgtctgatatcaggtcggatagttctatgtgatcggatagtctgaactgagatcagactatctgacctgcacaacaacaatacaaacaagataacaccctaagagatctaaattcaatccacaagcaaagaggtgagctcaaccaacaacaatattagcatggcacaaagcaatgcaacaagaaggtaaagagagtgaggatatcaccgaggtttatgcgccgatgtatttcccggagttcaaatccttgaggggattctagtctccgttgaggggctcgcaaagagccaggtctttttcaaccctatcctcgtgatgttgcacaaatgcactcatccttccactaagggtatctctttccttgcggaggcgagatccggccttcacaaacttctcttggccaaccacacgtagatcggtggcccaagaacgacacctagccgtctaggagtcctcaacctccaagagtaataaacactgttggaaatatagtcatgaatcggcatattttaatccaaaatgttaaagcaataatcatggcataagcggtgtagggtgatcttaacataaccagtagcataccatgcgcatcatgaatgtcaggaacaggaacattacagtaacgcaataacatgctagaggcatcatgaatgtcaggaacaggaacatagagcacataacagtaaagcgatagcgctaacaaagggaataggagaaggatataccccgagaatggccctccgctggattgtgaggcagaattgcctccgttgatgttgtcgttcgcggcaccggctccagctcctggcgcaccaccttcggctccagctcttggcggcgcaccacctctgccatctcctccagcagcggcggcggcaactccagacacggcgagcagtcgtgcaggaggcactccccaaaaacctgatcacccgcctacccggtgcagatctcaggcgaagatgtggtttcggaggcattgctccttccaatctctcgtgcgcgcaagagatcagaagcgaggaagcgataacagcactggcgcggaggaggaggaactaacatcgggaaagaagcaagcatccggaatagatcggactcgcggcctccttatctctcaggagagagaggcagtcgtgggaacgtggacgcgctgttgcggagagaatcgtgggaacgtggttagtggctgcaaaagaatagcgacgtgacgcacgcacgccgccgccagccagaccacgcctcgcccacgcccacgcccacggcctcggcccggcgcgcgcgcgcgcgtgtggcattccgacctccacctcaaccagtcaacagggggcctccaataactccctatttaggttgagatattcctcgcttaaatcctgaggtggtattattatccttaacacttattatgggcctttgagatttaataggataagttgggcctaccccaattattctaacaatccccaccaagtttcaaggctcataagaaatgttctcaatgttgtgcctgtttgatataccagggttttggtggagactgttaagttgaacttccacctaggaaatgagctacatcagaccacaactgaacaatggactatgccttgaattgtcagttttgtgtgatcaggtttcactcagaaccttgactggtactgggctgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttggagaagccactcggatcacattaaggcatgagccatcctaccatgcaggaaagaagagaagcacatcatggaaatgagcccttttcaagggtctcttctctcagtcacacaatagtttgtttcgccatccaaattcacaggatctccgatcacaatggacaggtttccactattgtgcaaccttaggtgggtatcaagcccatttccctcgatgcactgtctatcacattacgtggtagccccttagtaaactgatctgtcagatttctagccgtttggacatagtccaatgctatcacttcggagtttttctgctttctgacagatttcagtcttctcttgatgtgcctagatgacttcatgttgtcctttgaactgttcactttaataatcactgtttgattatcacagttcattaggatagctggcactggtttttcaaccaccggcaaatccatcaggagttcacgaagccactcggcctcaactgtcgcagtatctagtgctgtaagttctgctttcattgctgacctcgttaagatggtctgcttgcaagacttgcaggaaacagcgccccctccaagtgtgaacacatatccacttgtggcttttatctcatcagcatcagatatccagtttgagtcactatacccttctagtacttttggatacccggtatagtgaattccatagctcatagtgccctttatatagcgcattactctttccagagcctgccaatgatcatctcccggatttaagacaaaccggctcagcttgcttacagcaaatgagatgtcaggcctcattgcactagccaagtacatcaatgaaccaatgatttgagagtatctcagttgatcccttgctatttttcggtttttccttaatagcacgctgggatcataaggagtaggagctggcttgcggtcactatatccaaaccaactcaaaaccttgtccacatagtgggattgcacaagtgtaatcccaccctcatctcctctttgtagtttgatgttaagaataacatcagcctctcccaaatccttcatttcaaaactcttggacagatagtccttgacctcctcaatcacattaaggctggtcccaaagatcaatatgtcatcgacatataggcacaagatcacttcttctcccccaccatagcgatagtacacacatttgtcagcttcgttcacaacaaagcctgcagatgtaagcgtggtgtcaaacttctcatgccattgcttaggtgcttgcttgaggccatacaaggatttcaacaatttacacaccattccctcctgaccttttagtatatacccatctggttgatccatatagatctcctcctccagctctccgtttaggaaagttgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaaaccttgcct

SEQ ID NO: 40214 - DNA, 7988 bp, Oryza sativa
tactcttgcgagtatctacaatgttgtcctcctcaggattttcctcaggcgtttgatcattgtgttctatcggtgcaaagtgctcatggggcatgacagtttctttactagaagtgctaggtgtatgtttcatgggaaattcattatcaaagaatgtagcatctctggactcaagaattgtaccaacatgcatgtcgggtacaccaaagtttactattaagaatctataacccacactgtgaatagcataaccaaggaacacacaatcaacagtatttggtccaagtttccgctttttggctataggtacatttaccttggccaaacagccccatgtttgtaggtatgagagatttaatttcttcctttgccattcctcgaatggtgttacttccttatgcttcattggaattttattcaggacatgacaggcggtcaaaactgcctcaccccaccattccttggaaagccccgcagtgtctaacatagcattcaccatctcaattagagtatggttctttctttcggccatcccatttgattggggtgaatagggaggcgtcctttcatgaataattctaaactcttcgcaaaaagatgcaaactcattggaaaaatactccccacctctatcagacctcaaccgtttgattttcctttcaagttggttttctatctcagctttatagattttaaagtaatgcaatgcctcatcctttgttttcaatagatacacatagcaaaatctagtgcaatcatccatcagtgtcatgaaatatttctttccccttttagtcaacacgccgttcatttcgcacaaatcggaatgaacaagttctagaggtgccaaattcctcgcctcagatgccttgtgaggcttgcgagtttgtttcgattgaacgcaagtatggcacttggaacctttgaccaaagtgaattttggaattcaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctctgctgtcataaccttttccaacaaaagtcccatatttagatacggcacatttattggactcaaacacaagtctaaaaccttctctacacaatagagagccgctaacaagattcttctttattgaagggacatgctgcacattcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtgtccacccaccaatcaggtgagtgaagaacagagagaactgtaggtaatattttaccgtaccctgatgttcctccgccctcgctaatgaccatgttggcagacttcctgtctttgcgctcaggacagtccttggcccaatgcccagacttgccacacacaaagcagtctccctttgactttcccttacctttcttcttaatgttggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcagaaacactgaactcttgtctcttgtgctttagagaagtggcaaagtccgaccaagaaggtggcagtttggcaataatgccacccgccacaaacttgtccggcaactcacagttgttgttctcaagttccttagccagcatttgaatctcatgagcttgttctactacagaacggtcatcgaccatcttgtagtcatataactgctccatgacatacagctcactgccagcgtcagaaactctgaacttggcctcaagtgcatcccacatatccttcccggaaggcatgtgcatgtacacgtccactatgttgtcagtgagtacactgatcaatgctccacggaacaggcaatccgaagcctcgaacttagcctcttcctcaggagaaagaggtggttcacttcgtttgccccgtgaaacatagaagcactgcatcgctgtcaaccacagtagtgcacgtgctttccatctcttatagttagaatcatcaaaagcatgtggtttcagtgcagcagcaaagccaactaccaaaaatgacctatcagatttttggattgttggaaatatagtcatgaatcggcatattttaatccaaaatgttaaagcaataatcatggcataagcggtgtagggtgctcttaacataaccagtagcataccatgcgcatcatgaatgtcaggaacaggaacattacagtaacgcaataacatgctagaggcatcatgaatgtcaggaacaggaacatagagcacataacagtaaagcgatagcgctaacaaagggaataggagaaggatatactccgaggatggccctccgctggattgtgaggcagaattgcctccgttgatgttgtcgttcgcggcaccggctccagctcctggcgcaccacctccagctccagctcctggcggcgcaccacctctgccatctcctccagcagcggcggcggcaactccagacatggcgagcagtcgtgcgggaggcactccccaaaagcctgatcacccgcctacccggtgcagatctcaggcgaagatgtggtttcggaggcactgctccttccaatctctcgtgcgcgcaagagatcagaagcgaggaagcgataatagcactggcgcggaggaggaggaactaacaccgggaaagaagcaagtgtccggaacagatcggactcgcggcctccttatctctcaggagagagaggcagtcgtgggaacgtggacgcgctgttgcggagagagtcgtgggaacgtggttagtggctgcaaaagaatagcgacgtgacgcacgcacgccgccgccagccaggcacgccacgcctcgcccacgcccacgcccacggcctcggcctggcgcgcgcgcgcgtgtggcattccgacctccacctcaaccagtcaacagggggcctccaataactccctatttaggttgagatattcctcgcttaaatcctgaggtggtattattatccttaacacttattatgggcctttgagatttaataggataagttgggcctagcccaattattctaacaatccccaccaagtttcaaggctcataagaaatgttctcaatgttgtgcctgtttgatataccagggttttggtggagactgttaagttgaacttccacctaggaaatgagctacatcagaccacaactgaacaatggactatgccttgaattgtcagttttgtgtgatcaggtttcactcagaaccttgactggtactgggctgccgttcgcatcccctctgtttggagcatataagtcaaactccaggcctttcatgagtatctagtgatcgcccaaacctcatagactgtgactagcagttgaactcatataggtgtgttccttctgagatgttctgcaggtcaacatctctgcttggagaagccactcggatcacattaaggcatgagccatcctaccatcctgctcggagtatctgatatttttgaagcagaaaacttcgttctcaaacagagactcaagttccatgaaatttcgtagtctctgtatcatcggactatctgatccaacatcggatactccgacacttagaaaaactcactcaaaagaattttttaaacaaagacagagagtgaagttctgtgaaaaatcggatagtccgatacatcggatagtctgatttcaaatcggatagtctgatgttgctcaagtaaaaatgaaataactttttactccgaactccgatttcgaagatcttggactctatggaaagctagtttcatgggctatcaaacccaacataaaacatggtccaaaaccttcaagagatgttgaaaaacttgcaaagaaacccggtgtaagtgttgtgacaagtgaaaccactcgggattaaaaattttggcttaggtttttcaactcacacaaacatgaagcattttgagcactagtattcaaccaattatatgcatgtggtatccctcttaatagtacggcatcctaaactcaaatttaaaaagtaaagttataccaataggagtaccttcacaccatattgattcttcacttggagggttaccaacgtcaaagtcatttgatcatcaggaagatctcatcttcttgatctttgacagttcatcttccatttctcaaatgattaatgtggataatccatggcttcaaatggcctcgcacggttcatcacgacacagtcttcacttgcccttcaccaccggtttcggttcgtcggcgccaagccccttgcttgcccttcaccaccgcatggtccatcgcaactgagcgtcacttgcgcttcaccgtcttgccataggtagtcacttcatgcccgcatcttcaatatcttctctttaattctcatccatcgataagtccatttcctagtttcttcatcggactaatcacttgcttatacactccataagtgcattagtcccttaatcgtttgtcatcaataaaccaaaacccactaggggcatagatgctctttcaataacttgaaaataaatttatttgcttttttaagttacttttatatagattttttttttaaaaaaatgcattatttaacagtttgaaaaatgtgctaaaggaaaataagaaagttaaattttggagttgaggaaaaaatagacttgtcagggttatggataccacatacctaatagtagttgactaaatctcggcaggacccgccacataccatgtcttatacgaaaacaactttgaatatagaaggagttccgcataaggaatgatgaatagagttctacatgaaaacgacaaggactacttgaattgtatccatattggtttccctagttctacttggacaaggggacatctatgggtataaatacaaggccccctaggaggagaggggacacgaaacaatagatcaagacacaagatcaatatacaagccaatattcgtcaagacaagacgccgaatatcgacttcagagataagcatggctagtcccctacggtgcctacggataccgtcaggagagacataacgctatctttgatctcgccggatgcaaattcgaggaggaaggctaccctgttgtcgactacgaatcagcacttcagaccgccaagtcgacaacagttagataggctaccccaaatattgtactggtatgattatggtgaataagagcaacgaccagcttcggccaataggagtaaggttattacctgacaattcaggggcccgaacctgtataaaaatccttgtccccatcttttttactacaatctcgcatatatgatagtaccaatgatccccatactatgcaaataccggaatcgcgacatcaaacgttgacaagactcttggttgtatcttttagatcacaatggtatgagatgttgtttgatttatgctgtgaggaaaaacatgtaaacacaaggttttttttaataaatggatttagttaatttacctcatgttttataaggtctccctccgcctcttttctacgtctccacttgccatcatcgctagttcatggtcaaaattagcagccttgagctcatggccatcggatccgacagtctagtggtcgggaaagaagaagggcagcaaggaagaggagataaatgacagtggcgacatcgatggcaagaagaggaggacagacgatggcgtctagatttgacatcctcctcgagtttttcctcccagttagtaagaccttgcgacttgcaaaatctagtggccccgagctcactagacgctagtgccatactccctctgtccataaatataagggattttgttcccttggtgtgtccataaatatagtggatttgtctcctcccaaagcaagcaggcactgcctgtcagccatccaccatccatgaatcgttttcaaaaaaaaacataccaatatgatgtacatagaactaaagaaatacaaagaacatctagtactcatactacttcgccccgtctatggctttgtttagattcatgggtgtaaaattttgacgtgtcacatcagatatatggacacatttgaagtattaaatgtagtctaataacaaaacaaattacagaatcctcctgtaaaccgcgagacgaatttattaagcctaattaatccgtcattagcaaatgtttaatgtaataccacattgtcaaatcatggcgcaattaggcttaaaagatttgtgtcgcaatttacacacaatccgtgtaattagttatttttttatttatatttaatactccatgcatgtttccaaatattcgatgtgacagggtgtaaaattttgacaggatctaaacatgccctatgtcaaaaagggaaaaagttacagaaaacatactaatactagtgtactacaaatttgtttattgtgtcaatgatgtacacagatgtactacttactctttcttaatttgtgctcttttaggcataataccttatattcatggacaaagggaatatttggctgtcataggattatggctgctcgctgcagctactcaaagtgagggcgagaggctttacaggtgcagtgatggagacaacaacggattgggtcgatggaaatgagcaaatgaagcggaggcacaaacccctcctagccttttgtatccacacgcccctgcgtaaccccacacctacatgggctcatgcgggatgagttgagctcgattcaagcttttctgctcaacctagctacgaaggcagttttgtaactgctcattctggctcaggtcaatgttcaagcaactaaatatacgacacgctgtatctgatatacgagcaagtgcgagctagataactagcaaaaccttaagatgtttacaacagacagttaccttttgcatgattgaatatggcaaccaatgaacgtctcaagggctatatgctcaaactaagattctcatcggatagctatttcaggcctcatcggatggcatgaagctttggctgatcagccaaatctgccaagttcaatttagccaaagaaaaaccattgtttgggttattttgcttatatggctggtgaaggattttctgtggccggtggttttgggatttttattttttgtgtatggtcactagagagttcacataattagccactgctgatgatccaactcccttgcgggtcccacttgtttggctgaaaagtcttagcccaagcctcaaccaaacaagccatccggtgagacccttgggctgaagattttcagccaaactgccaaagcccatctgagtattttcaaccaagtataagcaggagatccttcatcaaatccatccaaacaaaataagccaaccaatggaattgctttggctgatttggaaaaggtctgtccgagcatgttgattaccaacgaggccctaaaattgtagctctgcttttttccaatgagccgagctatatttctatacgaaagttgcataaaaaataatattaatttattttttttaaaaaaataataaatacttaattaatcatataataattggtgttttgttttgcatgtcggcccgaacacagcctttagtcacgatggaccggggcagttcgcacaccgagccctgtgcgcgagacggcgtggtagctcagggctaagcgagcgctctaggggacggacgcgtgtagctccgccgctcagccccccgctggctgagacagcagcagcagatcgagactccaagagagcagcaacatcgacggacgcacccgtcacgt

SEQ ID NO: 40215 - DNA, 2809 bp, Oryza sativa
ccgcccggatccggccggggcctcccaccgcgggggacggagcgcgtcctccgccgccgccgccgccgccgccatttccggtggtcgacttcgccctgaccgagggagacggtctcgtccctctcttgtctgctgcagcttcctagctcctgggctgcctccccccgcggcttctcgggcgccgcgatgtcggagggcaggggaggtaacggcgcgcgagtgatggtccgggaggcggcctgcaacgccatcgcgggcggttcggctggtaattctgctctcccctgcgtatggttctagccagggttggtgggttttttttggcttcggtctcgggatggtggcgtggggttttgatccttctgattgctcttcgtttggtggctgtgttgggcgcaggtgtgatctccgcaacggtgctgtgcccgctggacgtgatcaagacgcggctgcaggtgtacggcctcccttccaacctctctagcacggcgccacctggtaactagctctcttctcttctgatgcatggtttatacgtaccgtttgcctactttgcactctgtccatacgctttctctgggcttgttgccccatgaaatttgtgagttagcctgttttggtctcgctgtaagatcaatttgtcgcgttgcgatactaaagaacatgatgaaagcctatatgtttgcattataccagttatgctggacaatggtttgattgcaaaagttggcgcttaatggggtggggggctggtctgacgtgttggggttgataaaggggattaggagctcaatgcatgcttgtaactgaagtactactgtcaaaattgaggaatggaagggtaggagtgccaaaatagataatctaataatccatgcttttgtatgcttgaatagttataaattaggcacatgaaattgtgagctaagtctttttccctgcaatgctgcacatgcagtgcgtaatgtagctgctgctgcagaatctcttatagtcaaccaatgcaacatttcatataagattgttttgacattgcactatttcctccatttcacagtatctgtcccattatctctggagtatctgtttcaaaatacttgtccattgcagagatcaagatgtacttcttgcaaattttgcccctacttaaatgcatttcccacctacttaaatatttttgaaaagataaattgtctgtattatgagtatattagggatatccacagtcattttcattatgttttcttagactgtgctttcttggtctgtgtaaagtgggctgtggacaaatattgcaaaatggaaggatgtcttgagtaaaatattataaaatatttccatatattgaatattttgacaaaggcatattagcattcatataaatcatatgattcgctaagtttgaaaagacttgcatgttcatttgtatattctaatgtttttatctgaatctgaaatgaaaaaaaaaacctgttatcctcatcaagtttgcattacaaacatgcacatttctctgtttgaaggggaactatatgtcctgtgcatatgtgtcactccaatggcacaactattaataccataaaacctttcacacttctatagacatcttagtttaacatgctgaacaatatagtgcttatctctgtatgttgatgatcaatctagtacaattataaattaattttggatactcagaaagtattgttctcttgagcatgtattactaatttttaatccttctcaaacagtcttattttatctcttgataattcatctattcatcatatatctgctccatttatctttttttctgacttctgtttctcttccgtattaggtagggtaataatttcaggttttcagcacatattaaaaaatgaaggcctgcctgggttgtatcgtggcctttcaccaacgatagtagcattgtttccaacatgggctgtaagtaatcattaacattatacagtcagtcagtaaacagtagcattatttccaacttaggatgtgagtaatcattaatgtacaaatacagttagtaacattacaggattgttttaatttctttaatccacttttagatgatagcttgctacatgtctataaacaatgagttttgaaaacgcctaatgctgatgttttatgtgatttcactaaattgaatacatgttccgtgcaatgcctaataacagatgtacatctccacgaagcgtgtttgctgtttgaacactttaatgcatttcgcttactatctagatccacttgtgattgcgattcaataaaaaccaatttcaatattacagatctagctatatgtatggacatttatattgattttgaggagtttgttgagattttggctgcagaagtgaatttgttttagtaggttgtgtgggagatactgtcagggttgaactgttggcactcaattgtttaaggggaaacatgagtcggttgttttctcttggcgcttaatagtaatatactccctccgtcccaaaatataaggtattttggagggatgtgacacatcctagtaatatgaatccgggcagtgtcacatccctctaaaatcccttatattatacgacggagggagtagtatcatgtgacttgtggaggaagatctggcaaatttgatgctctcctttttatgataaaaatcagtgattcccatcctcttcaataagtatgtcatcaaatagaatttaatatatgccacgttcagaatgtgatacaggaggttttcaatatatatgtggtctaatccatagtccatactccctatgaacatctaattgtgcttcaa

SEQ ID NO: 40216 - DNA, 10229 bp, Oryza sativa
tgaaattacaggcaacagtgagggacagggttattacagactgaaacgactttgagggtgccaataaaccaaaattacttgtaggaaggtaggtaacaaaagcagtgacttgtagcagggacagggtaagatttatcctttatctataagagcttgtagcacacattctggaacatgatgacagtgttcataatcataccacccaaggcgtgcgccgatgtccactcagcactttcaaacatttcccagtttgatagtcaattattttaacagtatgatcaccactgctcaaaagagatggagttagtccacatgccttcactttaatccttatattccgcaaataataaacttactgtgtagatgcaagtgttttcccatctgggctgaatgcagctgcgatagtagacctggggggtggcaaaagaggacaatatttggcagaccagtgatgcagggactgtgattctgccctgtatacagaaaaggtttcattccagggaaaagttaggtataagagtgagagtacaaaactatgtaactcaacagttaaaatagacaatgaagaatagttcatagggtttataaatatttaccaaagaaatattaggtgtaaaatcgaaagtacaatatatgtaactcaatcattactacagacatgacaaattgtgcttaaaccatcctggtaaagtaagaccccgtaccatgaatatatatcatgtttagcatctgtagctgcatatcttagttcattggaatcagcatcatttcctggagatttgctccaaagttttttagcttggtgttttgttcgaggggaaatctctcgctgagctaatagatcgaagatgttcctgacaataatgggcaaaccaaaggttatatatttaacaagtgatctcatattataatgccattagaaaacaggttactgaaaatgtttttatattatccagaagatgacccctcatgcagtttatttttggagggggccatggggataccacaatggctcaatggtggcattaacactgatggtgctactctatcagggagttgcatttgccattaagctattcccgcagtacttaagtattatgataacaacaatgtgttggtcaaaggagcttttgcaaattacattcaagatgaatgttaccctgaaattggttaggcataatgctaatgttatagtccaataggccataacattatcaaaatactaatgctaattcatgtggtattgaccttttgacatttctaccagtggagacgacacttaatccaacacagctgacctctaggtgaagtggtgtaacagtatgcagaatatattcccatagctttggtccattttctggaacaaatatgtgaggttcttttcacaaatgttgttttaaaaggggcttgtatgctaacaaatactgtaccaagagtagaagaagataaataaggccagggtgctaatcaaacttaataagtcacaagagggtttgcagatatattccacctttactgtgtcaaatattgcacatggatgcaatattggttccaaacacagaatcaaaagaaagaatacattttatcaattgaattgtaacagttagtttctcataggattgtaccaacttctctagcagaaaactaaatgatgatgttaagtagacaattacctttgcctagatcttgcagatgttgcttgatatctagaatacgatgcttgtgcagaagcatgctttgaaccttctgcccaatgttcagccatttcaggccttcaatatatatatgcacctaaaaattaattgaaccaaccagatacaacaagatgtaaaatgttaatgaaattgtatgatatataacagaagttaagtaagaagtttttagaacaattcttcagaaaaacactgacacaaacatcccaaaatccaacatatgaaaatcagaaaatgcagtatactccaattaaaaattagaaaacagcacatcaagagtgactggacacgaacaacctaccatttgatagattccctatggtaaccagtgtgtggtagatataacttgccacagatgcttagattatcatttgaccttaggtcacctcgcacaatgttcttctgtttgagatattcacaaaattgtactacagaacatccagctccagcagcagtgctgccaaaggcaaacaaggtgcacacatgcacaatagcgagatgcagcaaagaaaatgcatctcaaattatccaaagcacggtgcactatgcaagtcatgctctactagcagccaggcgctaaggcaccaaagaacatttctcatcaaaagactgcttagaatataaaaccaagcccaactagaaacggttgcttcaaactaccaagttttagtgagtctgctagatagtaagaaaatatatttatgacataatattgccaattttgataaaaataaaagtgacatggcatgctatatatattcaacggtttagttatttctagtaggttaaaagagctaaggtttcatctcattagattttattttggtgaactgtgcactcgttggaaatactctctgcacatgatatttcagggatggatcacatctttttgtgctttgagctgtaggcaattatggacctagcatattaagtgtaaattttgcaaacaggcttgtacagcagtgtgcatattcattaagatgggtttttcattgaaaaatttgaaaacttgtcatcaaacacttgctctttaagtttattctgcatatgttgtgtgtttcagggatgcttgccattgccaacagatttcataacacatttgatgtcctgctcttgtgagttaagaatgcatgggaacaatgcaaacaaaaagaatttcaattcttacttttggacaagtacaatttattcattggtaaaaacatggagagcaagtcagtccaaggaaggcctacattctgagctcacatcctatgccaaaaatgcataaagcaaggatagatcaacagctcagcaatgaatcattaagggtgtgtttggttgcttgcattttcctagcctggctcatctctctcatcctggttgagtctagcctggatgaagagatacacatgcaactgtttggttgtttgcatcagtttagcccggttgggatgagattttgtttggttgagtgcatgagagatgcggtttggaaaagattttgtttggttggttggatagatttgagtctagttacctcttcatttagttgggtgaggttacctacaaaaatttcaaatctagacaataggtataaacaatttttcacatacaaagaataatattggcatcaaaaatcacccggcattctctgcaccaaaagtgaaatttcttgagttctcaaaaaataaaaagtcaacaaaacttcctccaccatttgatagcaaagcgctggaaaaaaaaaagaaaaaaaaagagagagaagcgtttgtcctcctccttgttgtcgaggagatgagttcttgcctcatcgccgccagccgttcccagctcctctgtcgccggccagtaccatgctcctcgctggcctctcatcctgatctgacatgcgcgctcctctgctcttctctcagtagaaaatagaacagagaaaacaaaaaaaaaaaccctcaatctcatcgttgacttgcttcatcggcgctcccagctgctcaacgccaccatggtcaccggatctggtggcctggcggtcggagaaggcagttgtggcgacagaaaagagaggcagcgcatcgacgcgatggagatggcaagggatgtaatagcggcagtagcttctccactggggtcggccgagggagctcgaggtcagctgccagtccaccaccggagaagacgccaaacgagcggtgaccgcaggggatttggtggcggcagcggcaagggagagaggggaagaggagagcaattgagaatgggaagatgaaaatgagagggaggaggtgagcggatgctagacccctgccacgcacgtgcacgcactgatgcaacgcttgcacccgcgctgcatccaccttgcatcgagtgagccaggctgaggagcgaagaagaaatcggccgtttctctcgggcctggctaacctacttttgcatgaactcagccaggctccaaagggcatgcagttaaccaaacaagcggacgcgtctgcatctcccatgcgagccagggtagatccaggcaaccaaagagcccctaagactaccaatatggttcatatctgatatgcacatgaaaggaaaattgatacagtaatacaatatgctaaaacaaccagaccgatgaaaacaaaaaagttagatgcattgccacacaccaaaaaactaccgtatagattcctataggggtgaaagagtctagcggcgaaccaccaagatcaaacccctacagttagttaacatcatatgccaactgccaacatgccaaaaatacccagcttacaagtcaaaacagctccacaagaacccaatcaccatgtaacccgatctcgcctcgccttctacctcgagcttgtccgcttggggctggcggatgcatctaggaggctaggatcataggaaattcaggaaccctccgcacgcccaaaacagaacatatctgccacgaaccctacggacggattgcatcctagcatcgaacaaatccgggggaccaatccaatctaatccaatccaacagcgcactccgacaacgaatcgcacgggatcccaaaacaagtattccatttctcagcggggcacacgcggcggaaccaaacaatcagaagctagggcttaccacgacgaggggatgcctggaaaccgggcggatctggttgcccggcggtgcggagaggcaggggggacgaggggcgggagaccgaggccgcggcaagggaggggggcgcgggggaacggaaggggtcggttctgcggtcgccggcgaaagacgccggggagcgggcggcggcggcggcggcggcgaggtgggggtgggggggtgggggggggaggaggggatggggtgggggcaatcgggtgcttttgccctcgtctctttttctcgttgcgcttaggacgctttggtgggagggcgtcaagagcgagtcgagccgagaaaggggagacgacgcggctccaccgtggaaggggcgatacgatagcgcgtcctttcccaccgttggatggtgggcatcaacggctctcttttttttctttttcgatctcatatggggagtatattttagagaacgctaaccatattgtgataataaaatatctatatcgggcttttttccattaactcgcttacacttgtgactccctctctcttggacccccttacctttctcccacactcacacaggagggcggcggcgtcccaaccttcgtctccatcgacattgtttctctggtctgccgtcgttgccgccaagaaaccccgagcgccattgctcccgcttcgtcggcattgacatcgtttctcccacctgccaccgctgggcgggaatcctcgagccttgtcgcccctgcttcgtcgccagcgatgtcgtttcttcagccttgtcctccgctagtggcaaagttgtttcagagctctttagtttggcctacccctcctctgccatcactacaggataggaagaagacaatgtattttttatgggtggtatattttgcgaattttttaatgtttcagccaatgtatcttgatgtttttttttgtgttggattaaatgttgcagtgggattttttatagtgtttcaatttgtctctgattcttgtggatttgttgatgtttcagtaattgaagcttgatgtttcatattcaatccatggttcaaccgtatttcatataaaatatgtgttaagatagtggtggaatattcttccacaagtactggaaatagagggctgaaatagcgccctctgtatgtttttctatatttctacaacaaaaatgattttacatgagtgtaagaccagtgaaactgatattttcctcctcatagataaaaattcaattagtaatcaataatatttgctttctatactatgagcacacttataaagacagatatagtagatacgaattctctaaagctttggcttttttctcgtgacatcctatgtatgcatgtgatagatatcctctaacatcaaatattatcaaatattatgtctcatcctcgtcatcctctagtttttaaaggctatagctatgatggtagcatcggcaagttaaaacgaactacaaggaggtaaatcgtggatttgtatccttgtagacttgaggatttgttttcatgattatcggcctgtagcctgatcatcagttactatattattaacgtggttgttcatcaattactatattactaatgtggttgttttagcatactatatacttactttatgttaatatagtaccatgcaccgcgtggtatttttgaacaagtagctagtagctcgtaaaagggacgaggtacatgctctaagatcaaaagggatggagagtataatggcaagtcattagaccacatttgcgcaaaagaagtatggcaaaatgtgctgggtcctttaaccctatattagacatgctcaaatgtggagttaagctcaacttagggatcaggtggaaataaaaactcccaaacccgatgttgggacaatagaagaagctttttctcatgtgcaccatatatctcgctctcggtcacaaacactaccttgaacatccacaacaacataggaatcatgaacttttgtgtcatcaggccaaggaattcttcacagcacgaacatcacaggaatcatacatgttcacctcagcgccatggcactccctttccctagaatgtctacctgcccacttcccttcacttccatcatgtcttctacatgaaaacgaccgtccatctcatgcaggtggttgcagttaatacacaaatcatggagaagaaaagcgttgctacaacataataggaatttagaagttgtttgtcaaattctattggtccaacctttagagggtagcggagtaatcccatatggaaccgaaagggtcaccatgttggatcaaagacgcaataagaaaccaattcaaatgtgacaattgaacattgtgaagatccagcttttttaatatataatgattaaatttggatgaagggagtttgaatatagtcacctccttctaaggctacgttcggaacaattgcctaacttgactctaatgttttccatacacacgctatccaaacggttaaacaatgcattttttaaaagtaatatttatagaaaagtgcttaaaaaaccatattaattgattttttaagtttattaagctaatacttaattaattatgcgttaatggatcgtttcgatttatgtgctagtacgaaaggttgccagccttagcttagggtgtgtttggatggagggatttgggtggataggacatggcggcccattatttgtgggtgtttggttggtgggcggaagtgggatagggcggcccggaggggaatattccctctagatgccggatggtggtatctggccgatttggccggatggagccgcccgagcgctcgggtgagcggggcgagcgacgacgtgggtcgtgtcacccttctcaccatgcgaaacagcgatgtgggtaagcggcgatggcagcgggatgaaggaggcggcggtggcagcgacccggtgcacggcggcggcaacggaataaggatgaggggacggcagcggcaagcccaaaggcggctgcaacgggaggaggaaaggagacgacgacgacgatgacgaccggtggggggacggagacgacgacgacgaccggaggagacggggacgactgtgacgaccggtggggacggagacgacggcgacgactagatttggaggatacggggcagcggccggtggggaaggagacggggtggcggccggtgtagaaggaaacgacggcgacaaccggatctggaggagaggtgagacgagcgtggcggagaccggtggggaaggaggtggggcggaggccagcggtcgagaaggcggggcggcggccgtcgagaggagcagggcggcggccgttgagaggagcgggcgaggcggcggccggcgtgcaagaaggtgaggcggcggccggcgtgaagagcaagaaggaccaactttttttctttttttctcctttttccccttttatttctctttagattttttattttgcagtacattgataatttttagtttggtgaatttgaaggggtatactcaccacctctaatgatgaggtgattgtaaccactcatccatcctactccttctaaccaaacaaaaaaatggatcaccaaatccatcttcatccctggaaccaaacaaaagactggattgccatattcactctaccaaacaaaaaactggctcgtcatatcccatccaaccttgactgtgaaccaaacacaccctaagcctaaatacttatacaaatttagttctagttttctccttctaaatattatacaaatttattttgccaaaaagtctcagctgtccattaattggatgagtggctcacatcactcgcagtatttacctccggacgaagaagaaatcgccgccaccctctccaaaaaccctagctttcctccccctcgaaaccccaccacaccactgcaacgcgtgcgagcggcggcgagaggaaggaggagaccgatggggcgccgtacgcggtgaaggggcggaagaagaagcggaagctcgacgacggcggggcctcccgcgagcccccggtcgacgaagaggcggcggaggagctgccgccgccggagggggtggaggaggaggaggggaaggaggaggacgtggcggcggcggcggcggccggggaggttgctgatgggctacccgtcgtgccacggccggtggacgggaagcggcggcccggcgcgatcttcgtgctcgagagggcctgcctcgaggtcggcaaagtcggcaaggtatggggcgaagcttcgccaacaaatttattacacctttttcttgcgcttttttttcgaccaatccgtttctggctttggatgtacagtttggatagttggattagttctgttcttatgcttatcttgataaatttgtttgcgctagaagataattcagctgtatactttgttaacgagttagctgtattgtatctgaacatatcattctgtatacctgatgattgaggagcttaatgctacacgaatgatacttttgacaattctttgttagctatattgtatctgaacatatcagtctgtagctctgatgattgaagagcttaagctgcacgaatgatatttttgacgattcttttgactctttgtgtagactatgcaaatcctgaactcggatgaccatgctaattatttgaggaagcaaaacaggaatccagctgattacaggcctgatatcattcaccaggtatttcgaatttcttgtatttccggagctcccagggattaatggcacatgattaaagcctgtcctctctcacatctgtacaacccctgtttgaaactgaacgaaagcagacatccaattttctgtttgaaatcattccgtaccacatcattatctgtgttctattttggcttcccctattgaggatatatacattccatggcatttacctcctcacttttgggggctaaccacagaatggcccctctggtaaaggatactacctccgtcccaaaaagaatgttattctggctatgcatctagacatactcttatcaggtgcatagttagaaatgcattctttttgggacagaagtagtagctgatttctgtagttggtgctgtgcacataacaccagaatgaagtcattcttgaaagagcctcgtggtgattttacaaagaacatctaagtgattaatgaaaaagaaattgttcaagccagtcattcatttctctcatttgttttatacctgctttctcaaagccaacataatttgtattcttaatattttgcaggctcttcttgcaatatttgatagcccactaactaaagctgggaggttacaagctgtttatgttaggactgaaaagggagtattgtttgaaatcaagccttacgtccgcatgccacgtacattcaaacgtttttgcggtttaatgtgtaagttaataatggctgtaattgcacatatattgtgtttttagt

SEQ ID NO: 40217 - DNA, 2884 bp, Oryza sativa
atgagaatcacaacataaagtagtatttgtaaaatatacctgcaaagatgcacttttagctaggtcaaatagtataattcgtgacccaatgaacatttagtagcacatttttcttgatcagggcatcaggtaatggtccactgttggttgttgctaattcatgagtttttttatacttaggtctttcatatagtgctgagaagtcagtcaatttgtttgactatgttgccaaatccagtgacgatgtaccccttgtgtttgtggtgagttaagctatgccgtcgagttgatttattttttgttccattctttcttcctggtccatctcttatagtctgcacatgatttcaggtaggtgctatggctcatggaaagattgacaacgaatactcagatgattacatacaaagtaagttaccttcaattaaaattagagttagagcaaacagtttgcaggatcatggtgatatcatctatttgctgcattcttttgttattgtctactccctccgtttcatattgtaagactttctagcattgcccatattcatatagatgttaatgaatctagacacatatatatgcctggattcattaacatctatatgaatgcgaacaacgctagaaagtcttacattgtgaaacggaggaagtagctgttaaaaatattattacataaaggtttcaagcaagttgcatttatcatatgctcgctcatttgtaagacaggtttacaatctagctctgtaacacaaatgccctgttgcctttcctgagatgcctggaatgttgcgtgcatttactgtctcaaagatgttttctttagttcgtaaaaaaatgtttttcctttgtgacttatgtaaatatagacagtctcagatttttttttccttttacttgtgttgatatccattgtcttcagatggtttcgtttgactcgtgttgatattctgcacattgttcttgcagtttgcaattaccctctcagtgctgcctgctgtttgaatcgaatatgcagtgctctcgagcagaagtggaacatccagtgaaaggaaattttgaaaacgaacactgaaaaacattatgtgaaattgttgtgtactcgctagctaatgcaattttgcggtctcctcccatgctgagtgtgtactgtattctgattgtggagacttgaaaactccggtggtaatagtgttaaagttcaatgtttgtcgcaacaatatgttacatcttgaggcatactgttgcttatgattaccaccagccttgagctaggttggttgaaaaccgaactgcaacgtttgtcctttgccccaaaattttacgctgagctgagatttacccgcattaacaggaccatttcactcccgagatctcatgacaagcggttttttcgtttgattccttggttttatttatacttctactcaacgcttggtccatatatatatagtatcacagaaaattttaagatagtgggacagttcaatcatgaatcagatcttctaaaataacacaggaaccataccagtcaatgcctgcgagaatagaaaaatggttacggttgcataaaagcaaatgctttagctcttcatgttcagtccagcatgatagaagaagacattgcaatctctagagctgtttggttcttacccaatcttaataataccaaaaaaaaaagttggcaatccaattaatttgttgccaaataattggcattccctttcaaaaaaaaaaaaggtggcattgccaaaatattggtaagcaaattgaaatgtagtgtgaacacatttccaagtggaattttggcagcaaaccaaacaaccctcaccaaacattttcatcaggtttacattgacaatgatccaaacattgttctcaggatttggcaatgccaacactttaaacaggtttacattgacaatgatccaaacaagcttctcaggtgctaggttttgctgaaattaccaagcagaaagaacactcgatgcaactacagtctacattacaagtacaggtaaaaaagtggatgatccttgttatattcacaaaatgttccacggtaatgagttcaacggccaaactcgttatttcatttagtgactacgatacatacttacaaccgggcacaattcgagtaactcgatcagttattcagaacttctttaacttcacagcaagcttatcaaggtgaaagtccatgatctccgagatggtctccaagaatgtctcctcactagttcctggaaggatggcatcctctgcttcctctatgatggcctcgatttcagattcttttttgactgtttgcctgcataagatgctgccgatgtcataaggcgttaggcctctctctgcccccttcttcaaaagcattgtgctgatgcgcagaactcgggcacactggggagatagcgcccacccgtggaacttgagaagcgcaatgtctttgtcagcatctagtgatccaatgtatgctgcggtttctggaccgaagggttcgcgggcttggggccagtagagccactcaaaggtacaatcttcaaactgcaaaggggaaaaggtaaagactcgtaaactggtacagaaaaattgattgaactaagcaagatagcatacaaggaattaacttgtacaaaaataatgccagctaacaatgattcaaatcaaatgaatattaaggacacacggccttgtttactggatcagtgccgaaattgtcacattaacatagacaaaaacattgagaaaatacgaggatattactgacattgtttaaacttccaacaacactaaataattactagggatctctaattactatgctaaggacaaaaatagcagtttaagtttaccaattcaagcgagtgaacataaatacaat

SEQ ID NO: 40218 - DNA, 9427 bp, Oryza sativa
gcatttgccaacctaatatccagtatggcaatcttctgaacctctttaactgggaaagctcgagggcccatatcctcacaactgccattgttatctacaaacagctgcaatgatccaaccttattagatcccttccccatatggaaacaacggaccaacgctgtgggtggtacaccagaaaatccaggaacatcacacgatttacatccataaactggatggtcaagaatatatgctgcaacctcccttaatgcaccttcccctactcgcgttccccttttcaacccctcaccatcagttgacaaaggaaggcccctgggattattctttgccattggttcctcatcaataggcttgaatactgcaacattgctttcacctgaagagtccttcatgaaatagactccccctgaaccctctgttgacatcacgggaaggtacccgttttctataccagaaattgttgagtagatcatttccatcacagcaggagacaatttcacctttccattagcaatgattggctcaactggagcaggtttacccttagctggtttcgcaaggttcaaagcatctgtttggaggttatcattgtctttgggagtaacaactgtaacaacagtttccttatcaccctgctgtgtctgaacctttgctggcctgcggatgaacaagtggataactgcagcacccttcttgctaatatctgcaatcaattggttatcctcaagctcttcaccgtcaaacacaagcctttggtccttgagactcccaagttgctgtccactctcagctgagagcttgtccttgagatacccaacattgcagcaactctccacctggaactgaaatttcttcccattggcagtctcaatgcttatcgcacggaggtcagccaaccgcacgacaagatgaagcacatttccatcggtaagtccataatccctgacatgggagttgtttagtgacagctcatgcccactgaacaccagccgctgcttggtagtgacaaagcccttgaactgctggatgcggagcttgaccgaggcaacagagtctgagtgcaggacacgcattggcatgggtgccacccctggcatggcaagaaaaatgacaatagaatcagctgctgcaaccggggctcgccatggggcgcaaaacaaaactggtccagcagggggctcagtgtggctataccggctgacgacatctttgctgatctcaagcaacacagccaaggcagccaaagctactgatgcaacaagcacaagtgcacagccaccagcactagagaagcagctatttgcactatgaattagtggatgtgacccattgatgaaaaaacaaaccctagggtctcctatcaacaaggaaaccctaggggccaccgcttgacaccaatgcgcctataatcccttcttggcccccaatgcgttcaaccctgcacattcaagagaaacaaatcatcaaaccctaggtgagcaatcgtggtactcaaagcagcaatttcagcaaaccacatagcaacaatctgagcatttcgcacccgaaccgaaggaatcgtgcagaggcggcaggatcgtctctgctactactccaatggcgcagcagcacagcatctgtagaagttcaaaaaaaaaaaaagaagaaaaaaatataaatcgagtaggaactcgagttcggccaggggattcgaacagcacaagcaacagagagacccctcaccggaattgatataaacagattggatccgaggaggcgcgaagacgaagcctcccagcctcccttctccgtctccgcctccgcctccgcctcggcctccgacgggccgcgaacccccgcgagattccgcttccgaagtcgcgcagtctacgatcgatcgccattgccaacacgcgttagaaacacaaacccgaatccaaaaaatcgcaccacttcctcatcgatcctacccatcaataacacaggaaccaaatcgctcccgcgggagggagaaatcgcggaaagtgaatcggagaacgaatggatcatcttaccacgacggcggaggcgcggattggcggtggccggagccgatcaactgctccgcccttcggaagagagagagagagagagagagagaattgttgaaaagaaaaagaatgggtgagggtttaattgggcgaggtggtgtgggtttagcttagcgtggtgccgtggtgggagtgggattttaacttaagtaggatttggatttggatttggagttggaaggcggtggctttggcttcgggttgccggcttcgtggggaacacgttggaaaggagtcggttactgtttagaataagtaactccggtaattaattataattattaattaattaattgtctgtttgtttccagtaatgaatgacttacaaaaaaagaaacccggggttgcaacttgcaagtcaggccaacggtgagctggggccattaggtcctactgtatttcgaatttgaaattttatgagcttttataggctgactatttctgctagttaaacttatttaagtttgacaaaatttatagaaaaatttagtaatatttttaatacaaaacaaacatattttatattaaatattagttttaataaagctaatttcatgttttagatgctgttaaatttttctatatttaaataggaaaataatcaaaataacttataatatgaaaaataagagagtagttgacattagacattgctcgtttcaaaatcgctagtagatcttttctgaaaataacaaatactttagaagtttttgtaaaacacgaaccctgctatatgtacaacttctacattcgatcggtgtacaatcgaaacggcaaagcagcacagtacatgatggcgtgaggcttcatgtgacgtatagcatgttgctgatgccgcgtacgtcgttgtccaaaagtcggacgctccggtcgtttgtatattattttcggtaaaacactttaatatgaaaatggaggaagtaaactcgggtatgctccaacgctcttgacggtggtactctataacatgcgcttgtgaaaagtgaaaacccaagttgggttctaattctagataaatagaaaaggaaatataagaattgcgttataagggaacatgaagttttttccgattggtaataattgaatagtttcctatgaaaatggtaaaaaaaatcttgtgaaacttcggagttacaaatgatacatccaaaggtgtcatattataagcctataaattatgtagatcgaaatgtttacaatgcaaccattgcacaatgatccccaaacaaggattatataccaagaaaacaaatattacaacgattgatttctaagcctgtgttcgagaggtgaggcccacacacgcaaaacagagcgacgcattttcttatgattaattaagtatttaatattttttttaaaaaatggattgatatgattttttaaagcaactttcatatacaaatcttttacaaaaacacacagtttaacagtttgaaaaatatgcgtgcggaatacgtgggaggtgagttgggaaatgtgggggaagaacacagcctaattcttctttgctagcgcttgaagaaagtacataaattaaatgggagaaatttgtaattgattaggaagaaaaagtaggtgaagaatttgaatggtgaaagattgtgattagttgataatggaatatatgtggtgaaattattatattttagaataaattttaaatgctaaaagttgatatattttaagacactaaagtaacaagcaagttcgcagaaaggatcttgaaacaacaacgacaagcagtcaagctgctgccaatgccatggatgttcctgggctcctgtgaagaattctagaaaatactctatccatcccaatatataacaattttggactgccaatgccatgaatttgaagaatgatatgtccagattcgtaatagtaggcaaatccgatactaggctacctccttcggtttgtcacaaaataagttatcttttaataatcattacatcgaagtttatgaaggtaagagataaatggattgggagtaaacaaaaggagaaataattttattgagatttgataaagtgaaggtattttagtttttgtattggtacgtgtgagatgaatgaagaataaacttattttagggttggaagtataaacttagggttggaagtatgtttatagtttaagtcttggcgtaaatattgaagacgaccgactagttgaaatcgtggatacgagttacgaccggcacagatcgatcagcatgaatcgacaccgaaggtttggtttggccagtgcaacctgtaacgttatgtactagtgctttcctgccgtaataaaaattttcttgattcctactggaaatataccacaaaattccggcattctagagcagcagtaattacattccacgtcacacacaccaagctgtgggtgaaagagaaaggcaatgtgaaattaacatctatctgccatccttatcacagccaaaagaatcatatccctggagtctgcggataactacagatgatgatgatggaaatgaaatagcttcaacatactgtaacaacatcccaagtcatgcccacagcgagcaaaagatttatacaccacaggtagttctctctctctcttcctctcttcacattcacaggttcctctctacaaaatcccagatcctctcttccatatagatccggtcccctaaccggcgcggcatgtgcctctcgtcggggaagaggaggatatcgtagggcttcccctccgccatcagcgagttgatgagcctcgccgtgtgcctgaaatgcacgttctcgtctatcataccgtggatcagcagcagcctccctcggaggttcttcacatgatgcatgatcgacccgtatctgtaagcgtcgcgctgctccgagggcagacccatgtacttctcggtatagaaagtgtcatacccatcccatgctgtcaccggagcgccagaaactgcacaactgaacgtgtcgggaaatctcgcgaggcacattgccgagagaaagccaccatagctccagccgtagagacctatatgtccgggttttgctaggcctttctttattagccactcggcacctgctaactgatcttcagcatcgacacgaccgatgttgtatttgagctgtccctcaaactgcaaaccgcgtcttgcggttcctcgattgtccatctgccaggagacagtcagtcattcagtgttacaaacaacttgtattgccatggctcatgagcccaatgataaatgtagtgacaaatgcggaaatatataggcatatgattatactccataatgagcaatcaacaaatgcggaaatatataggcatatagcagccagcataaatttatcatatatgaataattctaagcaaaaaaaaaaactcatgtaaatatatgattatagaaacatccgttccaaaacattttgcttccacttcaaaattcccaccttaaaactttagattatttttgctcaagaagcaatatggttagtcatgatggattgtatcatcaatcttaccacttgccatagtcgctagggatagggggtagtataattgtttgcttgcaactgacagacattactacaataaaaaatattggctgctggattgtattgggcttttcaacccacacgtcacttaggataattacatggggcttttttggacacttgtaatgttttgctaattcctaatgacaggaaggttacaggcgccaatattttccagacatagttgtggacgcaggaacccttattagcttagtggagtggtgctaatatttctgactcaacgcaaattttatgcttgaatgcactattgcattatctgaggttgagtccatgttaactctcaaaatgacatactgatgtgctttggaaaaattaatggatgagatgccatgcattgcacagcataccttgttaaacaaaaagaaattaaatggtgctatcttggccataagtttatttaaaatcatttttagtttagaattttacccatgcaatgcattgcacagcataccttaagattggtgacattatggaccaaagtgaaaacagaaaaaaaaaatcctcaatcggaatctatcttgttaaacaaagagcaaagaaaaaaaaatagaggaaagaatagttaccttccaaactaatatacccttactacgcaggaactgagctctcatgtcaactgtacttatccatgagtcacttacaagctggacactgggaccgccataaacgttaacgagtgttttgtatgggggtggtccatattttttctcatcagggagataaagagttccatataaagcagtcccatcctttccttcaatctgtactatctctggagacagctgctgaaactttttaagcggctgaacagtcagaggctgctcatatagaggcattatcacacttccatcaagcaaagagcatagcaggatcacaggtggagattttattgagtcatacacatcaataaacctcagcaactgatggtcaagaattactgaatgacgtcctgtgccatgagtcaacctcttggggacttgcaagggaaggctccaatccggaaataggttggtggagtaaagatttgtctccaatggcccatccaatgtgcctgtaaaatatataactccagaactctcattgacaccagcaatttggtcgatcatccaatcaccttgtgtgaggggccccaagcacacaccattcttgtcatgaagatacaggtgtctaaatcctgtcttctcactggcccaaataaatccacctggatgtttactattcactcctttatccagaggagtaaaacaatcgtgcaatgttatccacgtatcatgctcttcctctagtatgacctcccttttacctgaagcgatgtcaaacttaagtagcttaagttttgagtgagttctattgagaacttgaacagcaatagcactattatgcatccagtttactctagcaagatattcttcatcaccatggatactatttggttctccacataggagatccatccaagttatttctcctccatgggaagaaacaactccaaggcgcactttgacattagcagcccctgcaaaggggtaagcatgatcttcttgagcatctggaccaaccgaacttttaccctggtgcataattctatacagtgggatttcagatgagtcaacttcagtaaatgcaaggtgtttgctatcaggagaccaccagaatcccatcttcctttccatctcttcctacaatgggagatacaaaatattaggcagcagccatcaaaacaaattccataccaatcctaatggatcaacatgtgcacctgtgcaatatactcagcaagtccgtggatctgggaaaaaaagaaacaagtacaaatgttagattctgaagttgcagtaacaacacatgatgtatgatcttgcatactttatttaatccccggtatatatttctgttgatcatgcaactactaatgcacaactcagcatgttttgaatgttagaagaatactgatagcataatatacatgctacatgggtaagctaataaaaactatgagatattattggtaaaggggaacataaagttcttttagcaggcaagtttatcctagaagcttatttgagccatagcactaatggcggcagttaactagaacaccctctaaagtttggttaaaagactaacttataaaacttgtagtctttataaacaccgccagcctcctgcaatagtttcggctgctgtgtgtctttggaaggtaaatatcccactgtttggactttggctatggattaagcttactttggttcaaccaaaaaacaatccctaccaagaggtagaaagaaatatttgaactataacacattgaatatattgttgacaaaaaaaatcaatatattgcttagttccaatgatagtcatgttgggttacatgctagttccaatgatagtcatgttgggttacatgccaagaataaagctaataaacttctagaaagtcaacatgaaacttttctttgcaacctgctcaacaagacttggtatgataacaaacaacacaatgcacacatattcctattaaaatgtgagtatcattaacagaactccaaagaagtaccttcccactttcgcttgcaccataggtcaactgggtagtttgcccatcagagaaccccactgtatgcaactcatcatcccgcacatacgcaatcatgctcccatctggagacagatgtgggtcaatgatgggggatgtggctgaactttgcagcttgagtacaggttcagcaccagacaaatcctggaagtaaacctatggaaatagaaaagatatatttccatgaaactcatgatatttagcatccttgaaaatttacaaaggttatctgaaacatcaaaaactaccagaaaaagaatatccatgatacgctgacaacacaaaactaaccatagatgacaataatcaacacaacagaggagttttatttctttgaatcagtagcgagatcactatttaggaacatgtcagctacctaatccaccaatacaagatgcagcactataccaagaatgcaggaagtgcgatctcaagcacagacctgcaggcactgataaactcaacttcatagccatcactaacgactacagagcaaatatggctcatcccgcgacatccaaaccagaaccataataatggtcacccaacactgccccacaaaaccaataccagccttccattaattcaacactcgaaacggaaattaatgagcctaagcctatccatgtgcagttgctgatagcaaaatcagaatgtcaacctcataccaaatccttaatccgagaaagtggtccaatacacaaggataaaagtataaaactaccgaatttgattagggcaatgcgtatcatctaatactaagttactaactcaactgaattggtaataatataaatcaaggaagaactaaatgggggaaagggtttgcggtttgagagatacgaaccccagaggggagcggcacgacaatgccggcgcgggaggcgggggtgccggggaggcgggcgcgccactcgtagcgcgtgacgccgaggccgcgctcccgtgcgcgctcgcggcggaggcgctcctcggcggagaggttcccctcctcgaggccgccgccgtcggggggcccgaagaggagctcctggcgccgctgcgcggggtcgaaggcgtacacattccggtgaagcgtgccgtcggggctgtacaggaaggccacccggcggtcgtcggggctgaagctaagcgccacgggcgccccgtagcccgggagcgggtgctgcacgatgtccaggagctccacgctcggggcg

SEQ ID NO: 40219 - DNA, 6998 bp, Oryza sativa
  unsure (1)..(6998): unsure at all n locations
ccaagaaaacctcccccctccctccccaacccgcgatcctccacacccaacaacaaaggcggaggagaaggtatggtgccctttgaaggcagacgaggatctcaaatccgaggcggagatcggagtggaggaggagagagagagagagagagagagaggatcggaggagaggtggagggcgacttggagttggtcgttcgttccaagaaggggaggagagagagagagaggcggcgctaattgtaagtaagtttgttgagaggagggaggcctttgggatgtctcggtttttcgttggattggatcatggatggaaggagggcggtgtgaggagggtggtgagtgagtgtggttgctttgcttgactgggtctggtctttcttgccctttgcctctctccaattctatcctaggcttccatcggttgccattttgcttaaaatggcttatttggtttattagaaaattaaagttaatttataagtaaaacttttgtagatttgttcgtagcgacttaaaagccaacattaacaaaaattacgttaaaagcatttcaaaatcaacttcaaaatcaagttcaaaaattcaaattttagcttattctttggctgtttaggccaaacgatggggctgctatactctcttttttttgttgttgttgttggataagaggaatttgtaatggttagttgtcttgaaattaactgttctgtagatataaaatatcatactttccaatgattggatctttcttgtctcgagatgaatttgaccaaattatcttccatgtgcttctttttcgtctttaacatcctaaatagtctacctgtcttgtgttaattttggtaccatccttattccaagcacagttatttgttatgtgttttttaataacgttgatataaaccttagcttgtgtccatagttctacatattgagttttttttaaaaaaaattggttaaaagttctctaaaaattaagttatatattattaattatggactaaaattctgcaaagacacttggcacgtgtatgccaccttagtaaacatggataaggaggaatgattgcacatgcaaggacatatgtatgagagatggaactaccggtgtgtagtaatgcactaatgcgccagtatcaatagaaattaaataattccggcaatcctagaataccaaggtctggctgatgattttctcgattgacttgagccaagagcatccagacttcttcacctggcatcgggagagccctggatgctactcgatgtgatctgcttacaatgcgatgttctttgagagtgtcaacttcccaacattcctaatttgggagagaaaagcccctagcgttgctagtactttgcatggttagttgctaactgacgatgttggatgaccgattggctgagtaagcgaggtttgcctcacccagccttaagtgtgctttatgatcaacaggaagaaacaattgatcacatcgaaacatgtatctcatcaattttggcagctgatcctgatcgccatcgggcatccatgcttctttgcaaaaaaaaaaactttcttcctctcatggtggtgtgagtgcaagaagaaagtaagcgggtagcttcaccgaggattcgacaccatcgtcactttagccacctggttgatttagaaggaaaggaacaatcgagtgtttaaccaatggcaacagacctagaccgaagtgacacgtgatgcggaaaaagatgtgctttggtgtgaagttgggctgctaaagtagcatcacaatatagtatcttggtcgcacaatggatgtcatgatagataatcttgtttacactttgtgtttatgtttgtttttctttttcacttgttggctgggttagcaagatgcacattaccctcttcttaatacaaaataaacacacatcttatgcatattctgcccccaaaaacaaataatttttgtctagaagcactgtagtttgttataaatttacaacaactttcaagcggactaatacttgtctcatgggcgggggtgctagcccttgctagatagatccggtagccttttcaaaattaaacctataaatgggagacctatcatgcacatgtgaggactaaaatagtaaagaaaaaaaaccctatgtcgattttgtttctaatttcgaataattctaatacgaatagtatacggaacgaaaatggtggtatgcacattgaggaaattcctatatttcttcctcacgcaacactccatcagcaacttaggtcttgtttgaggagcttctagtaacttctcttagaatctaaagttttccaaatactgcagattcttacctagcaatggtggattaggctcatcataaaagcccataaagcaattgaaccagcccaacaattgcatgttactgtgctacatgcacccagccatcccacacgtgcaatccccacctccgctccacccgagcctcgtattggtagttcagtggcattgtcttagcatctctcacccaagcgtgccgtgcgccaagccaaatctcgcctcccccctcctcctcctcgcccttgccctgttcgtcatcccactctccgctcccctctactgctgctccatggcccattcctcttcgcaaccattgtccctgtccccgtccacggtggtcgcacgcacgccactcgtcccggttctcttcgtgatcggcgactccacggctgatgtcggcaccaaaaactacctcggataactcacccgcgccgaccgcgagttgtacggccttgagttcgacactcgccacaacacggggcgcttctccaacagtcacatccccatcgactacatcggtatgtatctatgtatgtgtcgtccccttctcggcactatggctagctcgaggacatcctagctggtctaccgagcataaggcaaactggcgcgtgctaaccatgacagggtcccgatcatgaatttgttggcgacttcgatagggaatgatcactcttgcaatagctgaaaccccacttctccaacatgggctctcgcaccaatcttgatcaagacaacatcatgaccgcatattatggagagttgttgaaaactgatcgccaggtgtttgagactcaacttgaagaattgcttcaaaagatggcttcgtactaccgtaagacgaggcaaggcatcatcaagcaacaaaaattcatgttacccatccatgcaaaatcaaaggtaacaacgattctagcagtgcctattctaacatatgaagttgtgatggtgatgttatttctagtttaaataatcggtttacttctttgaatactacctttgagaaaacctttagtactaccttggaaagccctagatgatcacatgagtgagttagagaatcgactaaatagccggttccttggtggtgcatgtatttcatgcaacaacgagcatatgcatggtattccttcatattttcatataccaaaattttctgtacaacaagattggccgatgaaaaatacccacaattccctcgatacaatagatcctagattcactcctacgatactgtatgctggtccgaccgatgtgttattgctggtcagaccggacgcatcgatcggaccgacgggtgtaataccaccagtccgactagaggcagcagccgatccgattggagggacatcaccggtcagactacgctcggcatgtttcgtagaatcagctcatgtctggtgctcctctaaaagacattgacatgtggggtccacgggctgactcaacaagattggataaactgcctcctaaaccgttcaaggagtcaatttgtaatggttttgtgagttggaggataggttatagggatgcgattcaaccatgggcatgagttgagggaagcaaagtagacttagggcctgttcactttgatgaaaaaaaaaaccttaccaaattttggtaggcaacttgccaaaattttggcaggatttcttatatagttatcaaaatttggcagcaaattaaatatagtcacttttttggcaaatttactaaaatttggtaaggttgaaaatgacatcaaagtaaacaggcccttattacccacgggaatggtgtggggtgggctggtaatataagcccagaaaccaatccatccagcccagcaactgcgaggtcggctgctagtctaacgtgcacccaagccatcaccccacacgtgaaaaatccccgctccacccgcgccgcgccgcgcccaggtagttcagccgcgcgccaacccaagctcgctcgccggccggaaatggcgctccccttcctcctcctcctcgccttcgccctgctcttcccgctctccgctcccccgcgctgctgctccgcggcccccgcctcctcgccgcccccgtccccgcccccttcccctgcggcggcggcggcggccccgcgccgcacgccgctcgtcccggcgctcttcgtgatcggcgactccacggcggacgtcggcaccaacaactacctcggcacgctcgcccgcgccgaccgcgagccgtacggccgcgacttcgacacccgccgccccacggggcgcttctccaacggccgcatccccgtcgactacatcggtacgcgccccccaccttctcgatcggcggcgccatggctgtggcccctttgctctctcgtgaatcctccccccccccgcttcaaaggttgcaggtggttctggaatcgtcgatccgatgctgctttgcctctcgtacgcctatggatgcagcatgttgtgggtttagtgtaatctgggttttgggtttctggtatacgaaggttttgcttagttgttggttcctatgaatttggggcatctgatctcatacatcgggggtatgtggatttttgcccaacaattgctgaagctgaagagtaatcagttcatagcactctcctacacagctgaccacctggatctcacatacatagactcctgcggcttcctctccttgatctcacatagcaatgttgtgggtttagtgtaatctgggtatttgggtttctcgcatgcgaggggcttgctcagttgttggttcgtctgtgggtttctgccgaacaattgctgaagctgaagagtaaccagttttgcagcacaaccaccacagtctgggcatcatttgatcctgctgttcttagcactcctgcagagctgaccacctggatctcacgtatctatatagaatcctgcggcttcctctccaaatcagtatccagtatccaccaccgttatcagccgttgaggcaatgcattggcagaatgccagaacattaagaagtgccatcataatgtacaccattagtccatgcatccagaaaacattgccagaatcctgcaatgtatccatttgatagtcctgagtcccgaccagttgtctacatgctccagtctctttgccaccacacactgttaaatctctcttgtccaatgtccaccacattctggacagtttcaaggtcctcacaggaagcacagctgcacaacctttgttaatgttgctttaagaaagtcatatctactcattagtttctttgggagagtaaggagggaaaaggcataggaaagaaacatttaactagggctactggctcactatgtgaaagatgtttcccttcaatttcatttagctggtgttctttatctcttttgcccgtctctgtcagtacttatgtttttcatgaatcaatagtatcttgttctttcttctgtttttaaattattttttccgtgatttcttaatcttagacttttttgtgcatttgcagcagagaagctggggcttccttttgtgcctccataccttgaacagaacatgcgcatgggtgtcggcagtgtcgacctcagcaacattgatgggatgatacaaggtgtcaactatgcatccgcggcagctggcattctctccagcagtggttctgagctggtttgtcctcctaacttcccaacaactctatttcacgcttataatctagcaggaatgtctttgtgagacccttctctagaggacgaatcagaaggagggtgtttcaacaacagactagaagcaatgactcttctcatagtgtctacatcctctctagttaggaagaatacttgctcaaccatttgaactaatgctgaaagattctcctgttcggctgctcccttccttccatgtgttccaactagtgtggattatcagggcatcaaattcccttcttagttcctaggaattcatgacttatatatgcttcctaccagatgtgagattgtctacacgagacgattgatatgctggtgctgatggggggtttatttatgctgctggccttgtccaagtttgcttgtgaagctacagtgctataagttgtatggttgttttattttcctgcacgcataaagcaaaaggagatatatgtagccatctactcaaagctaatttatcataatttttttattgtctgaaactaaaaaactgcatttgttctatactatggcttttgggatgatcaaggagttagtaagaatcactgatccggcaccaatgtgatgaaattgatgtatatcatcctgaacattccattttcatatcaatctttattcctgcttatgttgttgaatctccaatctttgtgcccaaaacaacaaaaacttgtggagctgcaaatgctaattttgtcatttcaataaaacatcatggtggtgtctaaagaggagaaatgtttacgtatgaacattgctgcaaagttttcctttatgtggctatatgttttaactttctataaaggattggagcctcttggttagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40220 - DNA, 798 bp, Oryza sativa
aaatgggtgcccatttttccccttgtggacgatttctggtagcatgtgttgcctgtttgctgcctcaaactgaaggcgaccgtggtagccaattgcctgtgcagtatgattctgcaggggccggaacatcaccaactcgtcaccctctcccttctcaccgagttatttatgagctccgagtttactctcttgaggaggcaacgtaattttctcaacagtcttgttacatagtatgctcttttgctaggtttctcatttgtaaacgttctagttattttgaaattgtgaatgtattttccttacaggtttggcaaagttcttacatcaagagcgataagggcagctcattgcttaacttccatccaggttaacatctcatttgtttgtgtgtttgttggttttttagtgctgcaaaagataagcaggcatctctgctgccacccttctactgggagcagaaacatattatatacctcagataattgctgtcgaacttgtggcttgtgtctcaagcattgtccagtagcagcattataaagttgactggcttttgcatttttgacctaaacttgagaaatattgatatgaaattcaacaactttcttcatcagttaatttggtgagcacttgtttttctgcagttctcacccacttcagagcacatactattggcatatggtcgtcgtcataactctatgcttaggagcattgtgatggatggggaaactggaattcctgtatatactatcttggaggtacatatagttagattatgcataagcatagggctgcaggaat

SEQ ID NO: 40221 - DNA, 714 bp, Oryza sativa
attcctgcagccccgcatcaattttttttataagactagtcaagtacccgtgctttgctatggaaatctaaaattgtgaggtcacatgtttttgaacgatcctaacaagctaccaacatacaaaagtctgctgttgaaaataaattaactgggctaatgaactattgtctcctttgttaagtcacttttttttactatggcttccaaagttcattcagtaatctaacaatttctgctatgctagatctttgaaaacaatcagtgcagcgaattgcataaatcatctactcctacctgtttctcaaataatgataaagtttatgagttctcaatatatagaaaagatgcccgtgcgttgcaacgggtaacgacttttttcagtgttatattaagagctgagtaataaattaaaatattgggatcactatacactatgattgaaaaagttaataaaaatcataacattgggatcgctataattataattaaaaaattaatgaaaatatttcctgggttttcggtcgaaagccttccttccttttcagccctatgctagtgcgctacctccctccatttgatctgcttctcttcgaccctaccatcttcaacttcccgaatatgactaccatcttcaacctcccgaagataatcctgtgtccgtgcccgtacatttgccgaatcaaatcgccccatcaaatctagccgaatctttct

SEQ ID NO: 40222 - DNA, 1639 bp, Oryza sativa
aaatagcgaaaaaataaaaaaaaaagttcgactctctctcagaaacgaaaaaaaaagtccgactctatatccgatcactagtacagatccttctatctgtgacgggctctaatatgcttagaaatagcgggccgtcacaaggaagtcatctcaaccgggccgaaaagtacccaattgagatatggttgcacagacatgttagatgagtataaaactaaagcccgtcacggatgacacctatcagtgacgggccgtagtttaggcccgattgagataacattccatatctcaaacgggcctaaagttgcggcccgtcacagatgaccatcatctgtaacgggcaccaactttagacccgtttgagataacaattaggcccgtcacagatgactcatcagtgacggccaatatacttaatctctatcgggcattaactaaatcccctcaccgatgactatttttccatttttcatatgaaatgtttatatttgtaagttgactatagcaaaataatttagtgcagtataataattcattttataagtcagaataactttacgggtagtaaatgatttcaaatgaaaaaaatgtcaacaacaaagttgtataacttatcaagatttacaacttttagtttggtcatttttcaatataacatttttttttgaatagtttgaatttgaatttaaaaatatgacaacttcaaacaacatttttcaaatactaaatgatttcaattgaaaatgtcatcaacaacaaagttgaataactcatcaagatctaaaacttttatttttgttatttcttcatccgataaaatgttagtaatattattcacaaattttacatatatgtgttatagtttataaaaccagataagagatatgtcaattttgtgaacaatgttattatcactttgtcatatgaagaaatgaccaaaataaaagttgtagatcttgatgagttatttaactttgtttttgatgactttttcagttgatatcatttagtatttgaaaatgttgtttgaagttgtcatattttcaaattcaaattcaaacggttcaaaaaatgttatatagaaaaatgaccaaaataaaagttatatattttgatgagttatacaactttgttattgatgactttttcagttgaagtcgttcgctgatctaaaattctatttgaacttttcaaactttgaatttcaaatttcaaattgtttaaatagagtcaaatggagaaatgatcaaaataaaaattttgcacctcgatgagttctacaactttggttttggtgacttttccatttgaaatcatttaataaccccaatttgacatcctggcctagggcataataggattaatagaatactcataccaacatgttacaactactttttcggaagccaatctttaaagaactttaacattaagtttgaacttctcgcgtgggtgcacacgagtgagggctagccaaaaaataaaatttatttattttttaattatactcatctgtgacgggcattaacttaggctatagttaacgcccgtcacatatgactcatctgtgacgggttaatgcccgtcacagatgactcatctgtgacgggctataggtaatgcccgtcacagatcaggg

SEQ ID NO: 40223 - DNA, 18231 bp, Oryza sativa
ttttatatttacatttgagtagtatcattaatactggctacttctctgctgctgcgcttcactattatagtgtacaagcggtaggagagtactagagtaaagcggtaggagagtattatatacagctttccccaatctgattttcaatttttgaattgaagaaagttactatcttggttaaaaaagattactaacaaaaataagtaaagtatttgagtacgtatatatagcattttgttgctttagaaatgtgtagcggttgggaatttgtcatagatgtatagatatagcatgacataacatgtggtttcttgatggacagttttcaaataccatttgtagctcacttgattagttcacatgcatgtcgagtcatttttgtatggcaacataaagtgaggtcataactacagggcatgtctactgtagcatattacatatatatatcccagtaaaacataaacaggtgagttacaggggaaaatccaatatcatagtaacacataagatatgctacaagtatactttataacatatttatataaggtcttgtctagctttaatgtaactgatgaaaaatccgaaaaatttcagtcacttttttggacgactaggatcgcatcaagatttgtgcatactcattatctctcccttaacgattcttctcttttctagttcgcatgcacgcacatgagactcaggacaaatcgccacgccttgctttcttactgagcactgaggcctccactgccaccgcacttcgccccatggctcactagctagccagaagccatcaacggtgccggcgagccccctctagaccggccacctctctcttcctctctaatcttctggcggcggcgtggtgctatcgggttcactgccgatgaccacatcctccaaaccccatgacatccctcacccctgccaccaaccctacccacctgcgtgcctctaactccgcgtctccagcagcgcctccgccgcctcgccgctcatcgtcgatcaggccaccccagaaggccatctccctaatcctgggagaaaccgctcctttcttcccaaaaccccacggcttcccccaaccctagccccaaaaccctaactctaatccgtaggtcatgtaccgcaatcggatgtctctggcgatgagaaagataaagggatcggcgaggatctcttcatcactgttgccatcgccgagaagtggttgaagacaattctctaaacgttggatttcaatccaatgggtagggagcaggtgaacaccaaatctcagtcacctaaaaactaccatttcccttcattcatataaagatgtgagatgagaaagtacaataggagcacaaaatgtgttgcatatatatacacatggcagtaataatgactgacttggttaaaaggctagtaataaaattaaataaagtatttgagtacacgtatatatagcatagcggttgggaatttgtcgtttatgtatatatatagcctgacataacatgtggtttctggattttcagtttcaaaaacccatttgtcgtcgctcacttgatatatatcattaattactgacatgcaggtcgcgtcacttttgtatggcaacatagctaggtagagagcatgaaaacgtgtacgcgtgcacgcatgaggatatgtaagtgcgtacggtgcagctctgttgcacggcgagacgtacccagccagaaccagagaccgaccgagtccctcacctgatcagctgcctcacaaggcggaagcagtgcaactgcgcaagcatgcacgtatacgcaacacgcgtgtgtgtaatataatgtgtagctggctcgatcgatcgatctctggctgcctggctcgccgctcacggtcctataaatagccgcgcgctccaaacgcagcagcagcagcagcaagcgtttagctagctagctttctttccttcaatttcgtttccaaagagttgatcacagtacgtgtgtttagctagaggaagctggtggtggcgagaccatggtgggcaagggcaacgagtgcgccgcagctcgccgccgcttcagcctccgggcggcggcggcgtcgtcgtcgtcgtcgtccttcctcccctgtctcttgctggcggcggcgctctccgccggctgctgccgcgcgcacgcggcgacggcccgggccccgcgcagtctcttggcccgcttcccgacgacgaagatgacatcggagttggagaaggaggccggccggtacgtcgacgacagctcgcaggcggcgaggacgaacaacaagatcaccaacctgcaggtgtcgttcgtcggccacggacatgatactccagcaggtgctgcttattattattattattattattactccgctcgtgtaaacactcggcacgtacgcgtaccaaaagcttattacaaacaaacttcttaaccgtttaatctaattattatatcttagagttattataaaaaaatatatatgatttaatcacagtacttattatgtcaatagtgcaagttttgttttcaacaactttttgcacctatatatagctagcgtggcatcctagtcagagtccatgaaatgagcccaatgggcttaccgcctttggtccttggcccatggcagtgcgtgcacaaatacacaagagaatgcgggctgaccggttgagccggctgcatattcgcactcacacgcatgtgcaactgaacgcctgaaccagctgcagtaccagctatccatgagtttaaaaaaaaaactcagccacaaagctattagcatatttagtcatatttatatgttgggaacttgtgatacattggaaaaattaataataatcgacgttcaatattgatgtcatttttatgattcatatttcctcaacaacagatacggttactgtagattaaagtgaaaatcaaggcaagtacataggccatgttatcagcatcctatataatattattttaaaagaaaaaaaaataaataataaaaatatataaaaaggaatgtgcagtataaagaaatcaaaatataaaaatgcaatattttttcttattataccaatttattgctttggaaaagtcattgagaaataatccaaataagtacaatttgcgttaggttagatttggaaacatataacttggctttgtttttatcttatatttctagaaaagataaaacaattagtagcaagtgtaaacatcatgaacatattttccttctaattatatggttttaacagcttataggcaaaacttttgaatttataaaagtgagatgaaatattcataaaacacacttttctattcatctaatatacaaccttcatcaatttgttagcgtatattagtatgatgcagtgttttttcctcagtattccacaaaaaaaaatctaaaaacacactaaaagggtactttaaaggtatgatgctgatagaactttttaagtaccggattatttgctttaaaaattctcacgttctaaataacctctaattaagcagtatacaaatactccacacacacaaaattacgggctaacttaagcaagcatgccaataagcacgccgattttctagtaattaagtaataactgtgttgatcaactgagtaagtatcatcagacaggcgtcgtttaagtgctatatatctgcatttcagtgtagtacatcaattaaattgactccattaatctgttacaaaataacaagatggcttctcctactctgccgacgagtaagaattttctttttcttgagaaaagccgagtgagaatgtttgattgtcatttctacgctgtatttgtcgttttcagtagcaattcatttaagtaacccgtgtttctgtgacataacaagatggagaagggcaattcgctgatgctgcatacccggcgaagtggaaaccagatcaggatccgtccacgccatcgctggtcgttgctcatcatctaccgagtaagagcaactccaatagcctcttcaaaagactctccaagttaaattttgtcaattcttgaaaaaaaaagtactccaatagcctctctattcaacttgccaagccatttggctggccaaatccttcccctcagtagccaaatttggccagccaaactcactagccatctgtgggccccacctattccctattctctttctttgcatccgctcgctctctctccccctttgccgctgaaatccctaccaccgccgcttgccaaaaatcgatggcgagcagcggcggcggtagggagccaccgtcgaggtcatcgcgagccgccgccctcgccgtcgccctcctctagatccgtcgcgagccgttgccgccactgccgctgagctccgccccgagcatcgtcgaggtcgtcgtcgccccgggtcgtcgtcgaggttgtcgtcgccctgggtcgtcgtcgaggtcgtcgtcgccccgggtcgtcgtcgtcgcgagccgtcaccgccgccgccgccgagctccgccccgagcatcgtcgaggtcgtcgtcgccccgggttgtcgtcgccccgggtcgtcgtcgtcgcgagccgtcaccgccgccgccgccgagctccgccccgagcatcgtcgaggtcatcgtcgccccgggttgtcgtcgaggtcgtcgtcgcgagccgtcgccgccactgccgccgagctccgccccgagcatcgtcaaggtcgtcgtctccccaggtcgtcgtcaaggtcattgtcgcgagacgtcgccgccgagctccgccgccgcccccttgtagatctggcagctcgaggggaggtcgacattgtctcgcctcccgcctccccgcatcatcgagccaccacgcgcggccgccgtcggcatcagggaagggaatgggaagaaaagaaaggggaaagaaggaagggggagagaaaagaagaagaggagtagaggctgacgtgtgggtccattgttattttggagaggattaatagagagtctgttggagagagcatctagtttgactagctaaatcagatggagagttggctatatgggtgtttggagagttcgatttggagaagctattggagatgctctaagtattgcagggttgttctacctcgaatattatacatagtgggtttttaatcccatttactagtactagtaatttagtccaattatattcacccctaattctgttacatgatcgacaagatggcaatgctcccttcattgatgctgcttacccagtcaagtggagtccacgtgctgatgggcctcctaaacaaccagccaccttccctgcttctccaagtaagtactgttttatgctacatcaattggattggtattctctagtactagtagttaattaaaccataaacaaaattgaccctgtaattaattctgttattacataattcacaagatggtgagaaggccgaattcactgattctgcttactcggtaaaatggagtccacgtagtgttgcacctcctaaagcaccgggcatctttgctcaacattctagtaagtagtatatattatagtcgttttatgctatatgcatgtgctattttcattgactagcaatgcaatcaaattgatcccatcactctgttgtgttaacaagatggtaacaaggcccaattcactgatgctgcttacccagtcgactggaatccacgtagtgttgcgcctcctactccaccggctgccttgtcttctctggctcatccaggtaagaacatataggtagattttgtactcatttcagcgaacctttcatggaatatatatttgaattcatgcagctgcaggcatacatatccagcgcgggatgctcttcttaatgaagaagttgcatcctggcgccgtcttgccggaaggcacgaagctggcgctgccgcacggcgaccacggcgtggccgcggcggcgccaaggttcatctacaaggacaagggcgacgccgtgccgttcgacctccgcgccatggacgccatcctcgccatgttcggcatcctccctggatccgacaaggcggcgcaggtcgccgacaccctccgcgcctgcagcgagctgacggccgccggcggcggcggcgaggagccacgcgcctgctgcgccacctcccgcgaggcggtgctcgacttcgccgcctcggcgctgggcaccagcgcgccgcgcgcggtcaccacgctcgtgcacgggagggagccccgcaggtacgtggtagcggccgacggcgtcgcccggatcggcggcgacgccgtggtggcgtgccaccctatgccatatctatacgaggtgtactactgccaccggccagccgacgcggtggcgctgagggtcgacctccacgccgtcgccgacgtgggcctgggcggcgccactgccgtcgccgtgtgccacgtcaacaccaccacctgggacagtgcgtacttcgagctcctcaaggcaagccgtggcgacgccatctgccactacatgccgcagggctatgttctgtggctagccaattgagagtatttcctacaaacacctgatcgtagctactctacctttcatgattgatgcttgatgcatctctcgctgctatcttaataaaataaaactgatggtgtgctctcttctcgtcctcgactcctttttttctttttcttttttttttcgaagaacagtgaaggaagctattctaattactgttgcaatcccatgcctgttgctaacttctgaggaaggatgaagatgtcagagtcctaaaagaatcggcagactgaaattctaagttttcaggaaatttgaacccaaaaaagttgaaaatcgaatagatttttactaattgtcaacaaattagtaaaactgttacactgttcgttcatcacccgtggacgaccgtccgatctgcctatccaccaagctgttcatgtgcagatggactactcgaggagtagtgtggagatgacgaggacggcgccagagcctctcgctgcagctgatttggggatttccatgtcctttattactgtgggggatttacagattttcattggctctgctcgctgctaatttgggcagtacaaacgttgtgcagccttccaccgattttgagcatccagtatgccagatgcgttcttttttttccccttcaatttttcttccatcttgaaagctcattagcacccccaacaaattaaaatgctgcagatgtctgatgagattcttaaatggtgtcgtaccgagctaacaggtagtaactgagattcttgggctttagttccgcaccaaaattagaagtttgattaaaattgaaagtttgaataaaaaagttagaagttgatgtgagtaggaaagttttgatataatggaaaagttaaaagtttgatgaaaaagtttggaactaaataaagccttaagtgaataaagactacaaatagaaacaatttatttggaaaaactcaaatgtgaaatatgtctaacttttgtagatggagggagtaatttatagcacacgattgaaaatgcattttaacatgaatgactcgtaacggtttagaatttttctaatttatatttaataaaccatggcaaaataatatggtattttaaattttcatttatttagttgcattgcttgagaatgagtttgagtggtttggttggatgtctaagtacgaatgctgctgtcatttgtgggaattgggaagattgttctttggtgggggttcaacatcactctttggaacagaactaaaaccatgcataaccaggaggatatatagcagataatcacatatttttctttttattttctttgttgctctttcatgtcagatacaacatgtattcctgatgtttcttacacatttctcatcagggggatatgttctaagctcaaaaccggacatttctgtatagctaatatatagattatgtattttgaacactgctaaagtgttattagtaaacctacaaaattacaagattaattaaaatcgacttcaattattagatataatattaacaaaatagttaagaaaaaaaaataaaaactcaagaacaaagtttttagccatttaatttgttaatttaatgactccgaaactaagtttagtttggtcttacaattttatatggttatcttcttacttatattgtgcgttttaaaagcttttgagtttttttttgattgtctagccggcagttgtctagcaaatccctaaattaattaattaatccgagattgtacaattatgtcacatcctgatttttgttttatgatttataaattatttaataaattattattagaatttatgttaaatgttcattaatttacaagtgaagttaaatgtgagaaataaaatttcctaaatataaatcatggctgcatttaatttttattaaattctccataattaaatatacgctctgcaattttctcgaatttttcagagctcaattactaattttaataatacaaagagcagttcagcaatgattcgcatattaaattaatcattaaatggtcttcttataatttttttaaatacttatagtgttcaagtattttaataatttttcttggaattattagagcaccggaagtatttttaacaatttagagatcatttcagtgattaatttaattgggaaagtaataaaaaaacacccttttcctttccgggccgaaactagaaaagttcacttttagttctcggtccattctctcttcctttcggctggttctatcccttctccgaagtccatttcatgtccctccttcaatcgggctgagtaaaagaagcccagctgaaagtctgttttccttccctctgctacagtagtcgcccctaacctccagccggccggagacagagcccgatgccgccattgccgccgccttccccctccaactccggcctcctctctcgtgtatttccaaaattagttgaggcaaaatatcccccttatcctcctctatctcttcccccaaaaatccggttttatccctttgaattcgatgcgaatttggattcgttttcgagtttatctctccaaaccaaactctagaaaatcccggcttcgattctctcgttgtaggatcgatatctctctcccatggctataaatagagttccctccctctcctctttcggccgccacctctccctctctccgccgtcgcttgtagcgccgtcgccgcgttcgtcttctccgtccaccgccggcagccgctccagccgcccctagcagccgcctcagccgtcgacgacctacgccgtcgcctctctcggctccgcaaggtcaagctccaccccgtccaccccttccccgtagccgaaacccaccggagctccatcgtcgccgtcaacccgaagttcgccgtcgcgttttgatctccggcgaggccctactgctccttccgtcgtcgccaagctttgccgtcgccacccacagcgtcgcagccggggagaagcccgtccatccatccgttgccgctgctcgtcgccggaaaatcgtcgctgccgtggacccgaacctcgccgccctttggagtccgtcgccggccatctccttcactgttcgtcgtcgcataagtgttggtaagaatcgccgtcgccttctctttctcccggtgccctcgtttgcattattgtgccgtggttcgcctgcaactcaccgctcccatgccgttcaccgatttaggtttttttcctagggtattaatccaatctaatctaatccgctgtatgtctagcgtcatcgtcgtctccgtgtgttgccgccgggtagtcatcgccgtctctccctctccgatcgctttggtttggtgaggtttctatctgtgttccctcagtttaggttttaatctcttgtttgtgtcgttgagtagccgccgccgtgccgcgcttagctgttggcttagcattgccgctgcgctagccgcctagccgccgttgtaccgctccctgccacagctgtgtagctgctgctcgtgcgtgccaaaagtcgatgtcgtcccgctaccgcagcgaccgagccacttgctgctgcgttgtgtcgctgccgcgttgccgtagctcggtagccatcttgctaagtcattgttgagtcgttgctgctgccgcgccttgccaagtcgttgacgcagtcgtgccgctgctaaaccgtgtcactgtcgctgcttagtcgttgctccaaattgtgcaacgccgcctctatcccacgtcatcgtcatcgtggtttgtttgcttcccgtagtccgttagccgagttgcaaagccgtaggtgcatccctaggtttctaccggcctatcgtttgtcgtaccagggttttaccgtgaatcgtgtctagctcatcggtttagccgcaaccattgttgagtcgtttgctcgttcgttcgaacgaggtgttccccgtgcttcgttcgttcgtccatgttgagtcgtcctttagtttagagccgttcagagccgccggtttcggttaatcatttcggtgatcccgtgtcacgtagaattgactcgttgagtcggtatctcgtgaggccagcttgccagatcaatccaaaccatccgatcttggtcgactcggtcaagattaatctcagccatccaaagtcaatataaatcatgttatcccttttcaatggcatattagttctttttactatatatcatccactaaattagttccaataattttcggaggatgttttaatctttaatctcagtataaatcgtttgtaaattgtttaatcaatttggaatagtgttttctttaataggtttaattggaattaattttgtaaaattcataactaattcatatgaagtcggaatgaggccgttcaagtctctaaattcatctaaaatcatgatctacatgtttgtttactttttagtactgtttatttggtttttattagttttttctccgttataaatgttagcttgtcatttccgtcgttgtgaaggttcgtgagtgcgtcagaagtgttcaagaagactaattgaagaccgattattgcaaggcaagtcacacagatcctaaacacaatcatttgagcatgttgctcctatatttaaattctctatttatttcaactatgcatttatttttaaatgtcaccgggtggtgtgaacctattcatttgttatggccaatttgcattgattaccctattctttgataccttgggttataatttgactagttggactttatatattggttcgactatatattagaataattgcttagtcatgcttagaaacactagcatactattgggatgattaatgtttcactattacttaatgatggatactttatggtagctcacgatggttaatcgtgttgtgataaataattgataattaaaacttgataatggtgggttgtgagcacatggttttgaaggtcatgctcatgacaattaaggaccggttcgcaagctactgttgtgagacattaaccgtactaatcacaagccagaatgggcaacggctggacactttgtatagcaaggctcattgtggggcgctagactgtgaagcggcgagaagtccgtgggggtcgctggggagtccacgcctctggttgtagagggggtgattatgatccaggaaaggtgcgctgctttgagttgagctatgcgaggggtcttgtcacaactacacaaatggtggcatgttcagcatgggcacatggtgatatggtgacatattgtggagttatgtcttgtgggtaaatttgtacacctctggccagagtaaaactatttgaatagccatgcccgcggttatgggtgggttgagcaatgtttttcgtgattagtcccacactactcattaatgataataatgtgataattaatttgactcctggtttggaatggtaaattcctggtttagaggtttgatctgtacgaccggggttggttgttcaggtttggttgggcctgcagcatgggtgtgctattcagtgttgattaatattgatgattaattactctacttatttactactcctaaatgtttgctaaatgctgcttttgcaaatgagcctatattatgccatcctttggtatccgtgtgcacttgcatatttgctgtgtggcttgcggagtattccatgtactcaccttgcaataatcaatcaaatctcagttgaagaaaaatgatccagaaggagaagatgcttagcttataccccagttgagctgctgtgggagtggagccgaagctttgccagattttatttttatttttccgctgcagatttcttcgttgtgaggactaagtgcctcttcagtaagtatttatcgctttagttcttttgatgaatatgtatattaaattgtcagtttgtgtacctcggttgattcctggacaagaattttatgcgcaaattagttcggaaattactagtgaatttctgggcgtgacaaattatgggtctgtttagttcgcgaaaagaaaatttttgggtgtcacatcggatgcttgaccggatgtcggaaggggttttcggacacgaatgacaatactaatttcataactcgcctggaaaccgcgagacgaatcatttgagcctaattaatctgtcattagcacatatgggttactgtagcacttatggctaatatggactaattaggctcaaaagattcatctcgcgatttcccccctaactgtgcaattagttttattttaatctatatttagtgctccatgcatgtgtctaaatattcgatgtgatgttttttagaaaaaaaaattagggaactaattaactaaacaaggcctatatatagaacccaatgtgaatttgagtccttttctttcttgaaaccaaagtttgagaatcaatcgtgttaatgcaacagattaaagtaagagcacgagcgaggtggcaatgcaacagatcgatcgtagagatcactgctaactctaaacccctaagtcccaatcgatttcttcttttatttttgtgaggaaaagtcccagttcttttaactcgtctttcccttgttgtgtgtatttttctatttcttttcttttcttgaaagttgaaaccaactctatttctttctcccctgttttagttgatttccacatttcactctaccatggacgtccgactgagtttctttatatatactagcaaacatacctgtggttgcaacggatgaaaaaacctaatgataatatactttttcatacataaccatattgatgacaatcagaaaattagaaaattagaacatcttaaatgtaatggcccaacctcgatgatggcaaccttaccgatgtttggtttacctaaaataattggattattcatgtgacaacatgcatataatcttaaatattattttaatctcattcttacaaccaatcaaatcctacactgactcgcatggtcaagtctacacaaaatagagccactgtgcactcttttctaaataacaattacaatatgtttattttctaatattatttccatataatatgttatcaagaatagtagctatacttcacaaaaaatagtatgataattgactacagaggtgtgcagggtctccaatacaggagaatagatgatgaaacaaaagcctaggagatgaaaaaaaaatcgatgatcctaaccaaccaagcgtccatcaatttagcctttttttctgacaattttttcctcgtatgctttttattttgcttttttacagacgatggaaatatttttttctcgcgtgttttttttactacgaaaaccttttttctagcgtgttttcttttgtgcttttttctgatattttttcctcacgtgtttttttaaaccgtttttatctttccgcgcattttttagttagattagagatagagaagagatatatatggactactaaaacgacaaatataaatcctttctagatgttttctagattttttttattttttatggattttttttgtttttcgctttataggaaattgtactttttttcggttgtgggattggatctacgttcatatagatgttgatgaatctagacatatatattcattcttgtatccgaagggactaaccaaacttttatagagaaactaggaagatactccctccgaccagatgtgacacttcatagtacaacgaatctggacaggaagcatgtccggattcgttatactataaagtgtcctattcggtactagtttgttatattatgggacggagtagtaatttccatcacttcgcaccacttgtaccaaacatgctatactaggatttgaaagtcaaattctagtcttagtattaatcaatttcccatcaaaactttccatcctcttcatcgcaaaacatgctagacttaaaaatcaaattctaatcttactattaattaatttcctctcaaaactatcagtcctctccatcgccaaacatgccgaatgcagccacactactatttcccttctataaactcgcaatattctctaaacttgccaaataggcccacggctgtaaatttggatttcaatatatggcaggtacgattatatttcattaattgactaatcatacttttgtgtagctgtaggtgtcaaataaaaggggcattaattctccacataagaagggtacgaatacaatggtttccttctatatgattattacctctattggattagcctaaacaaatctgtactttgtactgtaataaaaaaatccccacacaaatacaggagtgcagtacatatgaaccccttctgctacgaaaccccgtggaagacggctggccttggcacggcgcatagcaggcagcagccggcgttgagaaggggagcggccgatcttctgatcgatttgttaggcttttaggcataacgaagaagctagcaggtaagtatatgcctgcagactttgtcatctctattttgattcttcacattggtccttttttttcttttcctttgtattcatccatgtatacccgattcgagaacgatcttaattttatttcatttttcaaaaaaaatagtccatattacttaactcaacttctaaattttactagcgctatacccttactttgcaaagggattagaaggaaaatttgcaaggcttgagtttcatccatctggttttactggtgggatgagttttggatggaaacacacgtgtttgtttttgttgaggtggtttctttacaacgaattactatgtacgaggaggaagatggcaacttacacttcttagagcaggtatatataataaggttgagtcagtaggctatacgttattccacattacgaaatcctatgtgggtgagggagaaaagaagaaagagaaaaagcggacgctagatctgtcaccgggcgatagtgtaagaaacgagcctctactgctcgctgcagctgatatgggtgatacctacgtatttggtgggcctccgacatatctccacgatctagtttgcatgtatttctgtttttctccctatctaacacgctagagcacaggcaacacacatagctacaaggatggtggttagttttgatcatgccaatttggttgtgcatgcatgaattaaatgtttgtttatttccatttagctagcgaaacagctagttcatcgcatgagcttctctcttgatggctatatcagacacggacaaatactatcgctggtagcttactacactaataaacctgctcttaattcacgaatccccgaattttaatattgttttttaccccttacaaactattttgagcctcgtgaaataccggaccagttctccaaatcaccgccggttgaataggagggcggctgcctgcgcaactcatgcccacccacccccacccctagaacgagagcaagtgaacattcgttgaagatatttagttagttgcctatgacatggaggaaaatagatggtaaggggaagaagggaaccgttactaacaagcggggattatgatattggtttcaagcgttacatatgtgaaatccgtaatccgcactaatttgaacttaactaacatttttattgttttgtttgaaataaactccaaatttactcaattttaaaataacctttaggcatgacattgataatgctacggtcgtacagcgtgtgaactgtgaagaaaaccggggttcagatttgcaaataagttctataacagcttttttttcataattgtgataggaattacttttaagtcgttaataaactcgccacccaaatctataacaaacaaatgtgttttataagattttgagaaattagaaaaaacccacgtaccgcaagcataggtaatttccgtctcctttggtcacgtgagtcgagcgagacggagatatttgataatttaacactccttaaaatttgggcaacggaaaaaagcgttaaattatcaaatttttcagtgagacgtggcttctttccaacttctgatcaccgagaaaaaccacgcagacacccggatggccgtggcggcgatctttacaaacgtcaattaaattaatttgggcaacggaaaaaagcgttaaattatcaaatttttcagtgagacgcggcttctttccaacttctgatcactgagaaaaaccacgcagacacccggatggccgtggcggcagcggcggcggcggcttgccccagccaccagcggcacgtccgtgctcctcttcggtcggctcggcaccgttgcgctagccccgctggtgggctcaagaccctcaccgccgcattcatttataggctctccgtgatcgccgccgccaccaccgcctctttgccggagggctcgagatcgccaacttctcttctcctccatctctcccaccgaatagccagtatctggttaatttacaaaaatttcgcacagatttcgatttgtggctgacaccatcctattccacatgcgtgctttttttttctttctttttgaggtatgcaaggagtaatgcgtaatatatattctcattttcagtctgttgcactaattttgctatttttattaagtctgtgcttcaatgctgagatgggcatggtgagatcggatacttttaaaaaaaaactcaattgctaaatttaaaagttcggtacatcctcttttttttttacttctaggaagtttagcacatattagattacatacatattacatatgctatttatgtaatctaggtctcgattttgtttacttggagatttgtgatatcatcttgaccatgtgtgacaatggaattctgtggtatcgtgcggattcatccggatgtttttcatgcaacatatggctttaacactcacagttatgtttgtttcctttaaattagctatactttctgtaatcctattaatgtccatgaacagacttaaattatcatttttacgttaacacttttatacttttctttctcataaataatcagttgtaacttgctaaagtttgttgttctatgttcaggagttattagtttatcatggatcagccactattggaccgtgcagcttcttcctcgtctaaggccacaggcagtagagcagctttcacagatgctggattctttagtgttatcactttttcttggatggggccgttacttgatcttggaaggaggaaagcactagatcttgatgatgtgccaactttggatgataatgacagtgttcaaggcatcctccctaactttgaggcgaagctcatctcagtttctggttcagggaagtacaccggtgttacaacaattaagctggtcaaagctcttgttcttacaacctggaaattaatcctcttcactgcagtttgtgccttactccgtactgtctcttcatatgttggtccatacctgattgagtactttgttgattacctgaatcgaagtccacggaccgctaaagaaggctacattttggtgttgagttttgttgttgcgcagttcatcaaaggcctctcatcaaggcatttgctcttcagatcgcaacaacttggtgtgcgggtgcgctcagctcttgtcgccatcatttaccaaaagggtctctccctctcaaatcagtccagggaaagcatttcaagtggagagatcatcaatgccgtgagcgttgatgcggtgcgtgtcgcgggtttcaattcgtccatgcatgagctttggttgtttcctgtgcaggttattctagcaatgctgatcctatactccactcttggtttggcagcatttgcagcccttgctgccactgttttgacaatgtt

SEQ ID NO: 40224 - DNA, 5455 bp, Oryza sativa
actaggttgttatatcatatgacggagggaatagtaatttccatcactttgcacccatttaccaaacatgctacactaggacttaaaagtcaaattctagtcttactattaattaatttcccatcaaaactttctatcctcttcatcacaaaacatgctagacttaaaaatcaaattctaatcttaccattaattaatttcccatcaaaactatcagcagccgcactactatttcccttatataaactcgcagtattctctaaacttgccaaacaggcccacggctgtaaatttggatttcaatatatggcaggtgcgattatatttcattaattaaggaatcatactcttgtgttgctgtaggtggcaaataaaaggggcattaattctccacataagaagggcacgaattagatggtttccttctatatatatgattattacctctattggattagcctaaacaaatctgtactagtactgtaataaaaaaaatccccacataaatacaggagtgcagtacatatgaaccccttctgctatgaaaccctgtggaagacggctggccttggcacagcgcatagcagccggcgttgagaaggggagcgaccgatcgtactgatcgatttgttaggcttttaggcataacgaagaagctagcaggtaagtatatgcctgcagacttgtcatctctattttgattcttcacattggtcctcttgttcttttccttgtattcatccatgtacacccgattcgagaatctgttttcatttttcaaaacaaatagtccatattactttactcaacttttaattaaattttactagcgctatacccttactttgccaagggattagaaggaaaaattacgagggttgagttttaaccatctggttttactggtgggatgagttttgggtggaaaacatgtgttttttttttgtcgaggtgcgtttctttacaacgaattacgatgtagtaggaggagggcgacttacactttttagagcaggtataataaggttgagtcagcaggctatacgttgttacacatcagcgaaatcctatgtggttgagggagaaaagaagaaagagaaaaaacggacgctagatctgttgccgggcgatagtgtgagaaacgaggctcttaccgctcgcttgtagctgatacgggtgatacctgacatatttggtgggcctgacatatctccactatccaatgtgcatgtatttatgtttttctccctatctaacacgctagagcacaggcaacacaaatagctacagggatggtggttagttttgatcatgccaattaatttggttgtgcatgcatgaattaaatgttttgtttatctccatttagctagcgaagcagctagctcatcgcgtgagctttctctcttgacggctatatcagacatggcgactgcctgcgcgactcacgcagccgctgccccccacccctagcacgagagcaagtgaacattagttgaagagatttagctgttgccactgagatggaggaaaatagatgataaggggaagaaagaaaccgttactaacatgcggggattatgataatgctataagcgttacatacgtgaaatccacactaatttgaacttaactaatatttttattgttttctttaaaataagaggattgctacagtccagcaggttgtaccgggcggtaaaacaaatctaaccgttgaatcgggatgggtaggatcgggagagaagatgagcgtcgggagagaaatttaaccggcgttcgagtcgtcgttcccggcggcggcggcggcgtcgaagtcgtcgttcccgacgggatagtccaggagacggcggtggttgatcctggcgatggcggagttgatgtccaggtggcggcggcgttgatggcatcgatccaggcggtggcgacccagatcgaagtcgcggtgtcagaggatgaagacggcggtggcagggcagaagcacggcagcggcgggggtgaggaagcacggcggcagcggggtggaagcacaacggtggcggggggtgtgaggcacggaagagggagacggcggcggggcggggcggcacggcccgatccatttgatctaggcttcccattgcgaagttacatttttgcccttccatctgagttttcaggtcggtattgtacaaggatagaattggtaccgagccgttggatctggccaggaatttggtaccacccggtaccggtaccgagcgctggacggtaaaaagactcttaaaataaactccaaatttactcaattttaaaataacctttaggcatgacattgataatgctacggttgtagagcatgtgaagaaaaccgatcttcagactgcaaataagtttctataagagctttttattgttcataattattataggatatttttttaaaaaaaatgttgataaactcgccacccaacatacggagtacaaacaagatgtgtttcataagattttgagaaaaccacataccgcacgtgtagcataggtaatttccgtctccctttatcacgtgagtgagtcgcgtcttctttccaactatcgatacgtcttctcaaaaaaaaaagaaaaaaaaagagggacatcactgagaaaaactacgccgacaccagaaaggctgtggcggcggcggctcatggctcctcttcggtcggtttggcaccgtcgcgctagcccctactggtaggctcgatacccttaccgcggcatttatgtgataggttctccgtgatcgccgccgacgccgacgccgacgctcgccggtgggctcgagatcgccaacttctcttctccctctctgccacggaatagccaagaatgaacagaatctgtccaactatagccagtctctgattaatttacagaaatttcgcatcgtttttgatttgtggctgacaccatcctattccccatgcgtgcagtattttgtttcatatatatatttttttctttttgaggataggcaaggagtaatgcctaacatatattctcattttcagtctgtttgcactaattttgctatttttatatttagtccatgcttcaatgctgagaatggtgagatcggatacttttttaaaaaaatctccattgctaaattaaaaagttcggtacatcttttttttttacttcgaggaagtttagcacatattaaattacatacgtattacatatgcaatttatgtaatctaggtctcgattttgttttcttggagatctgtgatgtcatctttaccatgggtgacaatggaactccgtggtatcgtgcggattcatccggatgtttttcatgcatgttacatatggctttagcactcacagttatgtttgtttcctttaaattagttattctttctgtaatcctattaacgtccatggacagactgaaattatctttttgactttaacacttttatatttttcttcgtcataaataatcagttgtaactttctaaagtttgttgttctatgatcaggagttcatggatcagccacttttggaccgtgcagcttcttcctcgtctaaggccacaagcagtagatcagctttcacagatgctggattctttagtattatcactttttcttggatggggccgttacttgatcttggaaggaggaaagcactagatcttgatgatgtgccaactttggatgataatgacagtgttcaaggcatcctccctaactttgaggcgaagctcgtctcagtttctggttcagggaagtacaccgatgttacaacaattaacttggtcaaagctcttgttcttacaacctggaaattaatcctcttcactgcagtttgtgccttactccgtactgtctcttcatatgttggtccatacctgattgagtactttgttgactacctgaatcgaagtccacagtccgctaaagaaggctacattttggtgttgagttttgttgttgcgcagttcatcgaaggcctctcatcaaggcatttgctcttcagatcgcaacaacttggtgtgcgggtacgctcagctcttgtcgccgtcatttaccaaaagggcctctccctctcaaatcagtccagagaaagcagttcaagtggagagatcatcaatgccgtgagccttgacgccgagcgtgtcgcggatttcaattggtccatacatgagctttggctgtttcctgtgcagattattctagcaatgctgatcctatactccactcttggtttggcagcatttgcagcccttgctgccactgttttgacaatgttagcaaatctacctatagggaggatccagcaaaattaccaagagaaaatgatggatgccaaggatgctagaatgagggctatgtctgagatgctgcggaacatgcgcattctcaagcttcaaggatgggaaatggtcttgtcgaagatcatggagttgaggaaggaggagatgcattggctaaagaaagatgtatacacctcagttatgcttatatctgtcttctttggagctcctgcttttgttgctatggtcacctttggaagttgtttgcttctaggcattccattagaaacagggaaagtattgtctgctctggcaacgtttaggcagctacaaggaccaatcaatagtatcccagacacagtctctgtgatcatccagacaaaagtatcacttgacaggatatgctcttttatgcacctcgaggaactatcgagcgatgttgtaactaaacttctaagaggtacaactgatgtatcgattgaggtgaggaacggtcagttctcttggaacacatcttctgaggttcctactctccgaaatttgaacttccgtattcgacaaggaatgagggttgctatctgtggaactgttggatctggaaaatcaagtttgttgtcatgcatactcggtgagataccgaggttatcaggagatgttcaaacatgtggtaggattgcctatgttagccaatcgccatggatacagagtgggacaattgaacataacatactttttggcacaaaactgcatagggaaaggtatgaaaaggtccttgaagcatgctgtcttaaaaaggacttggaaatattaccattaggtgatcagacaattataggagagagaggcattaacctaagtggcggacaaaagcaaaggatacaaattgcacgtgctttgtatcaagatgcagatatctttctgtttgatgatcccttcagtgctgttgatgctcatactgggttgcacttgttcaaggtatttttcagaacaaatctttaaatcctttttctatatgtgtgtaatcatcattgaatgcttaaactaataacttattgttggtacttgagacttctaatactacaaaatatatttttacatcatatgatttcaacgacattttctcccagtcaatttagggttttttttaaccttcagttgtcagtgctag

SEQ ID NO: 40225 - DNA, 5242 bp, Oryza sativa
agcatgctgtcttaaaaaggacttggaaatattaccattaggtgatcagacaattataggagagagaggcattaacctaagtggcggacaaaagcaaaggatacaaattgcacgtgctttgtatcaagatgcagatatctttctgtttgatgatcccttcagtgctgttgatgctcatactgggttgcacttgttcaaggtatttttcaaaacaaatctttaaatcctatttctatatgtgtgtaaatcatcactgaatgcttaaactaataacttattgttggtacttaagacttctaatactacaaaatatatatttacatcatatgatttcaacgccattttctcccagtcaatttagggggtttttttttaaccttcttcagttgtcagtgctagtgccgttatcaaatccttagacgaatagaacatgtttgttttgtttgatttttcatttcccaacttccaaaataagtaatagcagtttatctctttgcatagtttattgtgtggacagaaacctaatgtcttaatcagatcttttgtatgtttcagctaaacagtttttaggtagcctgttcttgaacaatatttagggttcaagagtatatctactgtatgaaagttattcatcacgaccttgtatttttcaggagtgcttgcttggactcttagcttcaaaaactgtagtgtatgttacccaccatgtcgaatttttgccatcagccaatgctatcatggtgagcttccaacaactatcaaatctacttatttattctactcgcaacaatcgttttaccatgtcaattcatttccctgttctaggtcatgaaagatggacaaattatacaagttgggaattacgctaaaatacttaattctggagaagagttcacaaaattagtattttcccataaggatgccatttctactctagaaagtttagaacactcaagtggcaatcccaaaagtagtcttattcctggtgacagtggaagtacgcttttcagataagcaaaaggatgataatcaaggagcagaagaagggattgttcaaaatggtcagttggtacaagaagaagagagggagaaagggcgggttgggatttccgtctattggaaatatattacaatggtatatggtggagcacttgtgccgcttattttgctcgctcagataatttttcaagttcttcaaattggaagcaatttttggatggcttgtgctgctccaatatccaaagatgtgaatcctccagtcaatagcttgaaaatggtacttgtatatgttgcgttagcttttgtgagctcgttattcattttcataagatcccatcttcttgtcatggctggatgtaagactgcaatgatgctatttgataagatgcatcgatgcatattccaggcttcaatgtctttctttgactccactcctagcggtcgaatcttgaacagagtaagtaatttaccttcaccatctttattttaatgagaaaattgaagttatctccttggaataccattagaatttttattcatattcaattaatcatgaaagttgaaacaaaattgtaggcttctagtgatcaaagcacagtggataccagcatttttgacctgatgggatatgttctatttcctgttatcgaacttcttggaacaattattttaatgtcacgggcagcatggccagtcttcgtaatttttgtcccaattattgcagcatctctgtggtatcaggtattctttttattatatattttatgttggatgccattttttggttccagtttataatttttaagtatgtggaaggaaaaatacattaattcatgacattattgacaatttttcacagattcaattgaaaattgaaaatcagtgtttttttcttttcacagatttaatttgaaatttaaaggcatggcaaagcaattaaatataatacataataaaaacatgaggtacatatatgatgtgattcttttcttggcaaaaatgttcccaataaaatttctaggttgatgctactgtatataggagaacttgtgcatttccgatgttcttctgaacaatcaaacttttagtcttaaaatatgctattaaccaataataattgtaatcatatttcaaaattataactatgtcctatggcattattggtttcaatacgactcatgttttgtttttatttttaatcaccataattccttcccttcagcaatattacatagatggtgctagggagttgcagaggttgactggagtttgcagagctccgctgatgcaacattttgctgaatcagtagctggatcaaatattattagatgctttggcaaggaaagacagtttatcaattatgtcagtcatttcatggataatttatctagaccaagtttatataattctgcttcaatggaatggttgtgctttcgcttggacattctttcatcctttatcttcgcatttgccttggtacttctggtcaccttgccagctgctctaattgacccaagtaagtacagtgggctttaatttgattggtccgatcaaattagttctttatgtgtattaccatccttgctaactattatttttatttttattgtattctcacagagacagctggtcttgcagtcacttatggattaagtctgaacatgttgcaagggtgggctattgcagtgctctgtagtttggaaaatagaatgatatccgttgaaagaatttttcaatacatgtttattccttctgaacaactccttacaatatcaaaaagtagaccaaactgccagtggccgacaaatggtgaaattgagcttcgcaacctccatgtttgtctcttgaactctatgttgttatataagttcacttctaacaatgtcggagctatgtcaattattgattagaactctcaacatttctattcataatattttctgagaaaaacagtgtgttattaaattaattttatatcgaagttattccacaaaaattggcatgcagattttttttctagtactgtagagttgcaatcctctttcataatatactattttgtacgacttccagcataccactgtggaaataccctcacaacactatatcttctttcttaacatggaaaacatacaacacctaatgcagaaatttctggtgaagtgttattttttcctctaagtgctttgtatgtgatgcaggtaaggtatgcaacacaattgccttttgttttgaaaggccttacttgcactttacccggagggttgaagaccggcatcgttggaagaactggcagtggcaagtcaaccttgattcaagcgctattccgtattgtcgagccatctattgggcaagtgttgatagacggccttgatatctgcaccattggactacacgacctacggacaagattgagtatcattccacaagatcctgtgatgtttgaggggaccctacgaaataacattgaccctttggaggagtacagcgatgaacaaatttgggaggtcttttaattttaatttactgacattttaattcttcaatgtgcacctgtcaaactaatgcataacttatatttgttgtgttatccaggcattgaactcttgtcatcttggcgatgaagttagaaagaatgagctcaagcttgactctgcaggttttatatctatatcagaaagctataatgcattgctccacagtgtcaaactcataagtcataactgatattttaatatgaaatatagttacagaaaatggcaacaactggagtgcaggtcagcgccagcttgtttgtttgggaagggtagttctaaagaagcgaaagatcttggttttggatgaagcaacttcttcagtggatccaataactgacaatttgattcagaaaaccctgaagcaacaatttttcgaatgcacagtgattacaatagcacataggatcgcatctgttcttgatagtgagaaggtcattcttctggacaatggttagtcatgtgctttgtgtttaattagtagccaacggttaatagcttggttctcccgttttaattccatgttgttgtaaacaggtaaaatcgcagaggatgactcgccagcaaaacttctggaagacaattcatcgttattttcgaaacttgtatcagaatacaccaagggatcagagtattaaactatgtagatgaaagaggggccaaatatatcaccgaaactaaatttttggcttaaatttaaatattctttcttggtaacttgttgcaacatgatcagttgtgtattcggaatgtgcaatggaacattcatatattattacatttgctcattggtttgcatttacgtgtgtactgactaagaaaattgcaatgctgacgcataggcgatgatgtgtttgcaaatgtgtttatctttcagaaagcactactccagaacttcaccatagacaaaaatgctactactaatatattcaccatcttattgtgttatttataacaattttttataaggcttctaaaaaaacgtacatgtgtcctttgctatcgaaatctcgaattgtgacgtgacaagtttttgaacgatcctaacaaggtgccaaatagacaaaagactgccgttaaaaataaatggaaaaagtatgaataaccccccaccccctatcccccgaactatcgcggtcgtccgaattaccccatgaaccataaaaacggacattcttcaccccccaactatgcaaaccggacgaattacccccctcgaaccaattcagagaggttttgtccaacgtggcgcacacgtggcaatccagttagcgtttttttaattaaaaaatgcaggacccgcctgccatactcttcttcctctctctctattctctctctctctcgctcttttctctctcgcggctcgcacaacacgcatggcgaggacagcgcagggacgagcggtcggcgaggacggcgcggacgtcgacacggagacggaggcgacggaggcggaggccgaccgggcgcacggggacacacagcgggcggcgggctcctcctccgcgcggtggaacaccgccgccaccgcgggctcctcctcctcctcgtcgtgggcgcgcggtggccggcggcgcgcggggactaggtggcagggcggcggggcagggcagtggacgaggcgagcgacggcgggagctcgcgctgctcaaggcgaggcgaggcggcggaggcggggtacggcagaggaggcgagcgtggcggc

SEQ ID NO: 40226 - DNA, 2242 bp, Oryza sativa
agctcccgccgccttttgcctcctccactgccttgccccatcactctgccccgccgctagcctccccgcgctcgctgcctccaccgccgcctcgcctcgccttgagcagcgcgagctcccgccgccgctcgcctcctccactgccctaccccgccgcttgcctccccgcgctcgctgcctccaccgctgcctcgccttgtcaccgccgcgctcgatgcctcctccgtcgccgaccgcccatgccgaccgcccgtccccgcgccgtcctcgccgaccgtcctcacgtgcgcgctgcgtgagcggcgagagagaaaagagcgagagagagtgagagaataaagagagaggggaaagaagagtatgacaggtgggtcctacaattttttattaaaaaaaggctgaccggattgccacatgtgcgccacgttggacaaaaccgctctgaattggttcgaggagggtaattcgtccggtttgcatagttgggggtgaagaatgtccggttttgtggttcatgggggtaattcggacaggcgcgatagttcggggggtaatttgtattttttccaaaataaattaactggggtaatgcactgttgtctcctttttaaagtcacttcaaatatgggcccacgttgactatggcttccaaagttcagtaattaagttctccggtttatgacccatcattccatcaatatatctcgcatatagcttgtcctaataatttctgttaggttagatctttcaaaaacaatcagtgtagcaaattgcataaatcatgtgcctgtttctgaagtagtaataaaatttagggattgaatggatagggtagagtcctcaagcgtatttttggtcagtttgaatatgatttgaatttttgtttcttttttttctaaatgaaatcctaacagcgaaatggaaataggaccaaacggtaacttcgttttacaaatgcggagtcaaataagcaaattaaaagaagtagggccaaattgatatttagactctaaaatagagtcaaataagtaattgtccctttcgataaccgcaaagcagaattgtactcaaacccactcaaatctgagtaatagtcccttctagctttgtttgtcaagatttgtgctgagatgggcttttgaaatattgagaactcataatttatcaaaaacgattgtaataggtcccgtgtgatttaataaagtctattttccctgcaaaagaaaaatcttgatgtagatcaaccagccataaattcgactaatcaggctaaaaaaataattcgacgtctataacaaaaacggttgaagaatacactcaaacttaaatccatcgaaatttgaatattaacagagagctaagcataaagaaataaggctcaagtccgattgacccccccccccctccaactataacgaaaatatgatttagcctcctcaactctaattccaaacaagtcacaccccgtaactaggggatgactagggatcggtcgcccgatacaaatctccaaaaagcgggcgctgacatcagcgccacccatatgtgcaaaaccactttaaactaatttttctttaaaattatttatccaaatcatgatccgattgcaccattaagtttgttgcaattaaatcttcaaaacaaaaccacccatggatatattccgacgaaaaaagtttagcttattattgatattttttaaatgttgcacgatgttccaccaggtatatcggaattatttcactaagtagatcgaaaatgtttcaatcgtttaaatcgggcgttgtttcgccttatataaaaacaggtttcagcaaatagcgaaagaatgtttcagttaactgcaacatttgatccatacatagtgaaacattatataaggcgaaacattttttgtggaacaaaaaatgaaacgaattcccgtaatagagagtttccaaaatatatgggtgatttgttgtaaaagaatatttcagttcactgcaacattggatctatacatagtgaaacattatgagtacactagatgaaatattttgggtggaacaaaaaaatgaaacgaattcccttaataaagggtttctaaaatatgtgggtgatttgttgcaaaagaatattttaattcactgcaacattagatctatacatagtgagacattataagtacactaggtgaaacatcttttgtgaaacaagtgtagggacaagtgggtgggtccagcggggcgcgcgcgtgggggag

SEQ ID NO: 40227 - DNA, 2845 bp, Oryza sativa
ccccctcccccagtcgaccgatcgagcattttcaccataactattcagtccggacacacaaccccctcattcccatttatagccagttttgttccagagttatctcacatgacactccgacggatgacatagcaaaaaattaaataattccctcctctcgtctctctttccctcaaattccccatcctctagagcccaaatccctaacactagggtgcaggaggcaccggacggcacgactgcttctttccggtgagcatggcgctgagcttccttccggtgagacggttcgcagaggatgaaaaaaaaatagccgacaggggctatagatttgtagccagctgcagcacgaactctagaacactatgtgtatatgatatatgggaccagttattaatgatatagtatatatttgtaattaactattagggcacccacaatggttatctatatactctctacaagaaatccatgtcagcatattttcctacttgaaaggtattaaatgaagagagagagcaaagctatctactaacttagagatagtctatagagaaaaacgaggcaatgcatgagagagctataaataccaatgtagacatactattaaggtggtttactattaatcgagtatattgctgagatgtacatgttttatagagagcacattactttaccattgcgggtgctcttatatgaatgactattaggttgactataaatgatttagagctgatagttggctatactattaaactaatctcttgaaccattttgggccaattacagagtgacatggcctctacatgcagtagctaactccatcgtgtgctcctcacgtgacaggctgggcccgtctcctcagtcctcattaggagattaatctctataattagcccaaaaccgccggtaaatgggaggaaggggggtttctctatccggatcgaatagtttttgaaacgtaaaatctattcggagaggcctctcatttttgcgttaaccggtgatacctgaatatggagaagacgtggagtttactacatcgtactacatgcatgcatttttttaatagacatgcatgtcatttttcctcttcaaacaaaattttctctcaaattacttatccgattctccaaccgattacccccataaggttggttccaattaattttccccaccaggttttacaatgataaaataagaaggaaaaaaatttaaatttggtaattacctttaataaaaacgtaaggtacctttatccaaaaatagaggtactttagaattaactaaattacttcttaaacatataaaagtaaactcaataaagtctaaaagtaatttacatatattatattataaaagtaacttaaaacaaaatgaaagtaactaaattcgttgtagggataaaaatatgacttctcgtacgatgaaaaaaggcattcattaaagttacttttttttataagttacttctataatatatgtaaattacttctagactttattgaatttacttttatatgtctaagaagtaatttagtgaaatctaaaagtaatttagatatatgataaaagtaatttataatttttcatgaaaatataatcatgtaagatcttgttataaagatttaattgttacgaatacaacagtgcaatcggatcatagatcggatgagtagtttaagagaaaattgtatttaaagtataagtggattgtgtccttcttagatagagtggtagttgatttagacaaatcagctaccactgtctgtctagtcacgtccttgaaactaaaccggcaggacaactatcaattatatttcaattaaacatgagtaaaaacccagacgggttacggaaaaataaaacaacctctcgctggagtaaaaacccagacgggttacagaaaaataaaacaacctctcgacaagtagagactcgccaagttcctccaccgcaactggtacaaccacacaacacacgaagcaccaaacaacactagccaaactaccaaagaaacaacggcggaatccaagagcgaacgtcgatgttgagatgctgaagaagtggcatacaagtttgatattacaaggcacgtgtcatcgttgccgagcttgccgcccagcgacctagcaactccgactccatggcgatcgcgacatcgttggaggcaccgcctaaacaagcaagacaacaccaagctcacactttggacatcggccaaagctatttatctagtattagagttgatgagggtattttttactttcatgatagttgaagggggtaaataagacttaaccctaaagagataaatgagggatgatggttcagagctatctgcattgcaagtcgattgccgaatcaaatttggagaaccgtacaggttgatcaagatgatcgtagtcgtagcgtgcaaatcatgcatccggaaactgaaattcttcactctctgtaatgaaatgaaatatttttcacttcatgaataagcatgacttagttgcacagaattgtacgagactgagatcatgttggagcattacaacaaaacgaaacggttgcaggtcgaataaaccgggcaacaaaataagcaggattacgggatttcgggtcaatatcagcatcacgcatatcccaaagttatagaacccccttaattaggcacacctcctaattaaagccaaatgccatcatagatacaggagttaattaaactgtcatcagctccattgctaactcatagattaaagggatactaccatctaatcacataaacaaccgttcacagaatagctctcgagaaccagagacagaaaacccagtagctcaactcgtcacgtcatat

SEQ ID NO: 40228 - DNA, 6160 bp, Oryza sativa
taaacaaatcaatattcacgtatcaaggctccaaattcagctgaaataaatgcaggcttagcatagaatcctctgtgcttgaccaaactgacaagtgtggtggcatatactccctccatttcaaaatgtatgacaccgttgactttttgcataacgtttgaccattcatcttattcaaaaaagttatataaatatcatttattttattgtaacttgttttatcatcaaataaaatgtaatcttaacttatacttttacatatttatgttaaatttttgaataagacgaatggtcaaacgttgtatgaaaagtcaacggcgtcacacattttgaaaatgaggtagtacataattaggatggtcatctagacaaacaaggtagctactcaaattcccatgtcagtactagcaggtagcttgaacagaatgcaactgttgttctttagtggagttgatgaggtcagtcaacaaaatcaggtcatctatacaagacaaggtagttccctccgtcccacaaaaaaccaacctagtattggacgagacattccctaatacaacaaatctggataagctcctgacagatttgttgtactaggaaatgtcacatccaataccatgtcagtactagcaggtggcttgtaaaaatgcaactgttcttttagtggcattattgggagcagttggagcagccaacaaaattcttcaagagaaaccctaaattcactagagcaatggacatcacacaataatttactttgaaaaatataaagcataacttcaaacattaagctatttatatcaacctaagctacaattaacaaacaaaactacaaagaacttgaaaataaactatgctgccttttgcagcacaagattcatatggacaaactaccagtaaacattgcatatatcagttgtggtaaaaaaaaagcattataactcagttctgcaaaggaaaaccatccccaaaaaatgactattcacggtgagtagagtatagtaggtacaaaacattacaatgacaacctagcaaagcaacaactgtgcgtttgaataaggtaaagctaactatttcaggagtagaatgcaagagatgctttattcatagtgttcccttgttcactactcctacctctcaatccttacaaagtgtaggtacagtttaatttacaaccaatcaagaatagtagaatccaacagatgatatattcaaatcactcccttatgttgctacgtatgacaaactcaccctctcaacacctacaaagtgtaagttagcttgatatacaaaccaatcaaatatttagatggtttgtacgtgtcaaatatggctaaatctttcattggctacactttccttaattgcacatgtttcacactaaactgaccacataagaacagggttgtttcaataattagttcagaagtcacactcaaattttagaagcaacaaaaacactttaaatgcatttagctataacagaactttaatatacaaatgggaacataataacgcaagtaagaagaatgtataccgcacaaaaaggatgtcagcaccgcaatgttttagtccagcaatcctaacaaagcattggctacttccttcttcgtgtctgctagacggagctgcattctcacttccgctatcttctgcttcttgatcttggattccagggtgcaagccttatcatcactaatgaactcaaaagctctcttgaaggttgatccacatggatgctgggcctcaattccgttcacaaaggaagcaaggttgggatacaaactctgcaattcagcatactccctccgtatgcttggtacattagcatctttatctactttttctttgtgattttcccctcctgttaggatgccaccattttgggtgccagcggtggcctcctttggcataacactgtgtgtgtcgccatccaatttcccattgtcagccttccccttcttactcccaaccaaagtaccatcatcgctagcggcagttgtggtggcctcctttggcatgacgatatgtgtgtccccatccaattcctctttgccagccttctccctcttactcccacccaaagttccatcatcatcatcagtggcaattgtggaggtcacctttgccgtgccactctttgcttcttcatccaatttgtctttgtggcttcccttcttcttacccttggttggactagcagcaagagcagcctccttagatgatccaacctttgtttccatacctgttttctgcttgttggttttccccttcttattctctgccagagtaccacccttttcattcacagcaatggcggcttcatccaccttatcttccttggcggcttcctttgaatctccactcaccttatctttcttagcttgccccttcttgttctttgacgaattgccagcatcctttgcgttctttccccagatttccgacgatagctgatacatccgcaggtcatcctctttagctggtaggtcgccgccgtgttcaactttcttggcagtggcctcgtaccgctgcttgagcctccgcaccttctcatacatgtccgaatacttgatgctcttcctctcgaggctatcgccgacagcagcgatgatcccctcaactttaagctgagtgccgtggctcttgaaatgggccacgaggacctcaagaatcttgacctcgtcatccgtcgtccatcgcgatagggccttcccagacttgcttgacggcgagggctccggcgccaaattgtacttgctcaccttgccggtagaaggagccggctcagcggcagccgctttcgcagcctcagccttggctgccttcttggacttgcccgaggagggagcgggctcaggcgccgccgccgacgacgacttctccggcttggccttcttggccttgcccgacggcgcgggctcaggcgcggccctcttcttcttggcctcggctttggccttcttcgccgactccttcttgacgggctccggctccggctccgactccgacgagtcgccttccacctcctccccttcctcgtcgccgccgccaaccttccgaagctggaaaccttgggcgtaggtgtcagtgtcggagtcctcctcctcctcctcctcctcatccgacgaggcggcgccgcggccgctgggcttctggggcggtggggcgacgggagactccctctcctcctcctcctcctcctcctcctcctcctcctcgccgcttgaatccgcggaggactcggcctcgggaggcggcggcggcgggggcgggggcgtcggcgcgcggcgcttgcgggccatgggtgatggatggctcgctcgctcgctcgccgctagggttttggggcggcggaggagaggaagcgggggagatgcgaatgcgaatgcgagcggcggggttctcggcgtgggctttgggcctttgtggcgggttgatttcaggagactgttgggtttcactgacgcgtggggccgggtgtagcgtacgctaacggttcgaattccatttttatttacttgttgtatttattttgggcatttcgtaaaggagaaagttctttcaaatgtcgcggtttgcccggaggagatcgaggtgaaaactgaaaaccgatcatggtaggttttaccaaaacagcgcgaaagccgatacaaaccatagaaccggtgacctttttttttgttaactatgtatgaaaactaactaaaatcaattggaattcacaaattgggtcagggtggtttcaagcaatggcggagctagaaaattttttaaaaccggataaatataactagtatttgttatagaaatttcatcaccaatttactcactaatataaaattttaatggagttttcgcctgcccagacgatgcctccgccattggtttcaagaaaaccaagcgattctaaaaaacaaatcggatctgtgaatcccaatcgagaattcggggcttggggtttgtgcaacttcaaagtaataacatcaagatcatctctcggtcttttatgatcggaaaatacgcttgagatcaagagaagcaatttaatgtggcggcaacaatatagagaaaggtaaagagaaaaaagttgtcacaagatgaattgaatgataggagatactcgtcccaaaatataagagattttaggtggatcacatccacctaaaatctcttatattataggatggagggagtatgaaataaaacaatattactgtagatcaaatttcttagtactacaaaatatatatatttcctttgtttttcaagcttgctagctttccatttattgaacccacgttattattccatggtcacgtgttttgcagttagtcctaataagatccattatcataaaaaaaaaggtagctgaaaatggagtgtgcggcatgtactagggcgatcgagaggatatgcagccggcacacggcacggcaaacaagcagcgcgtcagccagagcgtggtatgatggacgggcggtgtgccggtgtggcgaggcagccagcaaaaccaaaccaaccgcacacgatcgcacgagacgactcgcccagccaccgatcgatcgcccatcggtgccgcgactttttttgtttctttccacgaggcgagagctccatctgcgctcgtcacatgtgccattgtgccaatgtcacacgattccctttagctatctcttcgtgagcccatatatacgtgtacaatacaatacgaaaatcacatccaaatgtgcagcaaaattgtaaatgacaaaaaaagaagaagcatcgacgacagagctaactagctatatatatagcctggaataatgcatttgcattgtctaaatcggcacacagtattttatttttctttttcaagtgaaatcaccgtcacgtttggctgtcccactgttctcctcgtgcctttctattttgttttcttttataaacatgtatggctatgcagggttcacttattcacatttttagtgtacgttaataaggcgtgtaaagataaaaagaatatgtccgatctttgcaaggtgttcatataaaggtaagatgttcgtgtatatattatatggatgaatgtatacgagttgtgagcgcactttttttttcttaagaagagaggaatatgaattcctaactacctctcacaagtagaatgcatgacaatcaggggtagaaacatcatattgtgtgtgtggctgagtcaatagtaatcaaggcggacgaaaaacgattgaaaattaacgaaagtgttaaaaatgggaacgtggtgagctttaggtgctatttagtatctttcgatgctataaaaagaaaaaaaaagtgaacttttgatgatatataaccaattttgcaaaaaaaaacctatgatttgagacaattataaggaatttagaaggaattcaataccttcattctaaagcatcatataggaatttatttcgatagaaatgtaatcctccaaaattcttttattcgaaaggagccttaactttcataagaaaattagatccaaactaaaattcagtgttgtttctaagataatacatggtaaataaaactaccatagataatacacggtgaataaaaactaccgtaatatagtaagtagtttatatatccatagtactcactccgtcacagaatgtaagcatttttaaaatattgtcaagtcatttttttaactatgactattaatagaaaaaaaatattaaaaggtcaatcatataaaattgatgttactatatttatcattaaacaaactacaataatatgcaactatttttatttaaacatcttagttttatagatgttgttggtcaaataacattacttatgatataatctcttgatttccatgttactcatgcacctaataacgttagttcactagccacatcatctttttagttttatctcatttcgtaagcttcgtgtgagacggtagttgagaggtgcactactctactactactccatgagtagtaatatagaccgaaaatatgcgcccaagagcaagtgacacatatcagtgatctgtgagccgtggtttgtacgtgcacacagagcaggatttgtacccgtcgcgagaccacgcagcgtctcactgacgcactgcgcgctagctagcgcgcgcacacgcgcaagcgcaatgccgcgcggtgggcgc

SEQ ID NO: 40229 - DNA, 7143 bp, Oryza sativa
tcctgcagccccgtccctcattctcgccacccccaatcgccctataaatggccgcgccgccatcgctggtagtccagcacctcgtcgacttcttccagcttccatagctagctagctcggctcgccatgggccacgccgtcgctcgccgcctcatcctcctcctcgtcttcctcccctgcttcttgctgccgctctccggcgcgcacgccttcccggcctcggcgctggaggcggaggctgtggcggcgcgccaccaccggctccgcattgcgctcaacgcgacggcggtgcacgtggggaaggcgctcgaggccctgtcgggcgccgccgtcgcgccggcctccgctgtgatgacaacgccgttctcggcgggctcctcctcctcctcgcccctcgccgccgccgcgcgcgacgactgcgcggagctgctcgaggactccctcgacctccttgccggcgccggtgagcccagtgccgcccacgacgacgcggtcacgtggctctccgccgcgctcaccaaccacgacacctgcgccgacagcctcaatgaggccggcatcccccacggcgcggacgccgcgccccaccttgccgccgcccgcgccatggtccgcgactgcctcacaatgtacgcggaggccgcgtcggcggccatggcaaccagcaacaaggacggcctcgccggcgtccccgtccggaacggcggcgggaagagcaagaagcagaggaagagagggagaagaagaagaagaagcctcttcccgaggtggctgtcggcgagggaccggaggctgctgctggtccccgcggcgccattggtggagagcgcggacatggtggtggcgaaggacgggacggggacgcaccggacgatctcggacgcggtgaaggcggcgccggagcgcagcgggcggcggacggtgatacacgtgaaggccgggcggtacgacgagaacgtgaaggtggggaggaagaagacgaacctggtgttcgtcggcgacggcaagggcgtcactgtcgtgtccgccggccgcagcgtcgccgacaacttcaccacgttccacaccgccaccttcggtatgtcatttgtcgccacgatttactcactccattgtcatttcatcgaacattttttttttaaaaaagataatgttatggtgtcaagaagaaacaattttgatctatcacgttctctgaaactaaacttttcattgctaccattagtgcatttttcttttgtactgttttcatatcacataagtttagaaaagaacgctgttgctccctccattccataaggcacaaccacttttcttatatgttcgataatataaggcatatatgcaagcatacaattaactatgacatcttctccattaaattattactttttaaattctgtactctcatcttatctaatcctattagatgcatgcattatatttattaggatgattcaaactacaagatgataataactatttcttggtctttggattaagagtggttgtgccttatattttagaatggagggagtaataattaaaaacaattatattttataaaagtatatttttttcactttttacttttcaactgacattgcatcccctgtcttcaccatagatagacctatgctgattttgcacaagaaattaagtgttacaaatagggacgatttcctagtttgtctaaataaactaattttacttttgcgctcaacgcaagaaggtagtagtaaaaactagctagaggcaagttattaaattgcaattattttagtgatatgagcagtgacgggttgcaatgagcttacaggaaaacacaattaattcattgctaccgaagttaaatactacaacactatgccaacaacagaagaaacttcactaatcacaataatgatctactccagcctgttgtgaatgtctgatgatggaaccatccaatttattttgcggtcattagttctattaaattggtggattctttcttttatatatttttttgctgggcaattgatcgatcgttattcctgctgttacttctgcaatctcctaacgcttctactgttccgcaatgaagaccacttcgagtaggattagctcgtagtattaggcacgtactaatagctgctgtagatgactgggtataaaagctggtaaatttcctgaaaagaaacggtagaaatggactactcgacctgcattcttgctgtgtttgcgtcattgcggtaacatggcgtagtgtagtgggtgggggacttaatcacttaactgaaccagaaatcggatagcctgcaggcaggcagcggtatggcgcgacatggcacgtcgcgagcactgctgaaatttgacaagaatttgttgcaaattagtaatctcgtactagtataagaaagcagcttaattaatttgtgtgaaatttgtggcagcggcgtcggggagcgggttcatgatgagggacatgacggtggagaactgggcggggccggagaggcaccaggcggtggcgctgcgcgtgagcgccgaccgcgccgccgtctaccggtgcagcatcatcggctaccaggacaccctctacgcccactccaaccgccacttctaccgcgactgcgacgtctacggcaccgtcgacttcgtcttcggcaacgccgccgccgtcctccagcgctgcaacctctggtcccgctcccctctccccggccagaagaacaccgtcaccgcccagaaccgccgcgatcccggccaatccaccggcctcgtcatccacgcctgccgcgtcgtcccctcgccgccgccgccgtcgacggcgccggccgtggcggcgccattggcgccgacgtacctggggaggccgtggaagctgtactcgagggtggtggtgatgatgtcgtacatcggcgggcacgtgccgccggaggggtggctggcgtggaacgcgacgttcgcgctcgacacgctctactacggggagtacatgaactacggccccggggccggggtcgccgggcgcgtggcgtggccgggccaccgcgtcatcaacgacagcgccgaggcggagcggttcacggtggcgcgcttcatctccggcgcgtcgtggctgccggccaccggcgtctccttcctctccggcctctcgctgtagctagctcaaccatatgctgcatgcgcatatatatatatacctgttgcgttggcatgtgcacgcacgtacgtacttgggattatattgatttgttgtagtagattcgaaatgggatggagcgatttgatttgcattcagaatttggaatttcggtttcaccgcggcgaattttgcggttacatacatcgcatcgttctaggcttctagcggtgtttgttacgttttcactgtaaggtgtcggtgtcggtgccgagcgatttgaatgaatgtgggggctggctcactgtgagctcttgtgcagtttggtgatgagaattcgagtgggtcaagtgacagcccatcgatagactcttgcggcgtaactttttcttcaaatttttaattttttcatcgcatcaagacttttctacaaataaactttcaacttttttctttaaactttcaattttagtcaaactttcaattttaacgtgaaactaaacacaccctcgaagctagcatatcaaatgcgcatgtactttggtctgtgagaccgtgacaagcactgcaatgactaaacattgattagttacctatgcaattattaaaatatataaatattgaatttaataaaataatttgttgtagtagatgttgctaaatgtttttttataaactcaatcaaatatttaatatagtttacctagcttacttacaaacaacccagcgaaaattcggttgtatcaagggtattcatctaatatatggaccaaagagagacttcgttaattaggaaaaatgtcatgtgatttgtaataatataaaacagagagagtacacaacagtaggtgcaaaacccatctcattctccaaacaacataagatgggtgatatgactatttcaacatttaaatgaggatagcccctaaaacattttgatttttaaacagatggtttgcatatcaaaatgtttagaacacaactaaaaccacttggcatgaaaaaaaaggccgagttctaaacttcaactccgacctacaattcgatatataggtttcttgttatcaactccgacctacaatccgagactattttaattaggaaaaaaggacatgttttctaaactgctaagcagttttttttaaaaatggaaaagcttttttctaaaaaatatcaaataaatccattttttcaaaatttataattagttaatacttccatcaaggagtaataaagtcagccaaaagtcaaaaatccgcgtggaaattgactcgtcacaagctggaccagacgaccgcttccccttctccctctcagctgcgcttcgcgggaacgccatggaagacaaggggacgcagccaccggagccagccgcggccgcggcgatctcgtcggtgctcgccaacgacgacctcctccgcgagatcctgctccgcctcggcctccccaccaccctcgtccgcgccgccctcgtctccacccgctggctccgcctcgcctccgacccggccttcctccgccgcttccgcgcgcgccacccgccgcgcctcctcggcttctaccacacggccagggcgcgcttccaggacgaggtcccggcgttcgtgccgctgccccagccgccggagctcgccgccgcgctccgcggcgcccgcctccgcctggcgcccggctcctccggctccggccccgacgcgcccgtcatcctgagctgccgcaacggccgcgtcctcgccgcggagttccctcccgatgggccacgggtcagcatcatcagcccgatgcaccccgcccgccacccaccggctctcccgctggtctacgaactccctcgccagccggggcagattctgcatgcctcgtgtatgctcctcttcccagatgtcggcagcgacgatccgtcctacactttcgtggaatttctacgcaaagatcaggagatgttggccaaggcagtttctgtaagggctgaaatttcggatctgaacagtgtccgtgaatcggcaactatagagattcaggaaagctgggaaaggagcataaggcgtgatgtgcttgtcaatggcaatctctatctgttgggagggaaggggcatgttcttgggttgaatttggcatccatgaggctattcttgttcagattgccagatggtgtgcagcagctacaccggatgggaaacattgagctgctacgcgcaggcgattccggcttatatctcatccatctgaaggggtttcagattcatgtttggttccgcgcctccgattccgacatcggtggtggcaactgggagctggttgataacatctgcttgggcgaatcgtttggtcagtttgcagagcccaattgggaatcaggggatgctctggttgcgctccatagggtggaggacaatgctgaggtgttcttgcgggtagaccgtgtgatcttccacatacatatcatgaacaggacggtaaacaaagtgtttgagatgtcaccagaggcttatagatattttgacatatttccattcatgatgctctggcctcccaccttcccacaacttaggaatgatcatgatcaagatcagtgatcctcgaaggcgcatttgtctggtgccttgcaagtatggtcctgaatttgtcttgtagatctctcactgctagaatctgcttatgttatgtatctctgtcttttaagatgaggtcgaagattaatgtactatgcatcaagaatatatattacctgatgctatctttgtctgctattctgctctctttgtgttaacctgatcgactgactgtacttgggtggtttagcacacggcgcccaacatgtagtaaattctcaagaattttatagcataatttccacgttttcgatgaactggtaccttcctcataattcccggtgttgctgtctgcatattccttgtgcaataactctgtaacctttgttgtttaggcaattctgaatgtttggtatcatgttcagaaccaatggctttaagctaagaagtaagaaactattttgtagcaaagttttagcatgttgattgcacatgttcaatcgatgtttaaagagatttctgacaaagaaaagagatagatttaaagggactaaatgtatagcacgtttttgaaataatactacatatgtgtactttacaggcttacagcaggagaggcatttcatttgacctgctgatcttgtgcagaatctgtacatgcctcatgtagctttgcaattgtcaaaaggtagtggttattgcctgtaattatcatctgacttttgatcaatacggcgccgggagcaaaaccaggcagtgtcagcttgctggatcaggatcgacactgctggatcaggatcctctgcagtcgactgcaccgcgcctttatcagtgacatgtgggcccatagatcatcaggcccatatgtcagtgacaaatgcacggtacagtgactgctgagaatctcaatcctagcttgctaggggagggattataattacttgtgactgttgttaacataattggactgggagatatctcccatctcgtcttgcttaatctgaatacgcggttctcttttgtataggttaatttaaacctgtaaggataaggcgaatagtgttgaaaaagtactactactatttgatttaatttcataaagctgtttgtatgtttcaaatcttccaaatgaaattgtggctcaccatggttagttttataatgttagttgtataatactaaaaatcctacagcataatgttcgcgtttttaatgaactggtagctttctcctcgtacttcccattttgctgactgcatattcattgtgcttagggggtgtttagagcaagtttaataggatagccaactacaagctccaattcatctatagccaatttaatagtcaattcatacaatagtgcttattatactattaattcctggtcccacctatcatacacacattacgttttaaagtccgtgctgcagctggttatagatctgtagcccgttgctcttctct

SEQ ID NO: 40230 - DNA, 10582 bp, Oryza sativa
acccccttagatccatgagtgtaaagtttggcgtgccacatcggatatacggacacatatttgaagtattaaacgtagactaataacaaacaaattacatattccgtctgtaaactgcaagacgaatttattaattaagcctaattaatctgttattagcaaatgtttaatatagcaccacattgtcaaatcatggagcaattaggcttaaaagattcgtctcgcaatttacacgcaatctgtgtaattagttattttttttatatttaatactccatatatgtgtctaaatattcgatgtgacatggtgaaaaattttagcatggatctaaacaggcccttagaccggtgttcctaatgacttaatgacttaatgttagataccctgttcagaacaagatgacattttgtttcgacaacttgacacttgcctctttttttctccaggacgagtagtatatgtacatctagatttttttgttccgatgttaaagctagatgtttgaaacctttttatagcaaaggtttaactcgatattaaaagagacaaaagaataatgcatggcgtgttgtccaaataatcctacgcgtgtgtggtttacagcaggagagcgtgggcgcctcctaaccaaaattcagcccaactattgaaaaaaaaaacctgaattaaagttagtatttgtatataagatatgtttccttttctctgattaatatatgtggtttttttagttactcctttattaaggataaatagatttatatatttagagttggacatagttattaaaaaatatatgtagaattaaatggtagaagtgatgagcttgaatgttggagtattattggttggaaaaaaatgttcgtggaaaaattaatatataaattttgaaggttaaaaattgttatatttgatatggatagagtaatgaagttgtagaaatgacattaagtagaaaaatattgttaaaccagcttagcttagctcaacctgagctccttactccaatacctcctcgatcgcatgcaaatggaagacgaggcgacgcgtccctcctctccgccaccggcggcttctgcggcctcgtcggtgctcgccgacgacgacctcctccgcgagatcctcctccgcctcgccttccccaccacgctcgtccgcgccgccctcgtctcctcccgctggctcggcctcgcctccgactcgtccttcctccgccgcttccgcgcccgcaacccgccccgcctcctcggcttctaccacaccgcgcgccgggacgagcagccggcgttcgtgccgcttccccagcccccggagctcgcccccgtgctccgccgcctcggcgggttcgcgctcggcggcgccgacgtctccgccgtggtcttcgactgccgcaacggccgcctcctcagggcggagttcccgcccccgcccgacgagctacgcttcggcgtcgtctccccgctgctgccccccgcgcggaagccgcccgatctgcccccgaacctgcactcgcagctccatcaggtacccaacgatgcccgtgtgctgcgcccgggctggatgctgctcccggaggaggaggaggacgacggcggcgacgatctctcctacacgctggtggttctgatacgaagaggccgtggattgttcgcgagagcagtgttggtgagaggtgaatcagacgaccagatccgcacctccgattcaatcgagctgccgaatcactactggccaaacaagaagatgaaccgtggattgctcttccatgggagcctctacatgctgggcagggagcatgttcttgggttgaatctggcgtcgatgagcttgttcttgatcaagctcccggatggtgtggagcagctggagcatatggggaaccttgagttgttgcgggacggcgattccggattatatcttgctcatctgaaggggtttcagattcatgtttggcatcgtgcgacagacggcggtgggaatggtggtgattgggagatggttgataccatgtctctgcatcaatcgtttggtcaagttgcgaggcccgattgggagtcgggggatccttcacttggggatgctcttgtttcacttcgtagagtcgaggataatgccgagctgttcttgacgatagaccgcgtgatcttccacatacatattgcgagcaggacagcgaacaaggttttcgagatggctccaaaggaagatattggttttgaaatctttcccttcatgatgatatggcctcccactttcccggctttgaactatgacgatgacgatgatcagtaattcagtatgaatgatcccagaggatttttctctagtgctttatgcgatgtctaaccgattctcaattcagcatgtagttatcttgctgtaacaatctaattgttactggtcttttaggagagtcaggcatcttatgtgatgttcctttgttatgctttaaaataagatttaagtatgagttaacctgatctacttcaaaaatattcttctgcttaacaaattgaattcaagcaatatttcaggtttaaatttcaccttttttccaggtatgctacagaggaattttgagctggtaattttgatagcctgttttggagattatttgcaaagtactgcttctgagtttttagtccaaaaactggaaacctggaatgtgtgaataactgtcattgacaatttaggattgaattatgttgtgagctttttgtagtatcagactttattctgttcgtacttaatactccctccatttcataatgtaagactttctagcattatctacattcatatagatgttaatgaatctatacaaatatatgtgtttaggttcattaatatgtatatgtatgtggacaatgctagaaagtcttacattatgaaatggaggaggtacaacattatgtagcatttatattgaatctcaatatctgattttgtgcatacgaaacaggaacaaagaagaaatcatatccttgtgtgttgtaccatgtgctgcttgttctgaactaggaattttcggatttcagagcaactctgtcatagcttgagttctaacactttcttttttaaaaaaaaggaatatttgctcggcttagcaacatatccaaatgaaaaacagggatatggcagatcatataaacaattgtgatgttgttggaaaatttggacttgtacccaccaagcataagtctagctatggctcgatagacactagcaccaggtgggcctacccagcatgttttatctagttttgttccaacttaaaattgagttgaatttgggtttcaggtcatagttgaagcagctcatgcatataattgaaagtggtaagtcacagctacgaaaagaaactgctgaattgataatgcttcagattctaacatggcaacaattgttttgttttgagcatggaacatccagaacctataatccttcggttttcattttgattcggcaaggcaactcatgagaataggaacatcaaaattactaaacgactgatgcctggggctctctagttcctggctgctgaggtagttccgctcgggaaattgctgtacgtacgacaaacttgttacgattttgatacgatccagtcatgcatgatacttgattgggccatagaaacattgtatcgtacactaatcgtaagatatttatcgttctgctcgatcggaaggatatatggagcataagccatcaacatggttaaaatttccatcaacgggttgtttgcttcaaagaaaatatatcttcctttcttgcagttcatggttacagtaacaaatctccaagatcaatgcatcaccagagttatcatgccaactaggctctgcttacgatagaagtaactaaggtcctgtttgtttcagcttatgattattataatctagattattaagccagattactataaactggattataataagctgacatagaataagctgtgagttgtttatttgtttggattattggaggtatggattattgggtttgaaaagctaaagtctataatgccctcagctatctgttcggttgatggcataggtgggtaatttttctcaattatgtaggagtagtgggtctttagccactcaataatttgaaaaaagctcacctagagcagcttattagattataataatctagcttatagattataataatctgctataataatttacttgtttgtttcagagttaaatcaaatatacaagcagatattgattttagtaaaggatacccatatattcataatccattaattcatcgaccataccatttttaagtccattaccacaaaatggaagaaacaaacacacatgataaatcaatccagcagcaagccagcagtagacaagaacttaagacacaaagcaccaaaaaccaaacctcctcttcaaggatcactgaaatggcctccatccttgatctactccagcactgggaagattggaggccaaaccatggtcagtggatggatcactggcagaacacctcctctcttcggtgacgccttgaaaatcttcttcaccatcctcgtcctgatatccatgtacagcacatcgccatcaacgcacaagaacatgaactcgcagtcgtcgccgaccttgataaccccaaccggaccaccaatgtccatctccccgccaaccttcgcgaggtgatcgaaccctcgacgaacaccaatgtcgtccaccaacacccaattgcccgctgtcatgccgtcgccgtcatcgtcgtcgccaccgcgacgccagagacgagcttgaaacccattgacatggatgaggttgacgccggcgtcgtttgaccggaacaggtcgaggtctccgtcctcctcgtggcgcactccgtcggggaggttgatgaaggaggtggccatggatgccaggtcgagcacaagaatggcgtgggactgcatgcccaggacgtatagcttgccttggacaagcagggcacggttccaggtcgtgtcgccgcggcaccgcgccgggagctcgaccggcgccgtggcgcggacgtcgtcgtcccaggcgcccgcgcgcaggacggacaccttggcgaagaactcccaccacacgcgccagtccacgcgcttgctgcgcaccagcgtcaccacggtgtaggactggccgtcgcagccgtcctcggggaggaggatgcagacgtcggtggcccggccgagcagcgtgtcgtcgtcgcccatggcggatacgggcggcgggcgcgcggcgagcgggaccggcgggaggacggcgagcgaccgcgacgcgtgcagcagcgggctgaccaccgcgagcgtgccgtcgccgcggtcgaacgggtcggagaggtccatcaggacgcggccgttgcggcagtcgtacacgggcagcggctcgccgccgccgatggagccgagcatggcgcccttcgcggcgcggcgcgcggcggcggcgagcccgcggggatgggggagaggctcgaacagcgagccccggcgtgcttggcgaagaggccgaggacgcggggcgggtggagggcgcggtagcggcggaggaaggccggggcggaggcgacgcggagccagcgcctgcagacggcggcggcgcggacgaggtcggtggggaaggcgaggcgcaggatgatctcgcggaggaggtcgtcgtcgtcgagcaccaccgagacggcggcggcgggcatggcagggtgcgttccctgaccttccatcttcttgggtgtgtgagtgggtttggagaatcgggagggacggaatgcatagaaggggaatcaatggaagcatgtaagctagtgtactggttccttgttttcttttccggtttccattttttttctttatggaaagggttcgaaaaatattactatggtacgtaagactgtaagagtatctatatctatatctatatctatattaatataaaaagataagtcgcctccctccaatcctattggtgtaatcattcggatcgatctctaccgtccatccgcaaatccggtgtaatctggtccgtccatccgcagatctctaatctgtaccgtccacccatctcgaccgcacgattttagcctcacctcgcgcgaagacgtcgcgaagactacgcgtctatgcctcaccctctccacgcgcggctcactcctcccgtcatgtactgccgccgccgcctcaatccaccgctacccccgccggagctgacttcttctccagccgccgccggagccgaggtcgtccccttccgccgccgccgcggcgcactccaccgctgccctcgccggatccgaggtcttccccagccaccgccggagacgtggtcttcccatccgccgcggccagccgtggccggagttgacgtcgtcccgagtcgccgccggagccgagtcgtccccagccaccaccggaaccgtggtcttccccatccgccgcagccgcaagaatcgctcattcaccccacacccgcacccacggccacgctgtgctctcctccacaaccatgtcgagcccacatctgccgtcgttgacgctgtgagcacgctgagccctctgccgcaaccacgccgcacattagagatttaattgagttttatgtttcggatgctccagctttctaccagaagtccagaacacacatacatcagcatgaagatgagatgattcaggtcattgaattgctttgcattcatgctatcatattttgatgtgtcatttaatcatgttcttcatatatttgtttttccaagaagggcagcaggtgacagttgttgatgcggccgtgtttggtggtgttcacagttcttgaactgcaggagtaatcggtttgctaacacagacctgatctcaaggtgctatgcagcttccagtgaatgtattgtcttactatgatctgcacatccacccgggcaactctttgcttcccaaatttgattgcttgtgttgcatatttttgccgatgtagaaatcatatgtttttaatgttgtatgtcctgacggtttggcaacaaatatatccccagtatctttttgagaactatcctcaatatctcacggtattatttcatttgcactctaaatgaagaatttaaaagaattataaatgcaattttcaatctgatttacctttgtacatgattcaagattcagtgcagcagctgtagtcttcctccccatatcagaaagaatgaatcttaatggtgaggtataatcctaacgttatacattatgctttcatttgctcacaataaaacttaaataatgttcaatataagttcacatattgttctaaaagttttgttttgcagattggtaacattcactcatatatgttgtcagttagctcatgtcctattgatgcaaattttgttgttctcctctctctgcttggcctcggctcactgacaaacacctcctgtaccttgcccattcctctacaacttttaattgcaattgaaagatttggaacaacagaagaggaagagagatttgtaactatctacaatgccatttgaggtaggttatgtactgttaaaagtgttttatccattcagttaactgataggtagtctactattttgtgagttttaagtgtcaagtgaatgtgtactgtacgatgtaatggcttggtaattattagtaatcagaattaggggaaggtaaatctcttctttttatcatagagcagcacaaatatgtaatcaattattggatactttttaccttctgtatattttctgcatgtttgatatgtactccaccgatgaatggctagacttaacactcagagggaggacagaggaagaataatatactgatatatagctatgcaccgtttatcaacctttagtttaatgcctcaacaaaatgaattatcgggttgataactgaaacatttctaataggtgccacaggttacttgattagggataattgttccccattttctgataactgccaaagggtttttaatggcttaaatacttccagttgacggctgctggatgattttatcctcactggctgctttccaaatttttttaccgtgtgtttaaaagggagttattaagttgtgctatattacactacaatagatataattctcaaactacattttttgtgtcatgtattggggaaaacacgtcaaagtttaagtgtgtttatatgtttaatgttacataatgtggggaatgtgcattgcacgtgcacggttactagtgtacgtaacaagctataaaccagctataaacgtattttaaagagataaaagaagagagataagagcaacggactacagatctgtagctagttgcagcacggactccaagatgtaatgtgtgtttgacaggtgggactaggtattaatagtatagtaagcaactattatatgatttggctattacattggctatagatgatttgtagctagtagatagctatactattaaacttgctctaaaagcaagttcaataacacaactcagtactggctgcaataggtagccatgtcacctatagtaaataatagagcccatgcatacaatagaaatatcttgtttactctaataccaatattctattattttttgtagggcccatcatcttcttcccgaaactcctagttggcgattgatcgccaggagcgatcggtttcccccctctcctccacgtggttttcttttttggcaccacattacttttctattttagtaaatttatgaacctaaagtttatacacctcaagtttacacatatacagtttacaaatccaaagtttataaatcaaaagtttatatatccgattcaaatttgaatttgaattcaaatattttttatatatagtatttctatacatctaaagtttatacacccaaagtttataagtcaaaagtttatatatccgattcaaatttgaatttgaattatatccgattcaaatttgaatttgaatttaaatattttttatatatagtatttctatacatctaaagtttatacacctaaatttatagacccaaagtttataagtcaaaagtttacatacccgattcaaatttcaatttgaattatatccgattcaaatttgaatttgaatttaaatattttttacatatagtatttctatacatataaaatttatacatataaaatttatacatctaaagtttatagacccaaagtttataagtcaaaagtttatatacacgattcaaatttgaatttgaattcaaatattagtttataaacccaaagtttataagtcaaaagtttacatacccgtttcaaatttaaatttaaattcaaatattttttatatatagtatttctatacataattttttctaactttatttttttatttttttaaaatttatagtatagtaggaagagaagaaggggaggagaggagaggtgtgtacagggggcatggggatcgatcgcccattagccacaccctcttcttccatctcttctttttcttcctcctttcctttcctttactctgacgatgaaggcaactctcaagcggccagtgaagacgggacctaggagcacgccagagcggggagagtgggggtggtgtcagcggtggccatggcgattgcgagggtgagggcgacggtcgcgggggacgcatggagggcggcggcagccgcgacggataaagggggagagggtcacagccttgcggctacgggcgacgggcaagagcagtggccacacgggaagagagcgagggcgagggcggcggccgcagcggatggagggggagagggcgcgaccttacggctaccggcaacaggcaagagtggctgccacacgggacggggcgagggtgagtgcagcgacgcgaacgatggcaggagcgctagccgcggggaacacggacggtggcggtggccatggcagatgcagcgggtgacggcggcggcagccacaacggatccaacgggcgacgagccgatgatggtggtcatagggggatgcagcccagggtggaggcctgggtggtcgaggtggcgacctggcggacgctgtcagagcctcggaggcttggatggacgagggcgtcggactgacggacgtcggggcaaatgcaggagacgttgctgaccgtggtgtaggggtgaaaacggtacggaaacggacggaaaccactgttcacaacaatgatattttcacaacaatgatattttcggcctgacaccatggtattcactattaagtggtttaaaaaaaggaatccaggctatctcagtcacaaaatttccggaaattccgagaaaatttccggaaagtttccgaccgattccgagttccgacagaaactgcccttataattttcgattccgtttcggagaaaatattttcgaattcgtttctgtttccgaaaaaattccgaccgacagattccgtttttgaaaatagatctggaatctggaaagtttacgtaccgttttcacccctactcatggggcttcgtctgtgatggacgtggcatcgaatatgccgttcctctgggagactcgagagtaaaattcgaccactgttgctaaaggactcttgctacagtacca

SEQ ID NO: 40231 - DNA, 2038 bp, Oryza sativa
cattctacatgaaaaacaaaaatgtaaggaaagaaactatcgatgattaaatagatttatagacagttacttttgaaccatgcaaagttacttccaattaacattgaagttacttttaaaaattgttaaacttatgtgtgttgatctctgctgattaaatttaatttctagataaaatcatatttttattcctacaatgatttacttataatgtcgtgacaaaattacttctgttttgttttaagttacttttataatattgtcgacggtaggtacccgtagaccggatatagagggtattggggtacgctggtacgaggatctacgtagtacgacatcaaggaaacaagagacaacgattatactggttcaggccccttaataggtaatagccctaatccagttgatatgggattatatggagagaaccacaaattacaaagggaataatggaactagatgataccgacgagatcgtagtcgagttgattcgactagatcacccatcgacttggctcctgtaggctccggcttcgtaggctgtggtcgttgtgttggctatgagattcgatgccttaggtcttcctggggggtcccttttatatcgcaggtcaggtggtctccaagtaggactcggagacatcggaccctgcacgatatagtgacgacccagtcctatatgggtaggaacctttccattggtggacttcgtgatagatttccttagcgtatagagagaatgtccgtacacgcgcagatgtaccatattgccgtatagcgtacatccaagggtagagggtataccttatccgtaaccctgacagtagcccccgacttcagcttaaatgaactcatgtaaccgatcgcgacttctgatgtcggagttgctgtcgttctcgactggtcgatcttggtgtgaggaccgtagagacaaggagtggtcgacaatgaaagggccttgatgtcgcctagagggggggggtgtgaataggcgttcctaaaatttacttcaaaacacaacggttaaaatcagggcccggaacttcctggcaaaaggtccggaacttcctggcagctttttctcacaagcagagaaagctgcccggaacttccggggttcttcctaggaacttccgggcagttgttaattgctatttcaagcacctcacaacaagtaaattaaatcacaaggaagcctaaaccatagagaggtacaacatgtctcaaacaagagtaatacacatgaaaatacacaagatagcacaagtgatcatacaatgggagacatgatagcacaactaggcaaataaggagataagcatcacaatcacaaagataaagagagtgagaggagacaaacgatttgtttcccgaagttcggattctccaccgagaatcctacgtctccgttgaggagctctaaagagctgggtcttgattaatcccttgcctcaccaagaaaaggcctaggaagaggtctccggtcttcaagccaacacccctaggtacttctctttggtttcaagtgaccactaagatccccaacttgaacaccaaaagaacaccacaagtaaggcttgctctaccaagacgacctcctaaacctcacctaggattacactcaccgagtattccgtttccttttggaggtggaataacgccctcacaaacttgcccgggtcaatccacaaccttgttagaaactcgcgggcgacacctaaccgtctaggaggtcaccctccaagagtaacaagctccaaatgacagcccaacgagataccccaagtgctcaagtcaacctagccttcaaaaccttctccaatcctcaccaccaccctcaaaatcactctctcactcaagaaatacacaagatttaggtggaggaagcaaaatcacattgggagaggatagaacaagctagggaacacaagaactaaagtggaatggccaaagggtgaccttgggacgaaatccatatatataacggctaggtgacgtcatctagccattactcacaagtttgaactggaaacctacc

SEQ ID NO: 40232 - DNA, 6665 bp, Oryza sativa
agtatataagaactacacaagtcctatacacttgaagggaaaaaggtttaacatacctttggtgttccaaagaggctacaacaagatgaaactctatcaaaagcgttagtttcaaaatagcaaagcacaaatagcctcgaggtacacacaagaagatatacaagaaaatcatgtgcaccaacaccaaataaagcaattgaactcatcaaaattccaatagaaagagttgggatccaaagagacaccaatccaaagcaagctctttttggtcttgtgcatatgagccacaccaattgatagaataataccaatcaaaagagataggcctagtttgtagtcacaattggtaagaacccatatgcacatatagcaaatacattgattagataaactcacttaatttggagcaaggtacaaaagcatgattcaaaaaatattttctctttaacacatacttctcccaaaactcactaaaaggagggcaaaaagtatgtcaggcatataatgctatagacaagtcatgtatgcccgaaagaaaagtctcataagccaagacccaataaatagtgacgatgaagagacatatcaagacttatgtagcatcacaacataggatgaactccttctaaatatgtgcatacaaaagagtgaaaagaaatctttatgcactttcacaaaagaaatgaaggaacaaaagaatccatcctatattatgaaattaaggttgcaaagaaaatccatagaagcaataatgaagtctaccttgggagtcgtccacttccgacataagactaaaagtataaactcaatttaaaccattagtcttccaaggtatagaataaactccccctcaaggtgtgcatataaggataaatttaatgcatacatatgcactttactcaaatgagaattggggaggagtttacactatattttgggtcaggaggcaaatatcaccaaaagaaataaatttaaggactagaattgtaaagcacactttcataaacctcacatttcaagatgatggtgcttaaccaatctcatccttcttcacccattccttcggttgtcataaatcaatctccccttgatctatcattacctcttttctctatttgaatcaatagaaaagagaaagcataaaaagcacacgagtttcacatataatgatccttttgatgtggaggaaaattggatcacttattcatgaaacctcataatatagactaaattctcccaaaagtaatgcacacatatggtggaaggcaaatttatgtgcattatttgacatttaaatcaagcaagggaatttaatctatattatgaaaggtagctagataaaatatacgatgaaaaggtaattgaattaccacttgtgaatagcatacttttgagaatgtttcacttcccatgagactaaacataaaatacacttaacaagaagttagtctcaaaaatacaaaacataggacatgctccccctaaatatgtgcatgcaagcatttgaattacttgatggaaatggttatgagtgaatttaaattgaagtccaaaaaccgcctcgcgcaacggacccagaaatttccggcggccatctctctcctttccttgcaattcgcaccgttggtagtgtgcctatttaaaggagttttgggaatccattttggagtccagttgttgcaaaaactttctagcctctgaacgctcttcgtcttctacgcttccacgcaaaccctaattcgctcgcctcggtttcttctcccgcgatctccaacggcgatggacctcgacaagtccacttccaccggtgcgtctttgaagaagttgcaggaggagggcgctcttcccggtcgcgggaccatggagagggaaccgggaggtactgaacctgaacccgtcctgggccgcatggttgcggttgaggattatattctctgtggttttcttcctccgccttctgagttttccttctcatcttgaacttctacggtctttttctgctccatctgaaccccaactccatagccttccttagcattttttatcatctttgtgaggcctacattggggtagagccgtttcttgacctcttccgtttttactacgagttgcgctggatggaatctaaaaaggtatccgggtgtgttggtttttgacttcgggatggcctgaagtcgcgatacatccctttccagtgcccctcttctcgtagcaaatggcgggcgaggttgtcgaaacaagatttcggcaatactaaaagggggtggctatcaagctagaaaagtggatgggtttagagacaaggaatttatacaggttcaggccttcttaatcaagaagtaataccctactcctatccggggattgatccaccgagtgtattattgatcgtatgatctgggtgaaaattgtgtccttaaaggcatccggacctctccttatataggggaagggatccgtattacaaagcacagcccatattcctaacggaataggcagttatagataaaatacaatcgtaaccgactaggatctcgggtattttcttgacatacaagtttagaatttaacccgagtccttttaaaaatattctatctatacatgacaccccatacccagtcggactatacatgccgtgtaggtatggggtatccataatctccacagaggtggttctatcttcagatagaagattcggatccagtcttcattgttcctgaggagcaaccagacaagattccgtcttggaccgccaaacccgccttgaccccatctctctagtatttggatctccgagtacgagtacgagtacgaggattgtcggggtatgaagtcgctgcggacttcattggtagacggatccagccgctccaggctcgagcccatccagcctttgactactctgggccagaggacgcgacccgggtttctcctcgaggtatttttcttgtattctgggtttctctcctttcatgcgcattcctcctgacttatcgaaatttggttcttgatctacaggtttgaacagcgcaattgtggagcaccgtgtttcccaggtgatgatcagtggtcccacgacagcgagcaacgcccccacccctctttgcgagaaagaggcggctgagcgcgaagccgcaatcaacgtgagtgtaatcaatgaccctttaccttttaactcttagatcgcatcatgacttcatgttgtgcaggcactctccctgactgacatcattgggccgctcgcggaccaccaggcggcggcttcgttgaaggagggcgttgcccaggaggcgtccgacgcggccattgccgctgctgctgccacgaccagcggcagcaaagttccgaggaaagggaggaagttttcctccgtgctcggcaaccgccggaagacgcccaccccatcggtaagcctttttggttatcgattacgtagtcggaaaatgtcaccctcatatcgtactcggtttacttaggccttggatgcgtctcccccgcctccacgacggcataggctggtgacactcggcgagaagtaagtggacgaaatttgaggcccttgacttgatcggattctggcgttttgttatgatgaccaacatgatcgtctttcgtagggcggcgcgggcgagggcggcgcaagatgggtctgggggaaactccagcgcatctcctgcagtggcctcgaccgatgtcgtggtcgcgcccaggagccgcgaagtgacgcccagcggccctgccagcgatcttgtgcccggtcgaggcccgcctgctgccgtcctcacatgggaggagctccaagtcgagatggggtgcatcctcgaggctggtgctcgcggcataagtcgcgagatcgtggaggcgagggcagcggcggcgtcgtcggcgaacgagcgcgccgacaaactggcgcgcgacttggcggaggtttgtgaggacctctagaaaatgagggaactggtagccggcaacgagcggcaacggtaggggcttgagcactttatgtcagagctcgagaacaacctgtcggagatccgtggctcgctgcaggttacctacactggtctgcaccagctcaccggggagtgcggtgtcatgatgtaagttcaagtgccttaatttggttttggtgattaatgacaaatctaactatatgagactaatcatttttatgagcctttctttgactagtctcatttggatatgaaagtaaaaatgatgagaggtatgtattaaacttcacatattctaacttggtctctcttgtggatccaaaatatagtatgagcttcctatttgatctttattgattatgtgcatatgcgttccttcatatccatatgtatgcacatcttgagggggagcttattctatattttgtttattataagatttctatcttgatttgaaatcatttttcatctcatctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcctgataatgagatgtggaagatatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtatatgttttatgttggtctacatcattactacatatgccttctctatatgtataagataaacccccattggtcattctctaattatgcatacacttgtatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaagtacattgttatgttggcaagaatgaagtcaagcttgtgatgagaataaagtcttgacaaaggatggacaagacctcggcataaacatggttcaaccggatggtcacaagtgttgatctcggctcaagcttgaccctaagatggatggcgcaaggcaaaggtataatgtagctaagaatgttttcttagtcttttcccggtcttggtgtttggtgtagatcggatttgctagataggcgccgtactatcaagagggttctatgaagcgagcttgtggatgatcttgtgccatattagttcatatgcatgtaggtgcattttttgggcttgtctaaccaagtgtgattagttttctcaagtcctaaaccaagagagaagtggacatgtccaataggagtgagtgacatcttgtgggtatgtccggtggatatcctttggagtgtgagcccattatccttgacttaagttgtgtttcttggatggatttttcatgggttggatggccctttgaataagctttccatagagtccaagaacgccaaattccgagacccgagtcaagagatatcgtcgttttactaacggtcggttgagctgaaaagtgacctgcggtctgaccgtgggccttaggccggtctgaccgggtctgttagccggtctgaccggcgtggtaaggccggtctgaccggccccactagtctgttgcactggtctggtttttggtggcgatacagagccgccagagccgcaaccggtcagaccgagccgtggacggtctgaccggccactacactgcggtcagaccggccaggttgagtgggctcaatgattgccctgtaacggctagttttctagccgtagccgttacaaagtagtccggtctgaccagcctcacaacggcagtctgactggcagagcacaaagttggggatttcggttccaacggctagttttggtggttgggggtatatatacccactccccagcagcaagggtaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgcccggaagtacgaagatgtaccaagatctgaaggaaggatactggtggcccaacatgaagagagatgtggcggaatacgtagcactctgtgacgtgtgccaaaaggtgaaggctgagcatcagcgaccggcaggcttgctgcaaccccttaggattcccgagtggaaatgggatgagataagtatggattttattgttggattgcccaagaccgcaacaggatatgattccattt

SEQ ID NO: 40233 - DNA, 2103 bp, Oryza sativa
  unsure (1)..(2103): unsure at all n locations
ggaatacgtagcactctgtgacgtgtgccaaaaggtgaaggctgagcatcagcgaccggcaggcttgctgcaaccccttaggattcccgagtggaaatgggatgagataagtatggattttattgttggattgcccaagaccgcaacaggatatgattccatttnnnnnnnnnnnnnnnnnnnnnnnnngacggcaagattcatccccgtcaagacaaactatagcagtgctaaactcgccgagttgtacatgaccaggatagtgtgtcttcatggtatacctaagaggattatatccgatcgaggcacacagtttacctcgcatttctgggaaaagtacatgaagccctaggaagttatcttgcttttagcacagcttatcatccacagacagatggccagacggagagaaccaaccaggtcctggaggacatgctgagagcttgtgcgttggattttagcaaagactgggagaggtgtttgccctacgccgagttctcctacaacaacagctttcaagcaagcctgaagatgtcccccaatgaagcattgtttggtcgacgatgccggacgccgctgatgtggtctaagacaggtgaacgggcggtatttggacctgacattatcaatgaggccgaagaaaaggttcgcttgatccgtgaccgtttaaaggtagcacaatcacgacaaaagagttatgccgacacccgaagaagaaacctagaatttaaggaaggagattacgtttatttaaaggtttctccgatgaggggaacaaaaaggtttaagattaagggaaaactagcaccaagatatgtgggaccctttcaaatcacggctagaagaggagaagtcgcatatcagttacagctaccagagaatatcgctgatgtgcacccagtcttccatgtgtcccaattaaagaaatgcttacgagtgccagaagaacaagctccgctggaagagattcacattagcaatgatctcacgtatccagaacacccgatccggatattgggtaaagcagaaaagaggactaggagcaaagtgtggcgtatgtacaaggtacaatggagtaatcacactgaggatgaagccacctgggaaagcgaagaattcttgaggacggagtacccgcatctattcgaaaactggtaagaaatctcgggacgagatttatttaaggggggtaggtttgtaacaccctgaaaattcgaccgacaaaaaaaaaatctaaactctaaaaatatgggccttcaaaaactttttaaataaattgcatcatgccaattttattcgacgattttattggattttgatttcagaattcatcgatcagaaataggggaaaattaattaggaattaaccctgaaattagatttggttaaagaaataaataaattataatttaaaataaagattatgtaaggataggaataaataaaatatcatcgcggccatatttgtattaattagatttaaatgcaatggaacaagaattaaccctaattaaaaattcaaataaattataccaataaaatatgagtaatattaatctagggtgaattcattagttgagataacagaaacattgagtaaacttcatttatgcaagatttagaaattatagaatcaaatttatatgggaaataaactaaaatcgggataaataggaaaaagacactgttcattgcactctaggtgttcgacgaggttccctagccccttccccttccctgccatgcgcacctcgcgccccgagccatcgccatcaccgcctgccgccgtgccgctgtcgcctgccgcgccccgcgccgctcggccgtcgccgtcgcgcctcgcgcctcgtaccgccgcgcgccatcgccgtcgctgccgcgtcgccgtcgccgttgttgtcgcgtcattgcgccccgcgccgcgccgcccgctgtcacgtcgccgctgccgcccgtcgcgtcgtcttgcgccccgtgccgccgctgccgtgctgtcgccgtcgccgtcgcgtcccgcctcacgccgcgagccaccgctgtcgccgtcgccgtcccatgaccacgcgccgagccccgcgcgccgccccgagccccgtcgcccct

SEQ ID NO: 40234 - DNA, 19687 bp, Oryza sativa
ctccattttcctcttcctcccctctctccctccaccacgccgccgtcctcgtgccgtcgcgccaccgtccccgtgccgccgcgccgccgccctcgatgccgccgcgccgcaccgtgtgccgcgccgggtgtcgccgtcgccttgcgccaccgtcgtcgccaccgccgcgctgccgccgtcgtcgccgccgccgccgctggtgagccgtctttccccccccctcgcgtccaccaccgccgctgctcgggtggacaagagccgagagagagagaggaaaggagaggccggtagggaggaataagaaaagaaaagagaggaagagaaggaaaagaaagaaaggagccgggaggagagaaaagagagaaaaagagagaaaaagaaaagaaaagagagaaaagaggagagaaaaagaaaagaaaaaaaataaatagaaattagaggaagattagggaagtttagaaaatttaaaataattagaatttaattatggattaattatagtcgtagaattgcaaaatttaatataaattatggattattcttggcaatttctataagaaatcaattcgcggtaataatttagatgtagttaattactaaacaaatagatgaattcttatagattattatagattatttttgggtaatccctataagtaatcgattcacggtagaaattcggatttaattactagagattttagccgtgtgttacatttaatcattcagtcttagactaaattaaatcgtataatatttctagggtttcgtccgatatttagctcgcgatagaaattcctaacctattatatggatataatgctcgggtaaattaaattaaaaacttatgacaacaaaatatttatacccgcaaaatagtttaaatcgaaattgggtttgccgtagttcgcggatagtaaagttaataaaaaggaatcgactttcgcattcgactgtcatttggatttatttggattcttatttgaattctaaccgaattcaaatcaattttcgcacgtaactatagagcctgagggagttgcggatccaagcgaaggccaagacccgcaagactttgagcaaggcaagtcatcactattccttgaacatgttgatcccaattgcgaaattgttttgtttacaaataaaattgcatgcaatgatgaacatcctacttgtgattatgccatgccttgattattgattacccttagatctttgtaaccatgtttacgtatgagtccctagtcaactatgacaattgcttagaaatgctattctagaatcatgcatactcatatttatcaaatgctatatgtttgggcaattacctttgggaaggtaatggagatgcggcatgtggagacatgagcgccacattgccatgatgttgatgacatgatttgtgaaaggagaaataaaattacacaactgttttcgactggggcggacggaggatttgggtggtatctggaaaaggctagtaccgtccccggtcaattaaggaccgagccatgaagttaagcatgaaacgaccctcgtacaaccgcacttctcgtatgggtatagacctagcggagtagatagccgagcggaagcagtatccctgcatagatggttcacccctgagtgaggcaggtgcgctacggtgggacagccattgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgtggagtgcgggtaaagtgtacatccactgcagtgtgagtaaaccaaatctattcgaatagccgtgctcgcagttattgagcaccgggacatgtattgcacttggctagactctaaattcttaacctgtgtgggatgggatattgcatgatgatttttatgctgctggagccacttcctgagaggagggaaggtggacatcctcagaaaaccatgacgactcaatggcgggaagctatccttgaaatcacaatggatggtggacagaaccgtcgttgtttaatgtgaacactggtattaaaacttgatcagtctatgctaggtcttaggtttgtgaaaagaattacaaaactggcttagcgcaaaagagccatagccatcctttggaatacccctttcatatgcattgttgctgtggtggcttgctgagtacggttggtactcacccttgcaaatataaaattaatcagaagcgggagatgaagcttcggaggatccctatgcctactaccaggagggagatgaagacgatggcgctcagtaggtgttagtacggtcgttgcctgtggcaatggcatgccgctgcctgaattccgctgccttatctatttctgcttttggatgtattccggaccgctcggtccgatgatttaagacaatgcctgcgggcttctgatgtaataattagcactagactctcgtgtatgtacttttggtatttcagctatgaactcgtgtgtaccagactacttgatccagggaaatggtactgtttacacgaatgattcctgttataaaaacgggggtccacagagctggtatcagagccatacgactgtaggaaaagaccaaaaggcgctccaccccttttctaagttggccaagggagaaattcccatttagtaatactttcaaaaataaaaacgctatgtttacaaaactcggaacgattttcatcttactcttaactattttcttcacaaaacaagttttactcttagctgactttgggtttttcttaaagattagaaggcagatcaggattcacccgccacctgggagatgggcgtaccccgctcagagggatacgtcattgagctacaccggctgatgaggcgtctgcgataccccagatttccgatttaccgagtgagacagtgtggatctgtttaggaggctcgggtcgaggttcacacacgagtttcgtcagagttagactacagctttccgacacgccaccgtcgcgacttgccggagaccgcgatgcaggatgcagcccgggaggccttcctccgacttagctctatccaccgagctgagttggcgagtactgagtttgctcaccacccatttcgagaggagggcaactccgtctgcacagttcaggacacaccttgctgctacaacccgatagtgacccgactgtcacgatgggctgaggctgcggacgacttctacgaggaggccctattggagatcgacgatcagtagagacgtgtaggggagttagagactgaggtgaccgacctcacagcgcagcagcttcagttggaggaggagcaccaggcctggggcagtgagatagactcactgaaggcacagctccaggtccacggcgaccagttccagcagttatctgaccagtacaacgatcgccgcgggatgatggatactcttgaggagtagctaagagagagtcaggagcacgtcagccagctggaggagcagcttcgagcagccacgatcagcaccacaggggcttctacttccacagcagtagggcgtgaccgctacttcttcctcaccccgccgtacccaccaacgttccacgctcttctgggtgaggctagtatgctagctaccgagtcagcaccttacctagtggacccgacagtgacacagccacctgccccggagattgtgcgcactccactgatccctacaccttctccgcagttgggttccagtttggagactccgatccaggtcgactccgagacagaggggaccgacaccgagccagagatcgagccagacatcactgatcctttagaggatgagacccctgttccccgcatcaccttccttggaggtcctcgcaccctcagcactgctcgcaagagcacacgacctccgggcaagaggcccaagccagatccagaggccactacttctgagccgtggggactcaggtttgcgcgtgccagcgaccaccctctacctgccccaggatcctgcggatggctggaggactagattgacagactccttgcagcttcgatctcgtatcagatggtttttggatagcatgcgagacacacccccctcttacctagattgacgagtagattgatgattagtttgatgtatcttttgcatgaaccttatttggactgcgtatgtatgcagtcgattgcatcatgatttatgtaccatttgtgaaactctgtgatgttatttatgatatctattgttgttgtgttataaatgagtttattccaccatgcttgcaaaacaaagttcacaccaaaataacccccttaatgggatagaaccataagagctagttagaaaattaggatacttattccatcaacctacacagatggcaagccgacgtcgggcgtcaaccagcaatgaagaaactgagacacctgacctaaccaccctggccggagttatggtcacccaaacccaacttctgcaagccattgcaaataaccaaggcaaccgcggtggatcaagctttggagagtttgtgaggaccaagccacccacatttgccacagctgaagaacctatggatgctgaagattggttaaggatcattgagaagaagctaactcttgttcgagtacgtgaggccgataaagtgatctttgtggcaaaccaattggaaggaccagccggagactggtgggacacatacaaaggagcctgagaagaagatgctggagaaccaagctgggaggaatttaccacaggccggttaccattcagaaccgcgctcctgcaccgaatcaggccgccactggatcagtaaggccaggaagctgtttcaactgtggagagtacgggcatttcgccaacaaatgcccccatccaaacaagacacctatttgcaccggagctaatgcaacgactattcacggaactactacccctgctgctggacgaggtctattcaggactccatagactaacaggaccgctaccggatttggacgcggacaagtgaaccacgttcgagctgaagaggcccaggaggaccaaggcgtactgatgggtatgttttcactcaacttcactccagttaaagttctcttcgattcaggagcatcgcattcatttatatctctgaaagcaagtcaacaacacaatttaaccagagttaaactaaggcaaccaatgttagtacattcacctgggggtgaaatagccgtggacacagcttgcattgacgtacctattcgccttagggatgtggtgtttccctccaaccttatggttttgataccacaaactcttgatgtcattttgagaatggattggttagcaaagcatagaggagtaattgactgtagacgtagagaagttaccctgaccacaccctggggatcggatatgagagcaaccatggatcaagatcctaggctaaccgaacgtgcctaggatcgtacgctggaaggtatttcctgcggttatcagtccaaacggcattttaacgtagcagaatacaccgagcggcatgataaatgctgtcttctcctcatcctcttttaccatgctgatttggtggtagctagagtaagcgtcaaggaagcttaatagctcacaaccagctgttgagtccactagttggtctattcgagggaggaagtgatccttggggcacgccttgttgaggtcggtgaagtcgacgcacatcctccacttcccgttggccttccgcaccatgactaggttggctagccactctggatggagtatctctctgatgaaaccagcattgagaagcttgtcgagctcttctcgtatggcctgtttccgatctggtgcaaatctccgcagtttttgttttactggcttggcgttgggtcgcaccatgattttgtgctcaatcacctccctggggacccccggcatgtcggacggttgccaagaaaatacgtccgcattgtcgcggaggaaggtgatgagcgcgagttcctatttctcgttcagtgatgccccgatcttgactgtcttgtcggggttggcactggagagtggaacaattttgattgcgccatctggtttcggcgtcttagttgttttgctcactttcttgggtggctcggctgtggccggtgggctgggcgtgtgctcgaccatgtcgaggttccgcttgtcgcattggaccgccagctttgtgttcccttgaatagtgattgttcccttcggcccgggcatcttgagtacctgatacgcgtagtgagatgcggccatgaacttcgcgagtgcggttcttccgatgatggcattgtatgctgtgtcaaactcagcaacatcaaatgttatctgctctgttcggaagttgctcgcttggctgaaagtcacaggaagcgtgatcttgcccaatggtttggacgaagactggggagtgattccatgaaaaggttgatcggttggtgtcaactcgcttcgaggaatccccattgcgtccaaggtgctggcgaagagaaagttgatggaactgccgccatcgatgaggactcgcgctaccttgatattccgaatagtgggttcgaccacgatcggatatcgtcctgggataacagcagccttggggtggtcctcatctgagaactcgatcttctgttcagaccacttcatcttgggtgtaaccccttgccatgtcgaacaaacctcgcgctccacttttttgtattctcgctttgaagagtacgctgtggaacctccgaagatgtgcgagacatgaagatcgaaatctgggtacgccgagtccgagtcctgagtggttgcctctgcggccttctcgactacacgtgctcgtttgcccttctccaaagctagttgcttttctagcgactttttgaagatgaggcactcctccggagaatgtctgtctgacttgtgtatggggcatcatattctcttcgtatcactgccttgtgggtctgggtgtttgggagggtgctcgtattcagacgcgaggacttccgcttgagctttccttttcctactcttgccgcttttcttcttgcttggctcaggtgcgtccttggctggcttcttctctccccccgcctttggcttgtcgttcttgcgtctcagtgcgtcgtccacatgagcgcatcaatcgacgacctcgaacaaccttcgagtagttgtgattcgccttgttgccaactcctgggtagtgtagcgatctctgacaccggttttgaaagcgcgaatcacaaaggcgtcggtaatatcagggatcgtatttctgcactcattaaagagccgaacgtagtccctcaaagatttccccggattctgtgttaacgcgtgtaaatcgtcttcgatcgcatggcgcttgtaagttccttggaagttagcgacgaattgctgccacaaatttgcccatgaagaaatcgagtagggcgggaggtgcatcagccacgaacgcgcaaaacctttcaacgccattggcaaatagtttgctaacgcgttgtcgtctgctccagcagcgtatagtaccgtggagtagacctggaggaattcttttgggtcagtactcccatcgtacttctctattgcctcgggtcagaatttctcgggccaccggacatcacatagagaacggttgaaagctctacacccggcgctaggggcggtgggttgtcggcgatcgtgtgtcctccgtggatgtctatcggatgacgaggatgaagatgatgacgatgatgacgatggttcactcggctccggtgtgcgattccgagggcgacgttcaggttctcgagaattctatcgtcgtccaccattgttgtcctggcaccgatccccattataatcaccgtcatgttgacgtcctcgaccagcatcgtccggtgtccactgttcgcgatcgtcgcggtcgtggtggatgtgacgattatggtggtgttggtcttcgttcgagcggcctcctcgctcttcgttcttatgacgacgtgaagagacacaatgttgggaacgattctcgttatctcgcgcgcgttgtgcttctcggcggccattcagatggtcgcggagatcgccggtgccgcgaggtggaggggtagctcgtctaggcgacgtccgttgctccggtggttcgccgtcggcaccgccaaccgtcagatgttctggttgtgctctggtagcgacctcctcgaacgcgttactgagattggctactgattcccgtagtcgttctgtccatcatgggagatcatcgttaagtacggggtcatagggagcttctctcagtattgcgttgacggtgccgaggtgttgggccggcgtgaccgcttggttctccgcatctgcgttagcgtgcgcagacgtgctagtcccaccgatggtaaacacgtcgcgtcgtttactggaagatgacgagccatagtcttcgagcaagtgtaggactgatggctcgtggggatcgatgtcgattactccaacgaatcgatccgaggtcaacgtcgctccttgttccttgtctgcatccttaagagagattcctgactgctggaccttaggaagcgatgttttcatggcgcggagaaagaccttgcagcttgagaagtcatgattcttcgtcttgtgaataggacaatagacatcacgagttggagaagtacgctggattccacgctccttgcaagcatgaatttcagcttgtacgttgagaaaaacccagcaagcttgcaagttgtgcttcctggatttgtggataggacaccagggctttgttacctcgggagttgtccttgtcggctcacagttcttgtcggaaggacaaggtttggccgcactaggaaccttctcgggctcgtatgacgtcgatgttctgttctccgctacggcgggaggatccttcgacacgggatcgtccggggttatagccacggcgttctcgtttccggtcattgatggaccagccgagattggtaccgtggtgtaaaccgggaagacaattttgccgacttgagtccacaccagcattgttgaagtagggactccttggatggggccggtgttgacgccgttgtcgacgaagcttgatgtcatagtagtacaaccttgagcaccaagttcccctacctggcgcgccactgtcgacggcgggtacccgtagaccggatatagagggtattggggtacgctggtacgagcatctacgtagtacgacatcaaggaaacaagagacaacgattatactggttcaggccccttaataggtaatagccctaatccagttgatatgggattatatggagagaaccacaaattataaagggaataatggaactcgatgataccgacgagatcgtagtcgagttgattcgactagatcacccgacgacttggctcctgtaggctccggcttcgtaggctgtggtcgttgtgttggctatgagattcgatgccttaggtcttcccgggggtccctattatatcgcaggtcatgtggtctccaagtaggactcggagacatcgtaccctgcacgatatagtgacgacccagtcctatacgggtaggaacctttccattggtggacttcgtgatggatttccttagtgtatacagagaacgtccgtacacgcgcagatgtaccatattgtcgtatagcgtacatccaagggtagagggtataccttatccgtaactctgacaaatatatgtaaattacttttagactctattaaatttacttttatatgtctaagaagtaatttagtcaactctaaaagtaacttttatatatatatgtatatatatatatatatatatatatatatatatatatatatatatatgagataagagtaacttacatatataataaaagtaatttataaatataaatattttttcatcgtaatataatcacgtaagattttgttgtgaagatttaattgtaacgaacacaatggtgtaatcggattgtagatcggataagtaatttgagagaaaactttatttgaagaggaaagggacgtacatgtatattaaaaaaaatgcatgcatgtagtaccatgtagtagctggacttctccacgtttctccgtatttagacgtcactagttaaggcaaaatcaagaggcctctccaaatagattttacgaaagagaaagtgtaacaccctaaatattcagttaaagatcagtaaaatttccaacttttgcatcattctaggatcttgttgcttgagttatgtggaacttcaccttaaaacggaactataaataattaaataccaaaacctaccgaggaatgtaaatgaactaatttacaaatatcaaataaagcacagagaaatcaaacaccaatttttttctatataatccaattatgatgtaataaaagtccgggaatcaaataccaatttaattcgctaatcacaaggtcatacgttatacacaaacacaagcaatatattgacgaattataaaaggggagataattcaaatacaacaaatatagttcaattataatttaagaattcgatttcactctagtccaagcaaagggctaaaggaagatcaataaaaaaaatcaaattatttatacaactataatcagactacacattaacaaatccatattaaaccctaaatataagtctgattcccatacttgggcttaaaccatcacacgttaaaaggaactccaaatgggcctcaaggctcagctacttgagctcggcttgttgcaaactcgttttctgctgggctctcgactggaaatcgagccgaatgaaatccctcttcttcctacttgtaacgcttgcgagcttcaccgagccgagctcgaccaagctgggctaagttcgtgttgcggcttggcacatcccagccgtccgatcgagccacccctcccttacaaaaccccacccaggccactaggtttcgcctcttctacctcttctcccacctgcgccgccgccactcactcccaaaccctaaccccggaggagagggaggagcagccatggccgtgggcaagaacaagaggatctccaagggcaggaagggcagcaagaagaagacgtaagctgcttgcgcgcgggcggtgtgggcgccacacctctcgtcctctctgagctgcttgttcttgcttggggtttttgggggattctgatttgggacttcttctctttttctctctccgtgtgggtgcagcgtcgatcccttttccaagaaggattggtacgacatcaaggcgccgaccgtgttctccgtccgcaacatcggcaagaccctcgtctccaggacccaggggaccaaggttcgttcgttcgttccccattcgcgcccgtcaacctcaatccgcgatctgatccatgctttcattttgtatcactgtctgtgagtacatgtgcggaatctatctgtttggatctgcgtggctgcgtcattctatatctgagtaggctaagggattaatgttggcgttgatgtagttattgtgattgtgatgtcttgatgcatttttatgttttggctagaagtttgtttcgttaatgcaaatgtgggagttctggcaagatttcttctgtgctgtacttgttctactctcctagatttttatggctgatacatggaatgtttcatttcatttgatgaacactaatcatatatataagttcttgaggtgattgattcttgctgagatgtacttggagtaacctttttgctgcctttaatgtttgctgcctttaatgcgtcatacatcaaatgcttgatttcagtaacactatcatgtgttctcactaattagatattttagtctgatgtttaaatacccaagatatttctttgtgtaatcttcctaaggttatctgaattttttacagcactatgtctgttgctgattattattcatgaaattattttctagattgcatctgagggtctcaagcatcgtgtctttgaagtctccttggcggatcttcagaatgacgaggatcaggcttacaggaaggttagacttcgtgctgaggatgttcaggggaggaatgtcctcacgaatttctgggtaagaatgagcattgattgttcattaatccttttgtgttgtatctgtgatcccttttgtcctatgtagtctaaaccaatacatattttctctagggcatgagttttaccacggacaaacttaggtccttggtcaagaaatggcaaacattgattgaagcccatgtggatgttaagaccacagataactacatgctccgcctgttttgcattggtttcaccaagcgccgcccaaatcaggtgaagcgtacctgttacgctcaggctagccagatccggcaggtaaaagttttgtcatacttttttgcatgttctgtactaggtaagttcttgttttttgagatgaggtatgttcttgttgtttactttatttttgtccactgtttgaagatccgccggaagatggttgagatcatggccaaccaggcatcaacatgtgacttgaaagaactggtttcaaaattcatccctgaagtcattggaaaggagatcgagaagtcaacttcaagtatattccctctccaaaatgtgttcatccgcaaggtgaagatcttgaaggcaccgaagtttgatcttgggaagttgatggaggtgaggaaccttattctcatgcctagctagatgcctttagtgctcctggttattcttctgagaaatgtattagcatggttattggctttggaatcttattagaaaatctatctagtatatttgctatgtgttggaatcaactatgtttactaactcccctgctataacctggctgccctaaaatacttagttcaggattttgctttgacttgaatactaacttttagtgtaagatgttgcaataccgagttttaacaatatattttagggtttatgacattatgcatttagataatttttcctgataaaaaattcctaggcaattttgtgctcttaggcagccaatattagctcaaatcttatattagggcttgccttctgtaaatagtgctgtactgtagtgttgatttggaagcaagacttactcaagtattaggggggctaaatgacctggccggagttcttttttttactgtcacagaatgtagcaagtaaatttaaacatgatatggcgtccaagtacaaaacatgtttgttaacagcctcaaataacgttgaaggcagccaacacaaattggcctcagtatgctgcctcttgatgtcctcagtagtgccagatgttttttttccactcctagttcctgtgtgtacgtaactttactagccaaacacctgtgcttttctgtggattaaatctaattaatagtgaggtttttgggacaatttcattcctgtagatgttgttacagatgaaatatgataaaatcatggatagtttggatagttggtacaaaacatgatggagtaggtgggaaataaaaataatactgtacttggtggcaccattgcccttgtttaaaaggagtatagattctgagaaaatgtggtctttattggttttacaggtacacggtgactacaaggaagatgtcggtatgaagctggacaggcctgctgagactgacgaggcggtggcaggggaggttgcagcagctgagtagagatggtgttgctagttgctttaccttttaggagatttgggctgttactaaattatggatgatcaaaacttaatgtcagttccgatacccttttttgtctgccgagttggtttctctgattaaaaccatggaaaattgtgagactgatttcatggccagctcattttgaatgcagttgaatgattagtactatatgatagtataatactactggttagatcattgctatgcatttgatcatgatctgctcagcttgcgcattggcaatggtatacacctggtgaattacattctggaatgcggtggtttggaccatttttttgggcccgttggaaagctgggattcggatgggctgaaattaagatggtgcaataatctcggtaccgcgagatggactggcctgttgagttactgttcaagccaaccgtgagggtgacggcgtggatagctttcggtcgctcgttcgtgcattgctttctccacctgttcttgcggagtccctcatctttctcctccgaacactaaagcaaccgttggtcacggaggcgaatcgagatctgcatcggctcctgcttgtcctgagcggcgtgcaagcggtagaccatgcgctcgacgtcgatggctcattgggcaggagggttgccaggcacatacactccatcaaaaaaaaaaaaaaaactcaacctataacagaatgtgacccctcctagaataatgaacaatccccttctaggttaaatttttttagacggagggagtaggggagaagcacttagatcgaatattagcgcattggaggtggagaaaaaacgagaggcacagtcgcagcaagcatcggcgcggcgtcgattccaccgacagtgcatcagcctctccagcgcgcgtctgctgctctggtgagttctcgtgccgaatagggccggagattcacgtcccatccggcatccaaggaggcgccattgccaaaattggtggagagggggacttgaactcatagctatattaagccatcttgtggatccggccatggcatccaaaggcgtgaaacggaagcttcatctctagcactccaccaccgagcccttgatatcctctccacagttgccatttacttcggcaaaacggcgagaggtggctttagatctgaaatcctctcagggttcatccaagtctctgcaatccgacgccagctacactgccacagctgaagacgacatccaggccgtagcgcgagcactcatcatcatcgctgcaaagttccatgaagctatcttgcagctggtccgccgcctcactccggccagagttgcatcttcactcgattgggacttgctcgactcgtagcaccaagggcagtagtaatgcaaactacccatttgaagaacctaaaactgccacatagactaaagatactgtgtccaaattttggttccccacagtgcaaatggcctcatgggtgacttcgatttttcgttttagctcctaccacttttgattttagccctcatatttttctcaatttagaaagaagtacaaattttacaatgaacaccttacagtggaggaaataatacaaatctcaaccccacccaggcacccaccaccactgcacaatcctctccattttctccacccaccaaccttggcgagtttaccagcgatgccgctgcctccgtcctctcctcacctcggcgacgaactctgccgctggcggcctctccccactccccccacctcggcgacaaactccgccaccgcgggcctctctcctatccctatcggggcctctccactcccggacgccgctcaagcccactcgcacggggacgcggcggtggttgaggaagccgaggcggtggtggacccaccggcgaatcgacgacgacgaggtcggtggagccaagcagagggatgacgtataggggaataatcgggaaaattgagagtagtagcacgcgacatgggagaggggaccactcacagtttctttttgggcctgaggaaaccggatccttggtaggagatgcaaacctttgcaaagatacgggtcccaccaggccaccacctttttttttatccacgtcagagtttggcctagatggaaaacgataactcgccacgtaggtgcactgtaaaggccctaagaaaggtaaagcacaagttctagcttttattttcaacctacttgcttgcttgacttgggttgttagatggctggcggtcacacccattggacgtaggcggagctgaaagcattcctggatagctgcatggaagaaattgagggctgcatcatcacctccagctgccccaaagctcaaggatacatgaatctgcagaacaagatgtacgagaagggtcatgaacaagcagtagctgaagaacttatgggaccactgtcgccaccgtttccaaacatggacctagctggaatgaatggccaccgatctggggcaagatccctacactggctccatccaagtaaactctgaatggtgggagcagatggaagggttatgtatagtttaactttgcaatttttccattttgcgcatgccatgcaatttttcctaaagttcatgacactagagattacatgtagcaaatttgaaaacatagatgcttcacacaccaccatcagtggatcaatagagccatatagagtaggagctttaacaaacataggcctccagatgaatgacattacagaccagatgtagcatagttcaaaacataggcctctacatgcatgattcatacataggtctatagatgtatgatttactgtcatacatatatttggaatgttaatcctaaagtatttcgaatgacagattacttgttccatgcctagcgatatgtcaaactatatttatgattaattatgccatgttatcagcaatatgttcatatgttcattgtcatgcgtgtagtcttactgaatttaaaacaacctagtatgatatgttcatgccatgtgtacaccatatttgataattaaatttcaatatctttagaatacttctatatataccaagataattatgagctcaaagtatagattacaaaatttgacatttgtatctgaaaattacattgaaacttgtagcagaatttcatgcatatataggtttatagatatactctagatgccagtgtatcaaaactttatacataggtgtatagatgtatgattaactatcatacatatatttggaatgttgatcccaaagtacatgacattacagaccacttgttctatgcctagatatgtcaaactacatttatgattaattatgccatgttattaacaatatattatgttcatgccatgtgtacaccatatttgtcacaagtgtagtccttaatttaaaacagcctaatatgatctgttcatgccatgtgtacaccacatttgataattaaatatgtgtgttcttttaaatgcttgtgtatataccaagataattttgagctgaatgtatacatcacaaacctagacatttgtttctgaaaaacacaatgaaacttgtaagtgtgtagttcactcaaaaaaacacagaaaaatatgaacttttcatgccatgtgtagttcacaactgatattacatctgcagattgtgtgcaatgtttttgtacatagaatgataagtatgagctcaatgtatggattacaaaaaatgatatttttttctgcaaattaaattgaatgttgaatgttttctgatctgtctagggtactgaattaaagtttacatgttctgatctctctactatgatcttttcatgccatgtgtagatgacaagagcacatttaatttgaacatgtctgcaatgtttctgtatttatcatgataacaatgagcagcatgcataggttgcaaaataatccaaggcgatcagccatgacatgttgtaattaaaatctgacctgttagtgccatgtgttgaggattactgataattgaacttgcacatgtttgaattattctgtattaagcaagagatttaggagctgaagttattgtttgcaaagttggcatgtgttacatatctaaaacaatatttccagcaacaacgtgatcaaaccacataactgaattgtgtgttgtatttgcagcaaaactttaatttatcttagatgtaatgacaacaataaataaaacttatcttttaagtaccaacttgctgcatctacaatttatgaacgcatatttgtgcacttattttaactactcagttgtattgtggtagaaggtgatatgcttccgttttttttttcttaacttcaacacatggttgctgccatgtgtacactaactgcactacatgtattttcacttgctactgttatatactttgttataacaaatgtgtgcctatgtgtatttgattccagattctactgttttgaacatgcttacatgtttacatgtgctgccatttctatatcctgccatctgtacatgcatacaagtggttattttctgattaaaccaactatgtgctgtaatttgtgtagcttagaagaggagcgcgtgtattcagaaatgcaccgctcagattcaacgctgagcatcatgttgtttacagaggaagaactgtgctgctaaaccgctccggtgtgcctaggtccaagccggcacagtcacaggtgtcctaggaggctaagatcctcgatgttgaggacctcatgcagatggcactacttatgcatctccagagccttcttcaatgaggaggcgcggtaaaggaaaaaaggatcgtaacccctgtcagtgtctctagtggcagcggcaagcatatttgcggtgactccactggagatgctctgaataggttggctgacctaagggtgcagtccaatgagagcaaagaaagaagggaggaacagaggcaagccaaaagtgctagagcttgcatggagctactgaaggctgatggcatcaccaagaaggttcctctgtaccacatggcactgaagctgtttcgtgatgggtatttgcatgagttcttcattgatgattgcatcgaccaaaggaaggtgtgtacttcatccactcgcactaccaggtagaaactatgtttgctccaccaccaacatgctcaggtggtgctaatggatttggaggctggtttgatggtggaggtggatttgggcctagaggttatgatggtacggttggagcagatggtgcagcaatgttaaaatgttttaacatttcttaaggcagtgattatcgtactggtgccatgcgatctttgtcatgcatctctaattttccttgtgatgtccgttaaataacttgttcgatttctttcgagaaacgtgattgttctaggccttattaatttgagtgtttagtttaacaatttcggcaccattaatttgagctatcagttgcactgattgaataaattatgttgagacgaattttacttgacatgtgctaatattttaagtatttcgtacctcatttgttctttgtccgtattccatctttttctgaaattttctgtactgtcttataattttttcatcgtgactaagtttatagttgaacgataataaagttaaaacctattagcaccattcatacttgtaccttaaccatgtttattttgtcatataatgctatggaacttgagcacttcgtctgaaagaacaaatgcttcaaaggatggatacttcagtgaagaggaagattgcattcttgatatgttggttgctagtttggaggcaaaattgcgtggtaaggccgcaaggcgggtcccgcaacaattcgagatggaatgaatgatggaaacaatgtccaatgcagctcagtgccaagctatatttcgaatgagggctgatcagattcatgctttgttgggctactc

SEQ ID NO: 40235 - DNA, 12537 bp, Oryza sativa
ttcagaagcaacctaccgcatggaaaggaagagacttttaactacattcactcctttttgtgtaacacaatggaaagagctttggagttatcaagagttagtggagaattcttagagaaataccttactttcctgggcagaacgatcagacaaatatcacacactgtacgtttgctctccacaacttcaagcttgacagttcagacccgcatttcatgacacaaaacctgttatacaatgggtaccccaacatcccagaggctccacccctatgtgtttggtatgacgcacctaacagcgaggaagtgatgaatacaatccgtaaagccattgcagatgaagtgtataatggataggtggcaatgagtctgcaccttcaaaaataagtaacatatccatgagtgtcatggatatgtatcctatatgtatttgtgtgttgctacaagactctattctcgtctatgtataattatttgtgtgcacgtactaatgattaatcattttgtcttccctttaatcatctcaaatcaatttgtcttccctatgtgtttaactagaagatactccgcacgttgctgtggaaattagttgcattagaagaatgtttgcctaggcaacaaagcttgtagtaagttgattctatggaggaaaactctcatacaaagtaatacttgcgttagggcaaccatatcacatacaaagagccatgctgggtcatggtacatatgattgagcatagaaccataagcattaaactttatagttgagaagaaaaaaaaagctacatcatatcaaacatggataaatacgacaacagaaaagagtgaatccctggaaggaaacatataacttgtaagactaaggctagaaagaacatggtgaaatgtttaggcgtaggcgtctatctcaagaggacttgtatttacatgcctagcaatatgagatagagagaatccattatatgtcactgactttgtcatacgtctacgattaatttgccactgactttatcacgttctacaatatgctatcaacttttgcttaacttctacgatttaccatcgttgtccggttagtctccgttagtactgcacaaatttatcaaaatgaccaaaatacccctaggataaaaaccttcaaaatctggataagaattctgaaatgttagattttaagttttttttaccaaattttggatgttttgcaatcttgtgttcataatatgatattttgataattttatctaaattttagaagtttttgtcgtaggggtattttggtcatttggacaaaattgtacagtgctaacggaggctaactagacggtgatggtaaatcgtagaagttaaacaaaagttgatgacatattgtagaacgtgacaaagtcagtggtaaattgtagacatgtgacaaagtcagtggcatataatggattctctcgatgagataaaccatcttaaaaaaatctgataaaaaaagcacatgatcgaacaaagttcggaagatgtacatgtttctaccttcatagattagcatataagatatctccatgcctccatgctaggaatcttgcgctgcatgcatcacttgctccattgcaggtactagctctttagttccatgcatggctatactattttaccaagtgaagccatgaacacgattagacgaaaataacattagcactgccgtttaaggactgaggccaagaaatattttacccccaattttttttccaatttaggcagcccataaccgatgtcacgtgctccctctctttgttgctattatgctctaccgcactctgttcttggtatgctataaccgatcatcaggagggaggggatgtgaggagtagtagatcagcacaaggtcagctacgatactagttctcaagctcgagttcaagcacatgatggtagcgctgaagttgctggtgctcgagctcgaggaaggggcagcacggcagtgcttcagccttcagctcgggacgggagtagcagtgtttccataattcacttgcataaaaatatccaccaactcttgtgaaaatgattagtaataatcactaacaccaagtttgatgttttctttcatttgcttttatgtagggattgatggttagatttggtacctaattaccgtcaatagctttgcaaatacgtatgacgaaataagatctgcaacattagaaattaaagtttgtatcggtgtgttatttatgatattctatcttactataaagtcaatacctactaacttttaaaactcaacatgcaagtatgccacatcatcatccaccagcaattattttaaatattattttaaaatggagccaacattttggtttgaaccaagagaataaaacatttgttatgcaaagcataagaggcgacctagagcttttctctgcctcagtgacgagcgacttgcccaccatgtaaagctctctgcaacccataacttggtcatatcactacaacataaacgaaaacgaagatagtattataggtgtcagaaagtctataactaacacctatttttggctcgagcacatgcccatgggccgtttagaagatctaatacctatgtgacgatataggtaccgtttattaataaaatttggcacctataatattatcactttatctgtactagtttgttttaaataaacaagcatcctagaccgttaagctgagccaatagaccgagtctctccgtccttatcctctccctatcttctcctccccttgtgcgcgtgctctctctcccgactcgaccctaaactcatgagtggaggcggcagcatgcgcgtcccacgtgcgcatgctcccgtgactcctgacgctccccccccccaccccacgcgcacttaccctccgtgcaggccactggcaccgtggcgcggtgttcgccggaggcggtgaggggtagggaggaggtagagaaggggaaggggatggggaaggggaagcggatattgccactggtacgggtctgctgcgggggccatcaataagatccgggtaccttgccatgtacagcatgtacaacatgtagggcacccccttcccctacgttggggtgacgtgagggcgctgtctcgagctcaatgaccgctagatctgggtaccttgccatgctccccttccctttccatgtcacgtcacctatccgtttgatgacgagaggttctgtttttggttgaatttgtgatttagcatgtgcaacagtttatttttctttttaaaaaaatgtgattaagcttgtacagaaagtttagcatgtacagaagtttgttttttttttcgatttgtaatctggggcaacggggagtgactcaaagcatcggattcgaccgaatcgagcctcttctcttttttttttttgcgtcgtgtgtgcctcaatttttttttttttttttgcatcgtgtgcacctcaaaggttatagttgcaccaatgacctaggatcatcagtgccttctccgtgctgccggctggaaaatccggtccctagctaatgtggaatttccaattgacacccgtcaaactttctgtcgtagaatatgctggcgaggcactctgaagcggaattagaagcttgaattctagaagcatgctaaaaaattcaaaagaacatctatagtttcataatttcacaataactaacagaattattgcaacacgatatttttacataaattcaagattccatagtcttgggattctgtagttttaacaattttagtttagaatttgttccatggatacaatggcggagccacatgggcagctgcccgggcttcaacgcacacagcagtagattaggacttgatttatgtgattatttaccatccagccacatacaacagtaggaagtacttaattaccgtacttaagcaaaccagcaaagcaaatgcttaaaaaatcacaatcacgttcatagtaaatgttttttgaagtagtatgaaattgtgtacatttgttatctatttttagctttgcggagtttcaagaaaattcttcgatccaccactgcgtggatacttgcaataaaaccataaccaacgtttagagcaatctaaaacttataaacttatagtgagaaaaaaaaatacaacaaatttaaagtagaataatattattcttaaagaagacacatagatatacatctcacatatttaagatatataataaaaagtttgagaaacatatgcctgcttatgtggacgggcttttcttctcttcctagtttatcaaactagggcgatgtcaaatattattcagatgcctggcttctttacacagctgttggatatagatatatagataagtaattttacagtctttataaaaatatcacgaggtatcattttttctattataattttgttataattttggtagatagacagctcgcactgggccacttatcttatggcttcgttcggtggacggagcgagctatttatttgctcctggttcatcgcctcatcggagcctggactgcgggcgcactacgcgacggaggcggtactgcagccacctgcggccggccgtcccaacctgcatatgccaatcgccaaagaaaacgccgttagatcttggggtttgcatcgccttggcagtgtcgtctaaagcggcacatgcatatatagcagggagtatactactcccttttaaatatttgacaccgttaactttttagtatgtgtttgatcatttagcttattcaaaaaatttaagtaattatttattcttttcatatcatttgattcattgttaaatatactttcatgtacacatatagttttacatatttcacaaacttttttaaataagacgaacggttaaacatgtgctaaaaagttaacggtgtcaaatattttgaaacggagggagtaagttccattcagcacgttgtatccacgggcggcgagctccctgtgctcctgagccagcgcgcaccagtggcagaagagatgggtgaggcagtccggcaggggcgattccggcaagccatactgcgccctgagctttccgcggtaccaccccgcgtacgcccaccacacgccgaaataagcggcaatgaggtagatgaagcagatacagcaccactctaattggtgaggagaccaaaaggaaattgacaagagagaaaacatgcatatcggtaagcaaatgtaaaaaatcttcacatacatatctgtaaccggatataataataagcgtgaaaatgcaaaattttgaaactgaataccgataattaattaaccacctgatcagcggatattaattcgatctaaattcagtttgatggtttctttaattttatatctgaatccaaacgctcttctgttttatcggtaaccggtccaaagcaaagcactttggatggggctatgggagaggagatgacccctacctgtgaagccttgatcgacgatttcaccgatgcaggaaatcgacaaccaagggaaccaagcactcaaacaaactgccaacaggtcgagaaattaagccatgaaacggaaaaaacattgcattgtaccaccaaaccagaaaaatccagtcagtcgtagctttgcatacatgattcgcagccgtctccgaagcagtcgcagaggctagtctgccaaccctgatgggcaggtaccattctaggcttgatgaccacgtccacattctcgacgtcgacctgcgtgttcatggcgttgctgtggatcttacctgcatcgttggaaattggaaactagcggtaaatcaattttgcatctggaattaccgagtgcgtgtaatggacgtacaatcgcgcgccttgaccacttacctgggatgaaaaaggtccgaaaacatcccaattgttttcttggaaacgaaaacggtaaattcgaaaataaaaacagtataataatatcggaaaccaaaaacagaacaatatgaacgaaaatgcattggtatcgacaaaaatcaataacaaatatctaaaatcacacattttatttcgcataaccatataatataagaaaattaattcaaggatacactatgcaaattacaaattgtctcccttttaactttgcactcatatatttggttgaggagttgatgggcttctaaattatgggtcaaataaagaaatagataataaatattggtgtatttagaaatacggtaatctatctatctatctattatattattaaaatagctttgaaaggaggcaccacgttcgctgtgggggttagaaattcccacattaatcggagaaaaaaaaaagaaaaggagagtccaggtagaaatacaatctaaaaataactgaatttcggaattaaaaataagcaatattgaaagaagtttccatataaaaactcaatacgagattaatcaaaattataaataaaagtaaaataaaatcacaaattagaaaaggaaaggagagtctaagtagaaatacaatttaaaaatagctgaaattcggaattaaaaataagcaatattggaagaagtttccatataagaacccaatacgagattaatcaaaatttgaaataaaaataaaataaaatccaaattagaaaaggaaacgagagtccaagtaggaatacaatttaaaaatagctgaaattcggaattaaaaataaggaatattaaaagaagagtccatctaataacccaatacgagattaattaaaattcggaataaaaataaaaataaatatgaaattagcaaaagaaaataaagaagagttcaagtagttagctgaaattcgtaattaaaaagaagcaatattgaaagaaaaatccatataagaacccaatacaagattaattaaaatttcgaataaaaatataataatatccaaaattagaaaatttaaaacagagttcaagtaggaatacaattttgaaacaaataaaattcaaaataaaaaataaaaacattaaaagaacacaatacaatattaactaattttttagaaaaaataaattctgaaattagaaaaaaaagatttatattaggaataaaatttataaataactaaaatttgtgataaaaataaagactattgaaagaaaagaccatctaaaacacatgacgaaataaattaagtaacatggctataaagtagtagagttggtggtggttaatacggcatataaaaattattaataaaacaccaaatagaatcctaatgacgattaaaaggaggacatcaggtatgccgtgaagtaaacaagtaaagcggttgccgggacttctagaaagtataaagaaagaaaaccacattgataatcattttcgatttttaaaatctcaatgacaataaaaaggagaagcaacgagcggggtgtataagagtatagttgcagagcctccgacggttgacgggacttctagaaaataaaaaatgaattgtaatgatagttatgttcgatttttagaatcacaatgacaataaagagtaggcggcggacgggctgcagaggggcatagtggcatcgtttgatgagacttctaaaaattataaaaaataaaactacaagtccaatttttaaagatttagaaattctaaaaagtaaaaaaaaccaatgataatcatgttctattttaaatctcaatgacaataaagaaggcaataaagaagggaggcagcgagcgagccgtagaggagtacaatggcaaaaccgctgatggtttggcgggacttttggaaagtaaaaataaacccaaactataattatgttacccggaaatttaagctattttaaaaattaaaaattaagtggcatatatcactaattaattagttaactagcaaaattgttggaaataagaataagccactcaaaatttatgaaattcacattcgtcgaagttaaacaaacaaacaatgtccaatatacaaccacaatataatagtgataattggaaatatagtacaaacaaacgccactgtaaacagtcagcatatacatacacttacactaataatacaatacatcatatatttgaatatacggttgcacaggacatgcatagcttgacccttttatgcacaaaaggtaatatgtaaataaatattgccgtcagacccatacacgaagtggtgttattcaaccattcaccgagatacctagatcggctaataccgtctggcacccctcccttaagttgggttcgtcatccggctccggctaattaacactaagaagtcacacatctcatataaagaagtaacctcaccaaagggacctcaattcaccagcagtactaattttccaccaatcacatagctgcacataggaggactcacacaaggccacaaaggtagtagcacaacctcatcacctctcagtcaagcagtcaaagcatggctacagccatgcccatttgctcactgatgcatgcatatgagccccaagcacttggtgaggagtgagcagatcaggggaggaggagagcaatagggagcgaggagggaatagccaaagtcccaaaatccacaaatcagcggaatgcaagattctgcccaatccatttcaagaaccaatccctcaatcccaatagttagtagccaaattagttctcagccaaatactcataccatctctatgtcggctaggaaggggagaagaaaaattggctagacaaggagatgatctatcaaggaggagaagagaccaacacattggcgaggacgaacacgggagcacaaccatggaggaacttgtcccttagacaaaggtgagcccctcaaatcttgccattcttgccacctcatagagcagccatggcacgaggcactattttcctgcactttcacatcactattagtggcatcacatccatttggtagcatgagagagagagagggacacacacagagagagaaagcagacgctgttggtagggcttggaccatgggaggaagaggagaaatcgggagggggagaaaaggggatttgcagtgagctagcttggggtgtgtagtggtggtggctggcgtcgacctccgtgggcgccggggtggcagcgccatgggtggtgctgtagatggaagggaggagcagagttggggaagaagaaagccattagcagcagcaacagccaagaaaatggaagaaggggatgagtaactagatgcagcttgttgtatgtgcgagagagagagagagagagagagagagacataagtgaggagagcaggaataagggttaaattgcttagtgcacactagttgtctacactaacattaagcttagcaaaactctgtcaataaatctgtaaatcaagtctagtttaaatcaagtaactaatatatatactcaatacaaattaatggaatgctagaaattgtacatcaggctagaattttaggtgcactgtaatatagatagataagccaattatattcttcaagtttgaaagttaattgaaaatcaatgtatacaataaaatgcagggaaaaggctagagtcagaaattgggtcatttgatagtaccggctacagaaactcaggcaagtctctcttttgatcatgttggtagatgataattctatttcaacttaaaaatctatttcataaaaatatttctcctagtattgcatcaaaaagtattttctagaatataatgaaatgaacgatgatgatatgattgacaagccgatgatgatggagatcatcaggatactagtatggtgggtagggggagctcagggatgagatgattgatgatgatggcaggtcagggctctccctacatacggtgtataaatataaggactaatcaccccctcactcgtatcaaagaaccgtatataccgtgtcgaccatagattcgtcttaagacgggctggacctggtaccttatcaagtttattatactccacatgggtacgtagtagtaggatgggagatgatataaaccccatgaatgccgatgaagtgcattccaggcgcatatagtagcgcggtggtgtggagggctgataggctcaacacaaacgtggagtgtagtaagttgaagtaggggaaaagttctgtactcttagcatggtgccgcatctagtgaagtgcgacagtcaaacatgttaagagtagctatgggtacagtgatacaagcctgcgcagtgctaaattaaatcgtgattcacgactatctcctggatgggagtctacggggagttgctacaaactctattcaatgttatgagtgtactctagatggagtagagatgaccttaatgctcctagggatgaattaaaggtagttctaactatttctctgttgcgatctctgatggtggattattatttggcaaaataatggttgttaaataataatctatgttctcacacttttatcactaaagataaaagtgtggggcgtcacagttcgatttttaaaatctcaatgacaataaaagagaagagatagtggacaggctgtataggagtataatggcaacgtttgacgggacatctagaaattataaaaacgaaacccaacgtgacaataaactctaaaaactataaaatctaatttttaaatgttccaagatgaatgaatagaaatagtgatagatcgagcaagcaaataaagaagatgacataaggggtagcaattggtgtgatttttaaaactatataattagaaacacgaggatgataaggtttggtctttcaaagtcttaacaatgagatagctatttaataaattttaagtaaaatcatacttaaaaaaatgatttttttggctagccgcgcaattgcgtggaccacccagctagttatcataatataaaacagtaatttagaagcccgaaccatctgagcacaaaagccctcctgactctctttttttctctccctagcgtcccctctggccctctccatacctagctcaccctggagccctaactctaatatatgttggaatccgtttcacgtattagcccttacgggaattgaattaccgatgattctcattcttgacaaaatgttcacatggagaagcaagctctgaaatactactgccttcatcccattttaatcatcccctaatatttttaaggccttttcaaaataatcatcatcttcgtttatttgtgcaaattaagagtactaaatgtgtatcattggaatgtgttacttgcaaccaaacaagattaatttatattatatttaaaccattagcaatccataagacacgaagcgatggaacacttaatccatgagaggattaattttaagaatgatgaatattttgctgttattgttcttagcgcctttagttaggggatgattaaactaggatggagggagtagcctgctgaccaaactgtccattttttacgggtcctagctagagtggatcatggtgaattgattcctccttcggcgtgtttggagcagtgcagtgaaaatgttgcttcacacaggaatcagggcaaccatatatttttatatatttttggcacgacaatatattgatatcacctaccctttttctggcagctttaaattgatgacagttttggcatttcacaatcgaacttccaaaatttctggagtgctaaaactctggaatggattctattcttttttatatactccctccggtttcattttaattaacgttttggacaagaacacggtctacaaaatatatctttgacctttatttttctattataatatatataataaataaatatatgtttacttttattatggtgttttgaaagacaaatttatatatattgttctagttcctttaaactaaatatttttaaaattattgatggtcaaagttataaagtttgacttcaaccttatctaaaacgtcaattaatatgaaatcggagggagtaatataaaatatcctcgtggacattcatgcaagtatattgcaggaggcatggacgccaccaatcacagttaaatactagtatctaaaattgcgcaggttttgacacaacttttttaaagaggcatggtttagttttcaatttttttttcccaaaaacgtcacctcgaatctttggatatatgtatggagcattaaatatagataaaaataaaaactaatcacacactttgcatggaaatcacgagacgaatcttttgagcctaattaatccatgattagccataagtaccacagtgacccacatgtgctaatgtcggcttaattaggctcaaaagatttgtctcgcggttttcaggcgagttatgaaattagttttttcattcgtgtccgaaaactccttccaacatccagtcaaacatccgatgtgacaactaaaaaaattctttttgcgaactaaacacacctagaatttaagaattttagcgacaccaaagatttcctgttggcttccaacttttgagaatgtgctaaagggggcatattcgcaggtataaatgtgcagtagggcacgtgaaaaaacaaacaatatcaagaaattatattatatatgtatcacgcactttttcgttttaaaatattgctgcctttgtatatcaaa

SEQ ID NO: 40236 - DNA, 6077 bp, Oryza sativa
ctccgcactgagaaccggcctgtcttatctgggtgccaagccaaaaaatcttcttccaaatgaggagacagacagatagttgggatgatctcagcgtctataccaaggaagcatctattgatctctgtaatattccaagagccatcttggtctatcaaatcagacacccattttagccaacaattacctctcaaagaaataggtcttcttgagtgatcacgtggaatccagggatctctccacacgcagatagacttcccattaccaactctccatatgatcccttttttcaataactccagcccacgaacaatagcacgccaagtcgggaaaatgttgcaactgaaggtagtatcaattagggatccttgggggaaatacttcgccttcagaactcttgcatagaggatatcagggaattctataagacgccaagcttgacgggcaagaagggcttggttaaacagcctatagattctgaagcctaaaccaccacatctttttggttttattaaacagttttcttaataagccgttttggcttattagaaaatataggcaaccaataaggctcttaggctgtgttcgggagtgagggttgggaacctcactcctggcatataaaacggagcagcatttaatgcgcgattaattaagtattaactaatttttttaaaaaatagatctatatgatttttttaagcaactttcgtgtagaaactttttgcaaaaaaacacaccatttaatagtttgaaaagtgcgcgcgcagaaaacgaggaagaggggttgggaacttcctataccgaacgcagccttaaactacaacccaaccaaatagagatcctctaacttacttttctctaacttgtgtcactgatatgtgtgccctctatccagttggcccatgtcagtgactcaaagtcagacaagtcataggattctgccgatgcatgcacagcttagctaacagcatcacatcgtgtgccatgctgaatttccagcttcttatgtttatcgtgtaggattaattagtcactaaccaaaagaagcacaagccatgccattctttttttccttttccttgtataatactacattttattaatatctcataatcataatcatgtcgttagatggctaccatctcaaatttctaaatattccttaatacttgcaagatagatagtttgttaatcattttatcaaaatcgatatagatgaaagcctatttatctagacttttatctcggtcgatattttcaccgcttatgatatatttgctcaacattcttatcatgctaaatttcataaataaataagtatatgcagtataacttcctgcctatgttttttgttgtaatatgtttttcatgttaatacgatgcatcattacctaaagaaaacattgaaatttgcatataatctatctattatatactaaaagtccattaaacttcctacaaacgctctaaggctgccatgtggtatcctataaatgctcttaagtccccatgtgtcactctaaaaaattagtaaaatctgaccattgatttttatttaaattggtgggcccattaattttcatatttagatctatcttcacaagaaaaataactccgtccggacgtgagcctccgcgcgcacgtacgtgcgattcctccaaccaaccgttcctctcctttttttaaatccccatataatttaaattaaatacctttttatgggcctaaaaagcccatcaacctactagatctagccaacttcctatattctcacctaataaataaatagttcaatcaacatcatataaatatttctaaacacatgtccaaattcgctgttctcgcatatgccacatcctatttaagttcaggttttatgggacgggatgagtatatagcactcttaaattagagaaaaccttaaagaaacattcgtccatctatatacattattttaggttattagatttatctttttctaaaaaaatatatcccaaacctccctccgcgctcctatgcggcgttaaagcccattaaccatcttataaaccacgcagtgacactcctaaattataaattagagaaaatcataaaaaattaagaactcaaacaccattttgacttaaatcgatggacatatcatttaggttgttattagatttttatttaaaaaaactcacaaaccttatttcctcactctcggcccctgcaatgttaaatacattaaacatcctataaatatttctaaaccactactggtctctcttaagttaaaaacaaaacatccgaccattgttttcgacttaaacatccaacacattattttaggtcattagatcaatcatttttttaagaaaaaacatcctcctccctcccttcccgtccccgtgcggtgtgatgttccttttctcttatttttatattatgataattaaaattaaattaatctttatggaggaaaaaccacaaattaacctccacatattaggtctagccatgtatcccactgtccctgtccttctctctcttactagcacttataggaacaatataaataaaatatttataacttttcaaatcatatattcaacttatgatctgttcgaactattatatttttagtgaaatcaatacagtaatattcatattgtctatatttaaatgctaacataaaaattatattctagacccacatccatcttgaggccaacaataaattaaaaaagatactaaaattcgtcattgaaaatcagaatatcccaccttaatttttaatacagctgttgacccattacttatatcctgttagaccctaacactttctatcaaatttattaatttctctcaacatgtatatgggggctacttacctatataatatgaccttggtgcttttttatcaatcaatgatcaatttagaagataaataaataatcttaagatgatcatagagtctaaattatctatatgatctatgaagtcaccaataaattagaggaaaactttaaatgatatcgtgttttacgtcataatttgtaccccatctagcgttaattttttatagacaacataataatgtgtatttattacatgacctctattttaatatttcttactcaattgaagtgagataattcagaagagatgactttaccccatgtcaggttgtaggctcaacccacttatgtttttaacccaaattgcagaaatcaaatcatttcaaatatgcttcatagagtggaattctccaaatttctttaaaaaatgtacatgaaaagaatcaaaatttaacaaaaattatcttttttaaaaaaaaaattggtttgaaaacccattctaaacagaaacattcaaacttctagcaaagctaatggaatgaaaatatgtaaaacttcaaatactatctagcaaaaaaatgactttttgagcaaatgtttgggggtaagatatctatgcgagaagtcaaaatgaccaaaattttctcataggaactacatctattgtttcgacataatattttcttataaattatgaagtgtacagtctcaagtaattttagtttagaatttatgtgctgcaagggtaatcataagaaaattataaccagcattcaaatcacattaaataagttcaatttttatttagatagagaaacacccacacatggacatccctaacaaaatttcatgcacattaaataaggtgcacgcgcatgtgcgcgggctaccttcctagttttaagaaaaaatataattatgatcacttgtcaatttagttccccctcgtaattgtcacgcccagatattcacgaaccagaatttctaagctgaatgtgtattaaacccctgtccaggaccagccagggtacacaaacgacaattgttgacatacagatccacgttttacaaaaatataaaagattacaaatgcagcggaaaaaagaagaaaaaaacgagcttaaccttgaagacttgacttctgcagtgggcgactccattcgataggcatccatgacggtagcgacgaaaccaacttctttgtgacatcttcaactgagaaggacttcaactctggtgtgggggaaaagagagcaagaccgagtggcgaaggctgtcttgggaatatcctcttcccgaattctcaactgatgatagcctgatcgcaggtctatattggaaaacaccttagctccttttagctgatcaaacagatcatcaattcttggcaacggatatttgttcttgattgtgacctcattaagggcgcgataatcaacgcacatcctcttggtcttgtctttcttttccacaaagataaccggagcaccccaaggtgaagtactcggtcggatgtaccctttctgcagctgttcgtcaacctgctttttgacttctgctagctcattagctgccattctgtacggcctcttgtagattggagcagttccgggtgccagatcaatctggaactcgatttctctcttcggtggcattgtagtgaggccttctgggaacacctcaggatactcttgtactataggtatatcctccaacttcttgggatttttttccgctatttctgtctgatcctcaataacagcctgattcagactcgctacggacttctgtgacactggagaacggaaggtgatcttctcccctttgtcgttgcttagggtgatagtgcgacttgcgcagtcgatcactcccttgtgtctggtcaaccaatccattccgagaatgacatctaggtctttggattcgagaaggatgaggttggatagaaaccgtgacctcttgatctctatagtcactgaggggcagtagtgtgctgtcctcatgtcatttccaggggtatgaacctgcatcagtattttaagttccactaccgataatccatgtgccccagcaaatctcttggatataaaagaatgcgaggcaccagaatcaaagagaactgttgctggatatgagttcaccggaaacgtgcccagcacgacctctggtgatgcctgtgctttctctgcagacgcatgattgacgcgggcctggacgaacctaggtccaacgcgctttagcttcggacacttgccagcaaagtggccgtgcttgccacagttgaagcagggtcttggctttcctgcagactccttcttgagctgttctgactgagctgacatagctggcggatctgactgagctggtgccattaatgggggtgaagtcgagttgtggttatgctgcttactgttgttgtgactgccaccgttgtagtcgttgttgaagttactcgggtggtaaggatggtgctgacggatgatcagggtggaaggctcacctagctgtcccgtcatgaagcgaggcttctaattgttcccctgaggaaagctgatctgagctacctttctatttcggtccattttgttgcgttgctcttcctgacggatagccttgtccacgagcttctcaaagtcatcatagactccggagatcagctggttggtcaatttatcatcgagaccaaacaaaaacttctcctgcttctcggcatcggtgcgcacatccttaggagcgtagcgcgcaaggcggttgaactcatgcaagtactctgtaactatcctggtttcttgatgcagtgcgcggaactctcttttcttttgtgccataatcccctcaggaatttgtgccttcctgaagctttgacaaaactctgcccaagtaacctccgttgaatctggacgggtcaccacgtagttatcccaccaagcagaagcgggaccttgcaactgatgtgtagcaaaagcaaccttctcttggtcattgcattgcagaaggttcagcttcttctcaatcgcacggagccagtcgttggcctacattgggttggtggtgcttgagaaagtgggtggctggatatgatgaaagtctaacagtttggacaggtgtgatgatggaggaccagactgctggttctgctgcgcctgctgcaacatctgatggtaatgttgctgcatctgttgtatcatcattgtcatcatctgagtgaccgttgggttctcgggcggtggagatgaa

SEQ ID NO: 40237 - DNA, 1315 bp, Oryza sativa
cgatgatcataaaggcaaaaaatacgtcgagggggagattcgaaacctgggaacttcgtgacatctcactaagcaagtgaccactacaacacatgcaatgaaatgctcaaatttagcacacgctgtgtgcgcggatggcggagtttcggaaggttgccgatggcggtgcagatctggccgtggctgctgtgcacgaggaaggagggaggagtcggcggcgttaggatggaggtcgccatggtcatggcacttcgacggttggccatggcgggggcaactcacggtgtcactgccggtgtggcggtgtcccctgttcggatcgtggccgatgcatatggtgcaagagatgctgtcgcgacatgacgaggcgacatccctcacagttggcagcatgtagggaattttctgggcgttggtgttggctcatgctccactggtggataggcctccccctgctatctacagtaaaaaaaactttcactaattgaataatcaaaatttcaatatttggtccaagatatagcgaaatacccatgtatcaacttatggcatatccactcgtggatctatgaggctatggaatggtgtatataagggatcctttgtgcgataacgcatgaagcgaacgcaacctagttcaatctatatgtgattattgaattatttccattgttttgtctgtcttatttcggttttatcgtttaaattggcagagttcttatcaatcatgaaaattatctttatctgttgaacgcacaaatatttttgctagtccttaaaaaggtacaagggtatcatattttctattgcctttgtacttccagatactaagtatctcaaaaaaaatatatcttgatgtaccaaaatttgtttttagtgtattccaagtttccgcatcctaaagcaaaaccatacattatacatggaactccagaaccaccactaaagtatataaaaaaagtcgcatatatatatatatatatatatatatatatgtgcaacctctttaaaccaccatgtatagagcaaaactgaaatttactaggggtcattgtacaaaagcactacaggtgtcattgtggaacaaataataataacatgaaagaacattgcaagaggattcaccattattatgatatttccttcctcacagggaatatgggaggccatatcatcataaagggcatgattgaaaacaagatttcatccttttctgtcacctcgtaaaccttgtgaagttgcctactcttaacatccaagtagagtgcacattcatctgttttcaagaacaaaaactcagcatcgtcccctacat

SEQ ID NO: 40238 - DNA, 3033 bp, Oryza sativa
tgcctcggcagctagatttgattcggccgcaactggattttgccacattacgagctgctgcaagttaaggcaaaaattgttttttctgtgtgtgtgtgggggtgggggcggggggttgggatttgtttgtgtgtttgtgcttccacctttataatttttgtagcgtcgatcttatgtttggaataactaatgattgtccgattgggattttgattgatccttttgtgctttgtaagctgtaacggacagaggctgtcgctacatcggacatggcggatgaaaagttggggtgaccaacggaaaattgcagatttgcgcatttgcgcgtatgggatgggagcgacgcggtcgtgcatacggacgaaaattaggtgaagaaaggaaaattacgaatcttttaattagttaagataaagtaacacagtcggacgtccatggtagagtgaactgtgaaaaccagggtttcccaaaccgtcgggctcggggttaccgcgccccggcggtaagcacggtaaccgcggtaaccgcgaaaaaccgtgcaaaatttatcgaaaatttaaattattttttaaatttatttgaatttaaggaggttaccgcagtttttctatatcgtaccccgcggcaagaccggttaccgtggttactagcggtaatgtaaacccgggtgaaaaccaactaaaacagtggaaaaagaaatagagttgtttcaactttcaagaaaagaaaagaaatggaaaaatacacacaacaagggaaacacgatttaaaaggattggacttttcctcgcaaaaataaaagaagaaatcgattgggacttggggtttagaattatagcggtgatctctacgatcgatctgttgcattgccacctcgctcgcgcttttactttaatctgcggtgatctgtatgattaacacgtacgattctcaaactttcgtttcaagaaagaaaaggactcaaattcacattgggttttatgtatatatatatatatatatatataggtaaattaactggtgctacatggagtatgggtttcaaaattcaaattgagtatctacccaatttgaatgagtatgaattttttttaaatgtttagatatgatcaattaacttctttcaaactgaattttttttgttagattttgattctagttatataacatccaaacatataattcgttaggtatgtaataatgaattgtgaaataaagttgagtttgagttgttttgttgttaggtatttgtatgaatcaaattcatatacctagatatctacttacaatttgtaaatttttaaaaatttgagagaatttatgtgttttatatcttggagcccgggcactatggagtcccatatggatatatatatagttgtacaatctcggattaattaacttatccctccatcgatcgatcacatcgtgctgttttatctctccatcatccccaccatcgccaattcaattcaattcgacgtggccatgacgcagacgaatcaagccatcgaggtggacggcgatcggctgtcgccaccgccaccggcggcgtcacccgccgtgtccgccgtactcgagaacgatgacctcgtcggcgagatcctgctccgcctcgccttccccaccaccctcgtccgcgccgcgctcgcctgcagacgctggctccgcgtcgcctccgacccctccttcctccggcgattccgcgagctccacccgccccgcctcctgggcttctacgtcacgagcctcaagataccgcgggctcacccgctcttcgtcccgatgccgccgcctgcacggccaccggagctcgaccccgtcgtccttcgcggtggcaacttcagcctcgcttacgagggttacacgaccagtatctaccagtgcaggaacggtagcatcctcctcttcaaggagaggcatgatcggcgcgagctcaaatacgcggtgcacagaccgctgcagcatcctgagagaggcctactcgccatcccgttctcttcaacacatgacgatgacgatgacgtcgagcctgatctcggcttcgacgacgagaatgtgtgggggttccacttcggagaggatggcggcagccagctataccggttatcggtgatgttcaccccaaggggagctacttccgcgtggttctacgcattccgggacggcggatggcatgtccataccaaggcgacggcacagctacctggcttgccaccggaatcagctgggttcgtcgtggtccgagacaaggcctacttggcagccacttcgagcagcgttcttgtgttggacttgaagtcctcgagcttgtacaccatccagcttccagatggggtggagttcccacctgtgatgatgtggtataatgatcgaagccacgacgttttgttcggacgagcgagcgatgattctggggtttatatcgccgatctgaaggagcctcagcttcgtatttggctacttaagcatggcagcactggatggactctggttgataccatttgtttgcggtcgatgtgcgctaatttgcacataaattgtgtgggcggggatagtcgtgttgtttacatggattatgtaggggacgatgctgagtttttgttcttgaaaacagatgaatgtgcactctacttggatgttaagagtaggcaacttcacaaggtttacgaggtgacagaaaaggatgaaatcttgttttcaatcatgccctttatgatgatatggcctcccatattccctgtgaggaaggaaatatcataataatggtgaatcctcttgcaatgttctttcatgttattattatttgttccacaatgacacctgttagtgcttttgtacaatgacccctagtaaatttcagttttgctctatacatggtggtttaaagaggttgcacatatatatatatatatatatatatgcgactttttttatatactttagtggtggttctggagttccatgtataatgtatggttttgctttaggatgcggaaacttggaatacactaaaaacaagggctgcaggaa

SEQ ID NO: 40239 - DNA, 4357 bp, Oryza sativa
attatagcaaagaccattggtgtcatgtgacaccattgctataacactagctccacccccgagtcacaggtttatctatccagaagcggttgaactaaatagccaatatatagcagaagaatagtaggaagagctcatgtaaattattttcaaaatgaatgaacatttttcatcaatttgtacatgctgaagtttttttacagtatatatcagcgttagtaatgttaaggaacaataatgagatgttagggttagggtttatgcgccacccgggcgaccgggcggcggcagagctctcgcgcgtggcgagatgggtctggatggagatctcctctgatctgctcctgatgtctccgggggttttacccgccgtgggttgttctgggggggatttcctccctgtgttgaaacgtgatctggtagggtggcctgatcatactcgtataggagataagttgaaggctttccctttaggcggattgatctatgggaaaggttcgttctctgctttccgtattgttccaggggatctgtggcccttgcgaaattctagaagggggaggagattgaatctgttttggtatccgaagttcgagttgtattggagacctaattctgtggcattgcagtataaatacaagtcacagtggtggccgaaggtgcggttcaaagtttttccggcgatagggctaggcgttgtcaaccccgtctctttgtttgttggatctagcggaagtctcatggcggccaatgtcggtgggggtgataaagggatcgtcattgggacgatttcccacccgaagctgatgagcggtaatgagacggacgcggtgattctcgacaggattcctctgaagatgatcgagggagcagcgggcacatctgatcagggccaggaacacacaacggctgcgaggaggggatctgcagagaacaaccaagttgatgcaacacagtgtcctgcagtgttcactgaaggagatctggtggaggatgaggaggatgtggttgcggtgaatattgaggatgatgaactgcagactgctggcctgtggacgatcttggcgaggttctattctctgagaactccgaaccaagtggccctgtttgacgacatgcgcagagcttggaggttgagagcagatatgagctacaaatcactacgtgacaacatgttcatcataaccttctcggtagagggagactgattttgtcattaaagggggtccttggattcacagaggagatgcactcctggtagcgagttttgatggcattacgtgcccatcgaatgttcctttggatgttgttccgatctgggtgcgcatatatgacctccctctggtgttgatgacaaaggtaagaggtgggatgtttgggagcaaactcggcaaagttcgtgaggtagacgtgagggatgatggacgcaacaaacatgacttcttccgcattattcgtgttgatctccctgtcaagcgtcctctgaaatcacagatagctataaggatgactgtccaaggcaaggaggtccttcgcaggttcgatttacgttatgagcgggtaccgcacttttgctttatctgtggttttattggtcattccgacagagattgcaatagaagatctgccaatgaggatcaacctttccaattctcagctgagctacgatgctcccccccttaaaccttttgagaagaagatcagtaaagtgaaagctgcccaaacatcaagtgttgcacgtaacttgttcttcagaggggcaggaagtgctagttcatcgtcctccagacacaaacaagatggtcagatgcaggaagcaataccgcccagagttgatgcccatgatgggtttgagtttaaggaaagggaaggggacactgcaattgatgagatgttagctcaacaggctgggaagatggatgttacgggggacaaaactcaggaaacatcgatggttgtccctgctgggaagctagcccagcaacaataggagaaggaagcacccaagaagactgatggtgatgaaatttctgcttctgagatgataccagccatgaggaaccttcaacagcaagcctcgtttggggaagtgtcatccgaggagatcagcgatgccaataggaagaggatgccagaccagtcaggactccagataaaagggagggttcagcaagcattgttggaataccaacaatacacaggtggcagcaattccatgcatggggatatcggcaaggcagctagagcagtgaagagactcaagaaggctgcagagggtgaggacacagacgatatggaggcaaccagccatggggccgctggtaaactgacgggacctgtgattgggtcccgtcaggagcaatgagttgcttggcttggaactgtcgcggtatagggaacgcggcgacagttcgtgacctttgtgccttagtgaaggaggcaggttcccatattgtgtttttaagtgagactaggcaaaagattgagaaggttcgtaggctgcggaatagattgggtttgaagggttttgctggggttaacagtgatgggatgagtgggggtctggctttattctggcatgagtctgttcatgtggaaattataagtatgaatgagagatatattgacgcgtatgttcgtttatctgtgaatgctcctgtctggcatgctacttttgtgtacggggaacctagagtggaaaatagacatcgtatgtgggcgttgttaaattcagttaagcaagtttcggatcccccgtggttagtggtgggtgattttaatgagactctttggcagtttgagcacttctctctgaaacaacgaagtgagctgcaaatgcaagcctttagggatgtggtccagagatgtgatctccatgatctggggttctcgggggtgccatacacttatgataataggagagaaggccgcagcaatgttaaagtgcgcctagactacgcccttgcagatgatgggtggaggggactgttctctacagcacaggtgtttcatctgtcctctcctagatcagaccattgccccatccttgtcaaattttcttctgaagaccttcacaggaatcctgtgaagtgtgtccattatgaaatttactgggaaagagaccctgcaatctctgaagttatagcagaatcttggggcgtttccggagttaagcaggatctgcgcgacattaatcaagctctgtttaggatgatgtctgatcttcgcacatggagtaagaaaaagttcaggaatgtcagccgggagattgagaaaaatagaaagaaactatctgaacttcttctaagtaatgccgacaatagggaaataagacgggtgtccgatcaaatgaatgaacttctgtaccgtgaggagatgatatggctgcaacgatctcgaattgcttggctgaaagaaggtgatagaaatacacgtttctttcacagcaaagcagtgtggagagctaagaagaataagattacaaagctacgggatagtgacggtactgttcacagtacgacaaaagagttggaacgtatggcaactgagtatttccaaaggctgttcactgccgaccccagtattgatcattcgtgagtcactagcctgatgaagccgaaagtcacagatgcgatgaatgagaaactatgcaaaacctttagtgaagaggaaattgcaaatgccctgttccaaattggtccgttaaaagctcccgggccagatggattccccggtcggttctatcagaggaattgggctatactaaaggacgacattgtgcgagctgtacaagaatttttctcttcgggtaccatgccttcgggggtcaatgagactgccattgttctgatactgaaaactgagcaaccataggaactaaaggatttcagacctatcagtttgtgcaatgtggtctataaaatagtgtctaagtgtttggtgaacagactaagaccaatcctggatgatctggtgtcacagaaccagagtgcctttgtccctggtagattgataacagataatgccctgatagcattcgaatgcttccaccatatacagaggaataaaaatcctgagaatgcttactgcgcatacaagttggacttgtccaaagcgtatgaccgtgtagactggaaatttttggagtaagcaatggttaaactgggtttcgctcactgttgggttaaatggattatggcatgtataacctcggtgagatatgcagttaaacttaatggaaccctgttgaacacctttgctccatcacgaggtctgcgtcagggtgatcctctttcgcccttcctattcctttttgtggctgatggactgtccttgttactagaagagaaagtggatc

SEQ ID NO: 40240 - DNA, 1561 bp, Oryza sativa
ttttgattaaagcggtcctacaggccatgcctgtttatgttatgggactcttcaagctcccggagtcggtctacgaggaattgacaaaactggttcgtaatttctggtggggagcagagaaagggaagaggagaacgcactggaaatcctgggactgtttgattgctcggaagttgaagggaggtatggggtttagggatttcaggctgtttaatcaggcacttctagctagacaagcctggagattgttggacagaccagacagtctctgtgctagaattttgaaggccaaatactacccgaacggttctctcattgatacaagttttggaggtaatgcctctccaggctggagagcgatcgaatatggtttagaattactgaagaagggcatcatatggcgcattggcaacggtaaatcagtcagattgtggagggatccctggattccgcggagcttttcaagaagacccatctcagctaaaagaaattgcagactgagatgggtttcagacctgattgatcagtccgagtcctgggatactgacaaaatctcgcagcatttcctgcccatggacgcagaggccatcctaaacattcgtttatcttcaaggctggaggatgacttcattgcttggcatccggatagactggggagattttctgtcagaagtgcttatcatctggcaatagctctggcacaggttgatgaaggctcgagttcgtccgggaatggaaatagcagagcctggaatgccctttggaaatgcaatgcgccccaaaaggtgaagatttttgcctggcgagctattactaacagccttccaacattggaaaataagaagaagaggaagcttgaagtttcagacatctgcaccatttgtggggtggagtcagaatatgttgttcacgctttgtttcgctgcccacatgcccggcaattctgggaagcgatgactgttgatatgaagcttaaccctctcagcaacattcgcaatggagatccgaaagtgatcttggacctattggagcagtcgcagccggaggaacaggttatgcttttaatggtactgtggcgaatctggcacacacggaatgaaatagtgcatggcaaaccagccccaggaatactagtgtccaaacgtttcattgaaagctatgtcctctcccttgctgagatcaagcaacacccccaagcaagtcctgagaaggggaaacatgttgtggatgtggttctaaagaagtcgcacaacatcaaacggagtcaagaacctgttcctgacaaatggtcgaagccgctcctaggaagcatgaagctgaatgttgatggctcattccaggagagtgacggcaagggtggtataggcgctgtgttgcgcaactgcacaggagaggttatttttgctgcttgtggacatgttgatcgctgtagcagtgctttggaaacggaactccttgcctgcagggatagtcttgccctcgccctacaatggaccctgctgccaatagtgatgagacagactgcttggcgatgatccatcttttccgcgatgcaacaggt

SEQ ID NO: 40241 - DNA, 10507 bp, Oryza sativa
tgcttttcatggctcctatgctataaaagggcagcatatacagtcatacagactagtattaattagttactaagcagattagaattagttttggatcatcactgcaaattgaaggatcacacaaatcaatggctgagttgcattgtcgtttttgtgttttttggcattctgtaacttgaccgccccttgcatatatatgcagccagctgaaattagccttggctggcatcctcaagttagagaatgccaaaaacacaaaggcggccgggatgctgtgtcttgccggaaggcacgaagctgacgctggcgcacgacgaccacggcgtggctgcagcggcgccaaggttcatcatctacaaggacaaggccgacgccgtgccgtccaacctccgcgccatggacgccatcctcgccatgttcggcatcctccctggatccgacaaggcggcgcaggtcgccgacaccctccgcacctgcggcgaactgacggccgccggcggcgaggagccacgccacctcccgcgaggcggtgctcgacttcgccgcctcggcgctgggcaccagcgcgccgcgcgcggtcaccacgctcgtgcacgggagggagccccgcaggtacgtggtagcggccgacggcgtcgcccggatcggcggcgacgccgtggtggcgtgccaccctatgccatatccatacgaggtgtactactgccaccggccagccgacgcggtggcgctgagggtcgacctccacgccgtcgccggcgtgggcctgggcggcgccactgccgtcgacgtgtgccacgtcaacaccaccacctgggacagtgcctacttcgagctcctcaaggcaagccgtggcgacgccatctgccactacatgccgcagggctatgttctgtggctagccaattgagacgatattagtatttcctacaaacacctgatcgtagctactcaaccttccatgattgatgcttgatgcatctctcgctactacttcatccgtttcacaatgtaaatcattctagtatttcccacattcatattgatgtagaatgacatacattgtgaaacagagggagtatcttaataaacgcaaaatctatttcgagaggcatctcgatttagacttaacgagcgacgtggacaattacgtgagaagtattagtagcattacagacatgcatgtaagcagtttttctattaggttgtgcatattttttcttcttataaaattttcacttaaattacttatccgatctataatccgattacaccattgtgttcgttgcaattaaatctttataacaagatcttacatgataatattatgataaaaaaaacatttatgttataaattacttttataatatatgtaagttacttttatcttatatacaaattacttttagatttgattaaattacttctcataatttcataatgctttgagttgattacttttattattattgtttttactcagtttcataatttgtgttgattaaatttaatttctaaatagacttatatttttattcctacgacgaatttacttctaatatcataacaacttactttcattttatactaagttacttttatgatttttgtaaattactttcaggctttattaaatttactttcataaatgtatttacatgaaaatcttctctacacttttgaatttactccacatagtttcttattggaactcactcataatgtaattacttctatatagagttacttctattacatagctaagttacttttacaatttaaataaattacttttaaattaataaaatattttaatatattcaatctggatctcgttttatcacatattttaagtggagtacaatgatacaaatagatcttaaaaataatatatgatttaaaagatacaagtgattaaagaggtaaaaaaacatgcactatagtactttttaagctaaaataagatttaaatctaggatggagtgatcgctgctttaggcaaaccagagaccggtcgttgtgtagtcatgaaataaaactgatgctgtgctctctgctcgtcctcgactcctttttccttttttctttttttttatcgaagaacagtgaaggaagctatactaattactgttgcaatcccatgcctgttgctaacttctgaggaaggatgaagatgtcagagtccaaaaagaatcggtagactgaaattccaagttttcaggaaatttgaacccaaaaaagttgaaaatcgaatacatttttactaattgtcaacaaattagtaaaactgttacactgttcattcatcacctgtgttcgaccgtccgatctgcctatccaccaagctgttcatgtgcagatggactactcgagtagtgtggagatgacgaggacggcgccagagcctctcgctgcagctgatttggggatttccatttcctttattactgtgggggatttacagattttcattggctctgctcgctgctaatttgggcagtacaaattttgtgcagccttccaccgatttcgagcatccagtatgcatgccaaaaagggtttcccaaaccgtcagggccagggttaccgcgccgtgaaaaaccgtgtaaaatttatcaaaatttaaattattttttaaatttatttgaatttaaaaagattactgcagtttttctattaccgtaccccgcggtaaggccggtaaccgcgcggttaccgaaagaagataaacatgctattttatctctaacacgcccccgcagactgaacgtcgttcgaacaaacgtttaggctggaccgaaactctgtgaagactggagttggaagacccttggtgaagatgtcagcataatgtgtgagcacattaagagcgcgaacggaaccaatggcgaccttctcacgaacaaagtgtagatcaatctcaacatgtttcgtgcgctggcgttgcaccgggttagtcaagagataaactatgctgacattgtcacagtagaccagagtagccttgactggaggagcatgaagctcatggagaagctggcgcaaccaacatgtctcggcaacagcgttggcaacaactctatactcagcctctgcactcgaacaggaaaccatagtctggtgcttggaggaccaagaaacaagattatctcccaaaaacacagcatatcccgaggtgaacttgcgagtgtcaggacaactggcccagtcggtgtcagagtagacaaccaaatcatgtgaggctgagtgacgaatgtggagaccaagatccagggtgcctcgaacatagcgaagaatccgcttgagagctatgagatgagactctcgaggatcatgcatgtggaggcaaatctgctgaacagcatactgaataccaggccgagttgctacacggtttgcagtcgaacatacctacacgctccaatatctccaagccatactgccgttgagtgagaaacaagccgaaggaatggcgagagactgaaacaccgagaaagtgatggagctcaccaaggtccttcatactgaactcagactgaagagaagagattgtccagtgaagcagcgatgtcgacgaagcagtgagaacaatgtcatcaacatataataagaggtaggccacatcacctccacgtcgacaaataaatagagaagtatatgccttggcttcaacaaacccaacggagcggagaaaagtggcgaaccgactgtaccaggcgcaaggagcttgcttaagcccatacaaagacttgttcaggcgacaaacagagttgggctgagcaggatcaacaaacccagatggctgcatgcataacactgtctctgcgagggtgccatggagaaaagcattcttcacatcgagctgatggataggccagttacgagagactgccaagctaagcactgtgcagactgtagctggcttgatgatggggctaaaggtctcgtcgaagacgatgccggggcactgagagaagcagcagaggacccaccgcgccttgtagcggtccaaactcccatcggcgaggaacttgtgacgaaagatccacttgccggtggcgatgtttgtgcccggtggaagaggcacaaggtcccaagtgcaatttgacatcggtgccgagtactcctcttgcatggcatcacgccagttggtgtcggcgagcgcagcatggtaggtgcgaggtatcagggagagagtggcggcatggaggttcaggcgtgaagtggcaacccggacgccagccttgccccttgtcaccatggcgtggttgttgtcgatgggagagatgccgaagcctgtaaccggtggccatgtaactagggcgcgggcgcttctggcgcacgtcggtaccgcgagtggcgacggctagagaagcggggcacgcagcaagcgcgtactggacgcgccgtcatgagctggggaaggtgcgccgtcatgagccagggaggaagcgccgtcgtggacatgaggagcgccgtcatgggccaagatggcatcatcgtgggcagaccgagccggagaagctggccctaaagtagagaccccatgggccgtcggagatgaggccgcaggtgccggcccaggagagaggcgcccagcccagcccggcaagcagggaggggtcggccgatcgatgcatgcgccggtgggcccaagagaagtggaggcagccttccccgagcgattggagccaattggagcctgtataggagaagtaaaatcctccaggaaagcaagatcagtagcacaagcagtgtcaccagtcatttcggcaaagggatatgtatcctcatcaaacaccacatgccgagagataataaccatgttggtgatcggatcgaaacaccggtatctcttacgttcgctagggtatccaagaacacacacttggtggaatgtggcgagagtttgtggggtgcggtggcggataggttggggtaacgacaaccaaagacgcaaagatgtgtgtatgaggggtggacaccgtgaagggcgaagtagggagtgtgttgggctaaagttttggttgggtgagactcaacccataatgagccggggaggtgagcctgaaatagaagcgagcgtacaatgttattaagagaacgatgagtacgctcagctttacccttttggggcgaggtgtgtgggcaggaaatgcgcatggcgacgccgttggtgaggaagaaagatcgagcggcggagttatcaaactcgtgaccattgtcgcattggatgttgcgaatgggtgtagcaaactgtgtcctgacataggcaaaaaaaatgcgaaagagtggtgaatgtgtcggatttcaaacgaagaggaaatgtccaaacataatgagagcaatcatcaagaatgacaaggtagtatttaaaaccagacacactgagaactggagaggtccacaaatcacaatgaattaactcaaaattggccttagccctagacaaagaagtagcaaaagataggcgtatgtggcgaccgagctgacacgcatggcatacggtggaggagccgcatttgggaggagagatgaccaaggagtgagcaaaacgggtgagggcgtcgtgaccaatgtgtccaagccggcgatgccagagtgtggtggtagtggcagcgaaggaactggcaatggaggtgaagaagttcgccagaaaggagtacaagtcaccgaagctattgcacctggcgatcacggtcctggtaagtagatccttcatagtgaaaccaaacttgtcaaactcaatggagagattgttgtcagtgacaaaccgacaaacagagattaggtttttgataatgttaggtgaaacaagactgttattgagaacaaacattctattagcgtgaagaaatgaagcattgccagactgctagtagcaatgatgggcaaaagagaactgttgccgacgataatgtgggacagagtggcgtaggtaggttgggtgagaggataggataccggtgtccgatgtcatgtgtgaggtggcaccggtgtccatgtaccagccgttggaggcaggcgtcgtgagggtgtcggtttgaaacagacttgccaaagtctgttggtcccaagcaagtgttgggctggaggctccgtaccaggacgttggttgggccgatggctgcagttgttgttgctgctgagtgaggccggctggaaggtaagggccggcctgggagaccggctgcgggagggcagcttgcccaccggacattgccacgcccgcaaaaggagaagtgggccgagggcccaaaatccctggagcacgcagcatcgggccgcccagccacatttgaatcgtgccgacccaggggtgctgaggagtgggccaggcctgtccagcgcgaggctgaggggcagcctgccctacgctttggccacatgtgccctgagcggcgccgccattgccgccggcggtgccgcccccgttcccgttgcgtcgacagcgatttttgttgttgccgccgccaccttgtgtgttgccgccgccttgatttaggttcccgaaccccgtggcgtgcaattcatgagggcggtggaggagttggtggagcggttggaggggcccttgttgatctcggtgagaattagcttactcgatccgggcttcgacgaacatcgggaagggacactgcagaggaataatagtttggagaatttcatatttagggtttaaaccaccgatcattgcaaggacaagttgctggtcggtgacggggtcgccgagctcaccgcgagtgtcagccatagccttgagacgtcaacagtagtcgttcacgccgaggtcaccttggacgaacgtgtgaaattcagccgtgaggttgatggcgcgctgttcctagtggccgaggaacatctgctcgagggagagacagacgaggcgtgcgttaccatcaggctgaatgatggtctccaggaggtcggtggcgatggtcccatagagccacgagagcacgacacaatccgtccgagcccaggacgcatgatgaggaaaagcgtcgtcagagaggacgtggtcggtgagggcatatttggtaatttgcggcgccaaggtcgaggacgacggggacaagcaccttgacattgagaacagacaccgcctgggcatgaagggcatcgacagtgtcagaggttggcagagcgcccccggacatggagccggcgggctgttcgtgctagggtgtggctgatcggcgaccaaccgcgcgggcctgcacccgtgcggtcagtcctgcctgccttagtccattagtacaacaactactgctacaatactactactactactaatactactaccactagtacattattactactacttgtaatactagtactattataattgtttatatatatatatatatatatatatatatatatatatatatacacgtatacaaagtttatatatgatgtatacaaaatttatatacacgtatacaaactttgtatacgtgtatttttggtttttatatacatgtatgtataaaaataaaaaaatacacacatatatataaactttgtatacgcgtatacaaacgttgtatatgcatatacaaaagttttgggtttttatttacatgtatgtataaaaataaaaaatacacatatataaactttgtatacgcgtatacaaagtttgtatatacccgtatacaaactttgtatagaagtatacaaagtttgtatagacgtatacaaagtttgtatagacgtatacaaagtctgtatacgtataaaacgaaaataactgaaaaagatacgaaaagaaaaaaacagaaaaaaccaaaaaaaggaaagaaaaaaacagaaaaaagaaaaaaagaaaccgtccaccagaaaaaaaaaatttccacgcgccgtcctccaccctcctccccgcgcgcgacacgcgtccagtcgcgcgggggagggggcgcgcgactgaacgctaattagcgttctcgttcgtgctgtggtggttgaaggctgagtgcagcgaacaggctagcgtggtcggccggtgaagaagagccgaggccgatgggcggttgcgtggtcgcgctggctggaggaagtccgagggtggcgcgaagagccgcggcgtcaacggtgaccgttgtcgggaaggtagaacttgacgctgtggccaccgtgtcgttgataggcgtgatgacgagagcagaaatcaccgcttggacggccttggcagtcgcggccgaagtcgcgtcgatgagagccgtggcggcggcacggtcgtcaggtgaggccgagtcgtcgggccgaaggacctgccggatggcagaggtggcggcgtcggtgatggaggcgaccgccgcggtaagagccgtgtcgtcgacggactacatgggcgccggcaggagagagagccgtcggcgatgaggttttagggtttagcggaagcgattggatcgggagtatctgataccatgaaagcagggatagctcaacgcgatatcgattaatcacggaacatgtgtacatatatagctacatccataccagaatctctcaaccgatgtataacagaatcgggaagattggataggagatcggcaaaagcagaaagaagataaacatgctattttatctttaacatatttgatttacaagacttgtcaggggcctaggaatgccttcagttttcgactttttacaagataatagtgggtaaaatgagaatatgcttgcaattagtacttgcctcataatgtaattagtaaaacaaaatggcaaaatttgctacaagacacacaaaaaatatgtaattagctcaccccaccgccccgctcgcgccgacctcgccgacctcaccctcaccgcgcgcgttcccggcgaaggagaaaacgaagaaagagaagtggcaatccgggtatttaggaaaatatctcatctcttttgacccagaaataataaaataatacgaccagtgtcctaaaaccaattacacaatttttgtagtgtccatcagccatatcacgttttcgcggtgtctcccagctaatcccagctaattacatgttttttacgtgtcctgtagcaaattttgccaaacaaaattacccaaatggtggactgattctcgtacttataatggtagaatttcctttcagtgcagttattggtcttcagattgagcaaaattattgttctctctgtcttgatcttcagtttgagccaaaattacggttttctctataagtcatattttgcttatcgaggacattgttaaatgtgccatggcattttagcatctgatacatgggcttctgatatatacacatgctgtgctagccattacctctaaccatatcatgttatttaatttatagcacatgattgaaaatgtattttaacatgaatgactcgtaacgatttagaatttttctaatttatatttaataaaccatggcaaaataatatggtattttaaattttcatttatttagttgcattgcttgagaatgagtttgagtggtttggttggattgtctaagtgcaaatgctgctgtcatttgtggaaattggaaagattgttctttggtgggggttcaacgtcactctttgcaacagaactaaaagcatgcataaccaggaggatatatagcagttaatcacataattttcttattattttgtttgttgctctttcatgtcagatacaacatgtgttcctgacgtttcttacacttctttgtgcagatttctcatcagggggatatgttctaagctcaaaactgaacatttctatatcgctaatatatagattatgtattttgaacactgcaaagtgttattagtaaacctacaaaattacaagattaattaaaattgacttcatttattagatacaatattaacaaaataggtaagaaaaaataaaaactgaagatcaatgtttttagccatttgttaattacttaatttcatgactccaaaacgaagtttagtttggtcttacaattttatatggttatctaaattctcacttatatgtgtgcgttttaaaagcttttgagtattttttgcaatagttttcaagtttatagatgttttcatgtaaacccttgtcactagctagagtcaggcattcattactccatcataccctggttctttcccagcggcggtgctaattcaatcccaccaatataccgaaaacacaacacacctatgccctctcctttctcgtagcaaaaagtattggcagttcgcacttggtatatctttacctattactagtaataatgcccgtgcaaggcacgtttttccaatgtatatttaaaaaagtaaaagtatgggaagaaacagtgcttgcaagggcatatttatacattgacttcaaaaaaaatggcaatggtatgtccacacattgaattcagatacattccatgtagttctaaaaaaaagatactccctctgtttaataatgtaggtcattctagcgtttcccatattcatatggatgttactgaatctagacatacatatatgccta

SEQ ID NO: 40242 - DNA, 32060 bp, Oryza sativa
cctacattatgaaacgagggagtacattccatgttcaaccttaaatgataataggagtatattgtttacacatattgcaatggctaaggtcagacactaaacccacacaaaccttacattgtctggagaatttctaaacttccggtacttgagctatgagaaattcataactttaattagctcacagcaaattaaaacattgaacaatatttagatgcttgtcgaagttcagattctaaattcagatgctcctacatcataaggacaagtcagaaactaatatgccaaatgctcagaaaataatatatgaaatgttcaatcactaatctggcaaatgttagacatctatggttcacacatattgcaaggacaaagactccaaatatagaaaatgaatagcatgtttgaggtatatataaagaatttgtcatcagcatgacagaaaattacagcatttttttttgtttttttggaggacacaacatgagatgtgattggaaatttttttgctcctaggaaatttgtaacaaaaaaaaggaaagtgttccacatttctaaaggctgtcaggaattattaactcagtacataaccaatagttcacagggaagaatagaaacaatacattaattacactacacaggatgccatataatgcaaggacaatttcagaatgttgtcaaccaagttcttgagcaatgcaagcccaagttcagaccatgtaaaactaaattcaaattcacatataaagttgtatggcacacaaagactataaagcctcctaattttggttggagcaacagcaaacatggttgggtagagttcagcgaatataaattcaataggaacttaacagtagattataaggaaaatgacatgtaactctttgaattgagattgagcagagagaaccatcagcatacataagtaaaatgcaaatttcagataattcacaaatagtcaatagtgttgtggtatgcatgtggcaaacaagaacattcaggtagataattttgggatttcatatgtgtacaagcatatgaatgtcaaatattattctgacagggaattatgtgtaagtaatggcgtccttcaaacctgcaatcgtgattaacttgctccacttaagtcatgtgcatcaccttccctgatgccatcctccaaatctacaaccccgattaactcgcttcattgaagtcatgtgcatcacattgcctaattccatcctccaagcatgtggtcagagatgccaccaggcttatatgaaggttgcctcctctcacaaagaaggaaaaaaggaccgcctcttagcagcatgtgacaatggctaggataatcccggatcaatgccaatataaagatgaaattatgcatgttgtagcagtgctagacttctggagcatcatggaatgtgttttggtcgtgtgcccctgggtagaggttggggctatagcacatacttgtgcctcaaaataaaatatcttatttttctttaataaaagttcatctgtttggagaatatatttgtccttggatctacccaaaacaaaatttgaagcgttaggacaaaatcaccaaaattttatcaattcaccggcagctgctagctaggagcacataaggcttgttaatgaaaaagtaaacactcaaattcctagcccagaaaaaggaagaagttattcctattcagaatcagagttgttccatgcccccttgcatacactaagctgagtttctttaatatgtttatactacgcaaatatatgtatgtaccttatctgaccagtgaccaataaccatagtaaaaattagtaaaaacttaaagcaaagaaataatcctgcatatatgaatattacctttttgttgtgcctatggagtatattaattcatatatatcaaccaaatgccaatcaatgataaataacagaacaaaatctccttgacccttctcatagagcatcttaaagccaaaagccatcatctgacaagggcctataaaaaatgccttccatcctgttcacccatccccagcatatccgtataagcttgtattacgacaattttatagtatccctagctaaagaaatcaaatggtggaatgcagtatcacttgaacaattctcaaacctgtacaatataatttctctataaagtaatctggaagagacgcagcatggcaactacaagtctacaatgttagtctgaatggagcaacaccagtcaccttgataggatatagcctgcaatgatgcacatatggattgataagaaccgaatcacaccattaagaggagagatttaatatatgtgcatacccttcagctgaataagaatccacacagaagactaatggggattcagaagagtcaatttgagtcaatggggtctcactcgatctcaccagcagaagaaattttgacgcacggctggaagtacctacggcagactatgcccctcgtaacggcggcaagaccggaggcgcgacggaaagctggaccaccggagaacgacggagcagtggcgctggcggaaggctggaccaccggtcggcgacggggctgtggcgccaacggaaccctggaccagcaggtccaattgtggtggcgagcggcacggaggcggggcggtggagggagtcaccggcgtcgtcggcgaagacgggagcggcatcggtgacgacaggagcagcggaagcggcgacaggaggcaggagccgatgcggcagcggtggatggaggcaccgcgcggaaggggaagaggcggcgacgagagtattttacctccatgccattaagaaagttgaaggttacctatatgccaaaaaaaaattttgagtcacctatataccatgacacaaactttcgtttacctatctgccattccatccatcttttgttagataataagctctgacatgtgggacccacgtatgaaaatgactaaattgcccctgaagcattttcatctctgctcctctcccgagcaatttcaccctagcctagccgccgcctttatagccgccgccggtcgtcgccggcgccggcacgccgccgccgctgcctcgcctcgtctcgcgtcacctcgccagatccggcggcgcgcctaggccggctcccccaggccggctcggtgccgcaggagtacctcggcaactgcctccgcccttgcttgacatggccggcctgctcggcgccggcggcgtggtgacggcggcggcgggcatcggcgccgccatcagggggctcgacaacggcgttctggacggtgccgatgggtggttccagaagatcgtgtcgctgatgccgcaccggccgatgtccatcgccggctcgcgcggtacgccgtgtacgacaccgacttcgggctgggccggccgatgaaggtggagctcctgtccatcgacaagacgcccggcacggtgtccatggcggaggcgcgcgacggcagggtcggcatctagatcggcgtggcgctgccggagtccgacatggcgcggttcagctcatgcttcgccgacggactgaagcagctgtgaggacgaacagcttgttgcatttattgctttcttgctgctacatattgttgcagagttcagagtttgttcagtttgggtgtgattctgtaatgctagctgttgcttgaatgttgatcctataaccaagtattatttctgctttttctttttttttttgcattttcttacttatgcacgcattttttttccttatctttttacgaattttccttattttttcatatgttcatatttatttatgattttttaaaatttatttacgaatttttttcttatttattcccagttttctatttatttccataattttaaaattatttactaatttttccatatttatttcttgttttaactttattttcaattttttagaatgtttactttatttcattttccttcaacctacatttcagcctttatgcggtgtgtgagccgatttctctttcaaatgttcaatgtttcattcaaagtggctgaaatagagcaagggcaaaataaacctttaaacctccattagtctccgttagtgctgattccatccaaagtggcgcataggtaaacgaaagtttgtgtcatagtatacaggtgactcaaaacttttttgtggcacacacgtaacctctaactttcttaatggcacaggggtaaaagactccggcgatgaaggcggagaaaattgtgtggtggaggttggagaaaaaggacagcatgccactccatatggtgggtttcgacaaaatgccacccaatatattgcaaaggataaaatgccactcaataggttatctttaggatattttaccactttgaggaggtttaagacaaatatgcccctactttggagagagagagaggaagggagagagagccggagagaggagtcgaacggcagcggccgtggtcgtcggcggcgggcagcgacgagggaagaacgagcaccgtccgtgctcccgctagcagcgacgaggagagaaagaagacgccgataagcgcacaggggtggcaccggagggggtgagcgcatgcgcgggcagcgctgcagagccctccacgtcatcgtcgtcgcctcctcctccctcccgtcggcgttgcccttctccccgatcgccgccgccgtcttcctcccaatgaccacggccacaggcagcgacgagggaagaacaagcaccatctgtgctcccgctagcggcgacgaggagaggaagaagacgccggtaagcgcgcgggggtggcaccggagggggtgagcgtacgcgcgggcagcgctggagaaccctccgcgtcatcgtcgtcgcctcctcctccctcccatcggcgttgccctcctcccccatcatcgccgccatcttcctcccccatcacagtcgtcgtcttcctccctctccgccgccgtcttcctccccctgtccacctgtcgcagcccacccccgtgcgctcgccacccgccgccggcgagcattagcgtcgtccgggtcaaccttccgctcctccctcttcctctctatccacggccaggggtattttggtcttaaaatctctcaaagtggcaaaatatcctaaaagtaacctattgagtggtattttatcctttacaatgtattggatagcattttatctaaacccaccgaatggagtggcatattgtactttttctcgtggaggttgggaggaaatcatgcgattttgtttatgtattcgagtcatggtatccacagtgtgggcaaggcgatggtgggaggtgggacagattttgtttctgtatccgagtcatggtatccccagtgtgggcaaggcgatggtgggaggtgggaccgtgggagggccgtgggacgctggggatggagtatagttgatttggcctataggatcggagtggtgaactcctggattggagtggtgaactccttctttttatattagtatagataaaaattcaaggtgtttttgccgaaaaatttcataagtcacccccaaatggaaatagcgctagggttttttttcgcatggtctttttttcaacttcccaatggcgcacggttttttttactccgcctccagatcgctcccaatattttttctcagatcgatcgcatccgtagcacccaaattttatgtccgattcccaccccgatagctccctcccaaatatatacctaacctaattaaaaaaatttcgtccgcaacatcataagtccaacaaacaacaaatcatccagagtgcgcatcaaataacacacaaagttttaatccagtttatgttagatcccaaatataagaatagaagaacagcaaacggagataaaaaaaacaaatcgaacagaaatcgagcagatttttccatagccgcctctgctgccaccgcctcccatggccaaaaccggtgaaggggcgcggagtggccgccggcagtggcttgccgagctgcgctgccgacgcccgccaccaccgtcgtttcagccgagggagggaagcgagagggggcagagggagccgccgccgctgtcgccggatctgtcctccgcagccgccaccaccactggatccacccatggccgccgcgaggccgccaccgccgctagatctgccgcaggagggaggcgagagggggcggagggagccaccgccgccactgccggatccacctcctcccgccgacgccgccaccgccaccgccaccgccgccggatataccgcgggagggaggtgacaaggggttgagggagccgccgccgccgccggattcgtgccggaaggagagcgccgccggtggaggaaggggggagtggccgaggggaagcggcgctgctggtgggtcccctcccagtcgccgcgccgtgccggtgagacaggaggaagagggggagatggagcggtggcgccggtcaccggtggagggagggggagggggagcggcggcgctggtgggaggaaggttggggagaggcgctgccgccgacgttgttttgagtgagagagagatggggaagaggaaatggttttagggttagggtttgggctgctgagtatttgtatagatcgggatcaatcaggaccgtccatcagatcggatggctacggcttctcccgcgtcgggccgggcgccgttcccaggccgcccacactattgggccacatgtacgctccgcacaaataagtttactttatgtcgctcaagttgtccccgaattgttcccaggccgcccgcactattgggccacctcatggaccgcatgtacactccgcacggaataagttcactttaggtcccttcagttgaactttttttatttcaatatgtaaaactaaaccttaatcatctaatatttttatatttgttataattttagtttttcgttgcaacgcacgggtatttttatagtatatacagaaatcagaaatgcatgtactggtacaaactcttcctaggttgcaaatttgctcgactatatatgaattcttgtagccgcactgttagctagcgctaaggccatgattgagatagctaaacacgttggattgatggataatctattttttttatgatatctatttaagggataaacgaataaattaactacaacaaagttgaaaagatgctttagaaaagtattacaataaaaattatattataaaaattttgcacgaaacaaaccatctaagagcttggaagcatgcaaacaaaaacctagaatccagaatcatgaaagaacagggcctaaaagctaaagctaccaacttggggtctctcagccttgaaacataagaatgtacttgctctgagagtttgattgaagaatcacagatctctgatgccatcaaatagtactgctagacttctcttagaaaacaaaaaagaaacactgtgtgctagattagcctgttgtttggatctaccttaattttaattttaattgtcagggagataaaaaaaagaaagagaaaaggaactgtgcacgctgcacacgggcaatcagggagggagggaggtttgggatgtttttctgaatgattaatctaatgacctaaaataatgggttggatgtttaagttaaaaccaatgataatatgttttgttttcctatcatcatttttaggatttcgtctgatttaagagaacaacgtaacatagcgtttatagaatgtataatgaacttttaaaaccgcatgctgcacggaggaggaagtgagggaaggaggtttaggattttttttttaaaaaaaaatagatctaacgacctaaaataatgtctcaattgatttaaaataatgtgtccatcaatttgagtcaaaactgattgttggatgttttgtttttgtccataattaagaacatcatgtagcggattagaagcgtttatacgatgtttaatggacttttagcatacgatgtttaatggacttttagcactgcatgggggtagagggaggggaggtttgggattttttttttggaaaaaaatagatataccaacctaaaataatgtgtccatcgatttaagtcacaattttgtggatgtttttattaagaacttaccagattcttctctaatttaataatgttatgtagtggcttagaagcatatataagatgttaaatggactttaacatcatacacgggcggagggagggagagatgtttgggttgttttcttttattaaaggaaataactaacgacctaaaataagaaactgatagtcgaatactttgtttttcttagattttctagtattttatctaattcagtatcaccacgtagtgagttagaaaacattcttaaaatgacatagggagagccgctagacatagtagatagaggtctatttatgggttttttgcccataaaaataattttaatttgtcatgaagataataaaacagatgaagtaatgcaaggaaagttcgggatggggtttccggttttttttttacaaaatagatattactgtctaaatggttgaaaatcgatggtcgatttaatttattaaagtgtcatttagcgaattaaaagtgtttgtagaatagcacttaacgagtcaaattttattatatgctagcaaattgcccgtacgatgctatggaaagaattaaatcaatgcaacaataacattcggaaacaataacattcggaggaatcaaagtcctgctttaattagctattacatcagtaacaacccgcggcccccaaatcccgtcgccctcctcacaatcgactccctcaccccgattcaccactggtctcctcctctccgctgcacaatcctccctctgtcaatcgcccctcccaccccttgccctcttccaccgccgactgtcacgtcgctgccgtcgtgttatcccgccgccggtactgtagatccccgatccgttgcccgcctccactcagctgtcgccacctccacatccgggaagacatcgtcaccaccgcctccgtccgcgctgaccccatgctgtccatacccacacaccgccggtccagtgcatgggcaatgcttacagcgtagccctatactcctatattaatcacagtagggtaggtagtacaaacaaggtgcatatcagaaagcgctgaccccacgctgtccacaccgacacaccgctggtccagtgcatgggcagtgcttacaacgtagccctatactcctatattcatcacagtagggtaggtagtacaaacaagtgcatattagaaagtgattttgcacttcaaaaatatctatttgtgatatattatatagtgtaaatcaagtttaacatatatgagtcagtggcggatgtaggattttataaataggggcacgataaactaatctatttataaaacaataaattatctaagtgttataaaatattatctctaaagaaatgtaaaaaatccaatacatcataaaaaaactagactagaaataaactaaatcttattttttatatgtagatttcattgtaactagacggtaccccgcgcgttgccgcgggtgcgaacatagccatatatggacatagatgttatattcaattttatttgcaaccacttatccaatcaaatgtgcaaacatcacatagatgggcaaacatgctaaacttgattaatttattttatatgtataactgacttcacaagtcccagagatgatatgaagggaactcattttacatgacaaaaaggcaagatatatatgaaaggatatattttttttaatgggcatcaaagtgcctaatatcaagcacagaggtaacatggaaaagaatcaaagataaaactcttacattccatgatacttaaggtctccagaatcatgaattaacttggaacagggaattacagcttcaattgttggtgccctaaccattaaaatttcctttctgaaccgctgcagtttaagaaaagaacaaaaataaactcataatggtgggtattggagcaaagaaagtattaatctctcctgtagttcctcaaagcagtgcttgattatgtcaaacattacagtttcacttccagtcaacacagagccaaagaaaatacctaagaatattgcaaggtacagctatgttacatgcaagccatgtcatgccactttgctgggtcctctgaaagcagttcaagtgttaattcatatgtaaagattagtatctattttagtttttctctttatacctatagattagtatatatgttataatatcagtaattcacacctaaattatattagtatctatgatatgttctaatttacacctaaagattatactacctccatcccaaaatgtttgacgccgttgacttttttaaaaatgtttgaccgttcgtcttattaaaaaaatttaagtaattgttaattctttttctatcatttgatttattgttaaatatacttttatgtatacatatagttttacacatattacaaaagtttttgaataaaacgaacggtcaaacatgtttaaaaaagtcaacggtgtcaaacatttagggaaggagggagtagttatgtaaattaccaaaaagggaaaaatattgtgcgcagaaaaacccgggacataaatctgagatgccataaaaaaaatatatgccattacagtcgctgaatgttgcagaactacataatctggtagaaatagaacaataagttagatagtggagtcatgtttcatttgactgataactatgcaatacattttgagctataaggagaataagatagatgctgctagcagttcagtagtacctcattgggcttctatcactctattttagttcaaaagaaatagtacatgcagttggctgctacgaagccttgatgtgacaaacaaaataatttcatatttctagtatgaagatatcagtagtttagcaacagaatgtaaggataattagtacacgtgcttgaagagaccacgaaattgcagcatgtcattcttgccgaattcctgcgtttcacctcccatgcagctgcagagaccaagacagtttgctcatgagtgaaattaaggtgcaaaagataagtagaataaaccttcagtgtttgaactggattgcacaagcagtggaattaatcctaacacatagatatgcatgtttccatatagagaggtggaaagcaagtcgactaaactgcacatatggctgtgttctgaacataacctgggtataagaagcatcacttcagctgcataaaggaggcaggggcggagctaccattattcctgggtattcccaggaatacccaactttttttatcacaaaacaagtatacttctagtatatacacatgtacacatattagtgcacctaaatcctcaattcttcaatccaaacacagcccaaccggcctcttgcgacgcctccaccaacccgacccattccgtcatgacccatcagacatcagttgacccacttatccaccacccttctagacggccccctcttgctctctctccgtgacccatccctccctggctcggctcccctcgcgccgctccccatttccaaaccctaggcggcggcgcggcgaggcggcaaccggcagcgggagctggaccgtgctatcgcggagggggaggccattgccgtggcgagcggtggccgacgcccgccactccgccaatctcgggcggtcaggccggttgggtggccggtggccacgaggggcagggccagcgcctcagcgcttagacgggaatacccaactttgaaatcctggctccgctactgaaaggaggaagatgcacatgtttttttaatttgatgttgttgccccgattaatcaaaaagaaactgaaatagcaatcccacaccatttgctagacccatgcaaacagatggacttgctttctatgcataagaatgttgtggagaacaaaaatgtctgcatactgaatctataactattatttttacttttatatgtagatagtacttaccttggaggtaaaccaaagaagttcaattctataggtagaaagcactggcaacatagctgaataaattttaagaccgcatatatgtgaaccataaaagtaagcacaaaatagaaggacatctgagcaagcattttttcctgtcaatccaatctaagtgctgttttggcacaacatatctaccagaagtgtttcttcagtggaataaacctatttatcaattcataagagcacagctgaatgtagcacctgtactatagcatcagaaagttgaaagcatgaggctacgagactgtatggatagaagtaaaataaagtaaaactaaaagttatagttagatcaaactaccttcgtcaaccaaaacaaagccacgagtcttgcactgcaaactcaccagccaatcaatacttgcagatcacatttagcagagattaagtgatagaaaataaacacaaattaaatcactgtgaaaaataaaggcataaaggatggcacaaactcaacctgaaccctaggagcaactacgacggtgcgaaatcaggcaacggcgtggcagccgaggtagacatctaacgtggggaaagtttataggacaaaacaatagggtttattaagcgaatggcaacacgggtgaataaatttgagcgctgcatagatggaaactatggaagtaagctcaaacataaaaatatatctgaccaagtaacttctttgttgccaagtcagtctaagtgctattttggtaggtttctatgaaaagggccaaaatatggtctaacattgttaatgttatgataggacactctgcatagatatcgattgaagaacacatctcaacaacatatggatttagaatataagaacacgtgaatataactctgatggggtgacatacatataaatggtaggcaattgctattatatggactgatagagaggattttgacattggactcataaatcccttccataggaatgtgccatcgccgcccatatatactctttgcttgtctgatgcacactgcagacatttttataactataaatatacataaaaggctagtgaattaccttcagtcacacttgtccattgtactttgtgatacggaccaatcactgtagtaaacattcactaaatcagttaattaattaacatgtaaagcaagacataatggctatgcacattccaactggagcatgtgtatctgaggaaaaggtaatcaacaaacagaacatacatatgtgatcttagtgtttgtgcttaaaaaaataactgcaggtatcaacaaaatatgtcattctaacattgaaagttcataagcatattgtaggtaaaacatatgtaacctcatatctttagacttgatttacctcatatctttagacttgatttaccaacaccatagaaaaatagaaaaataaagtacaggctgccgctagtcatgcaaagttgatatgaaaaagagaagtgagaaaaaggattgcaaggagaactgaacaattaatttgaggaatccaatcagcaggaacacccacgtgaattttcacgttttggttaccacgtgcttatgggcggtcgatgcaccataaatcttgcaaaaccaagcctgcgaggaatgcagggaggagataaaacaacggctacagttaacactgtgacccgcaagaagacaccggcatccgcacctagcacgatgggaagcaacgatggtgatcactggccctgcacggagacagcgacggctggccctgaaagcctgagaagaaggcagcgactccggatccagccccgcgaggtcgaggggagtggaggtgctgaagagatgccggaggagcgacgcgagatggtcaccgggggcgtagaagaagctcacccggccagccgcggcggtcaagaatggcggtggacggcagtggcgttggccgcgacgaagcaggaaccctagcaggcggcggcgaagaagaataggtagcgcggaaggggatcgacagggaaaccaaaggagaaactaatcgcgacctcatgggagggtagaagcagaagaggagacggatcgttgacgcgtggcagatcagacaagaggggacggatagttgacgcgtggcagatcacacaagaggggacggatcgttgacgcgtggcagatcagacgaagtagacacgctgactagctgttggctgaacagtagtatagtaaaacagtaccatgggcaaaacttgtaggcaaaaactataaggtttatatgatgtataggcatgtactccctccgttcctaattgatcatcatattatatggatacaccaaaatttcaaatatgaataaagaattcatggtttaagttgaaagtttttaaatttaagttgaaaattttcaaatttgagttgaaagttttaaaattttgacttgaaagtttaaaaatccgagttgaaagttttaaattttaagttgattttttttaaataattgaaatttaagttgaaagtttttaaattttagttaaaagttttcaaatcttaacttgaaagtttgcaaatatgagttgaaagtttcaaattagtgttgaaagttttcaatttggaatatgaagtttctaactttgggtaatcgaaagacttaaattatatttgaaaagttacaaaaaaaacaacattgattatgcctaattatccgggaaaagaaaacaaatccagaactaaccaagctagtccaaatgctaatcgcttttttttgtatcggttttttccatagcaccgctcgtgcgttacactaacgacacatgtccgtgcgcgccagtaactcatctcgcgcgtacgcgctaattagtcttctcgcatttactcggataacaaactcgatgcatgtaccatcccattatttcctagccaatagcaaatcaaaacattgcatgatggttataaatactttgtgcaaatcaaaacattgtataatggttataaatacttgtgtgcatggatatcaatgtacatttatcgaatgcacaaataacgaatagacttaatgaatgaatacaaatatgatgatcatttggaaatattctaaaaaaatatatgatgatcaattaggaatggagggagtaactagtaaatagtgaatgtcataactcactcgaacaatatatatagtgcattatgattattggattcataacaagtgttgatcactagttcatccaaaaaaaaatatgactatatcgtttaatattattaacttttatagcattctagataatgtttagcaaaagtatctttctcttaaaaaaactagtcaaataccttttataaatataatatcattaacaaagataatagttattgtttcctcatgtaaaaacatagataatatatattatggagcacacacacatgagctagttgctactccctccgttcctaaatataagggattttagttggatgtaacgtatcctagtacagcaaatctggacaggctttatgtctagattcattgtactagaatgtgtcacatctaaccaaaatctcttatatttagagacggagggagtagtattcatgtgcaagtaatagtgctggttgtagtaatattattatcaaaaataaaaaagaatgagaaaacaagaagaagatgaaacaacagaagaatagaatataaggttaaagtttttagtttcacaccatttactacaaagaacaattttaataatattagtatattatcgattaatgtgagtatataccataccatgaatgtgagcaaccaccctcatgtgtttgcgctagtgactaacctcctctttttcttacttctttcgaagttctttgaacatatttaggtaataatgttttgttttgaataaaaaagaaacaattcaactagattattttttagagagaatccatcgtgtgccgctgactttgtccctgttctataatataccactgagtttgttaagttctacagtatgtcattgtattttgcttaaattctataatataccatcaccgtccatttaaattccattagtacttaattttgtcctaatgatcgaaatatccctaggaaaaaaatttccaaaatttggccgaaaattccgaaatatcatattataaacgagacagagaagttgcccatctcaaactttgtaagttttactatctgtatgataaaattgtataatgctaactgaggccaactagatgacaatggtatattatagaagttaagtaaaatgtgatgccatattagaacttgagaaacccaacgacatattgtagagcaaggacaaaatcagtgacacacaatgaattgtctctgttttttatagttgttcggttaactacctatctactatgatgcggcaattttagaaaaaagttaaatcttatactataagtccatatcttacacattaaattacatacacttataatataattttcaaaatataaaataccctattctcattttataggagaaatatggaaaatgatttattatctatttaattatgagaaaaatattagttcaaattaacatatatgtagaaaataaaaaacaatatgaaagaattatggaaatacctactaatgtagtcatcatatatcatgcaatgagaaaagaagaccatagtcgaatgctttattattgagcaaaaatgatggtattatttttatcatcttttagaggaatctatctaaccataattaattagcccgtgtgagtagaagtctgtatcgtcatgcatcaatatatcatgagattattagttatagctaagtacaccgacccaaccatacttagcatatcacaagactatcgggtaatggacaattatctttaattgtgctagagaaaaaagtactccttccatcccataaaaaaccaacctagaactggatgtgacacatcctagtaaaataaatctagacatgcatatgttcagatttattgtactagaatatgccacaccagttctaattcattttttgtgggacaaagggagtaaattacagtccatactacgtattcttaaaaattcttaaaagcttcatataatgttattctttaaccattctttatatttacacaatagctaactttacatttcaatttggaccaccttattctatccatctccaagtccggtgactcagcaattactccgcacattaactatctctctctctctccattttctttttccctccgatagttggataaccgatagatctagcaaggagcctagatatagttccttcgctctttgttaggtcagctcctacctcccaaagtccatgtaagcccgacatccccgacctcaacagcaaccataacaatagtgtgcatcacgataggagaggagaaaaagatttgtcggttactaaagggtaaggctgcgcatgtaaaggcaaagaggaggaacgatggtggctcatggagaaagagcggtgatggcggtgcagttagtggttgctggtggtatgaagaatttgttgtcgacacaatcacttaattttttcttaagtattgatgatacatgggtcaccagttatataaagaaatagtcctagctagttttaaaataataaaaatattgactgaattgaccattgtttcacaatggaccaggtcatggttagtcttttcaatttaggccatatatctttgcaattatttgcaacatggaccaggctgagagagttgggctggctgctaagatgacttttctactccagccatgtaattaacatcacgataagctcgagcgagcctcgatcatcacgcaaaccagaaaggggatcggcggcgctggtgaagttaggagaggaggcggtggccaggagcacaggacagtacagcttagagaaagattagagccacatacatttgggaggagttaatggattgattcatgcttgctttctcggttattttcccagcctccacctccagtggctgttggcgccgctgccggaccgggacaggtaacgggattacgattttcatttgggcagaagcaacggatgatatgattaacaggatgttatgcaggctgtagatcgatggtggaagcgcacgaagtagaagacattgccacttaattcgcagcgtggccttattcagttcatgatgcagctcacactagcattacaagaagatcaacgccattgccagtatgcctggcattacctgccggctgccgccatgcttcggagtggatggttcaccgcgcccgacagcgcgtcggcgagggtgtgaggctggataatggattggctaatagggattggtacttgccgtccaccactcacgctgttggcacaatctcctccggcgttgtcgacgtcggccttgagcccgccctacgagagccacttcatctctctactaagtaaacgcgatgttggagccgcgctggcagtgaaaaacctagattgctatacctggtccaagcaatgttaagtgaaaagtttggtatagacatggttcattatgcaacttgggtaatagttccttctttttcataatgtaacttactataccatagtgcaatttactctaaaaatattgagaaaagggcgggtatcgcgtaaaagaaaaagaaaaatctaagtctcctccgctccttgtgccgccgccaagacgaacaggggagggccgggcggcgagacgagcagagcagcggaggggaggggatcctggtgagcatccgcgtgccctttctgattcatctctctctctctcccaccccaccgggactggaatttgcttgcgttcgtgaaccctactagcttctcttctagatctggaagaagctcttttcctcctccttaatttgatagccttaaacctctcttaattcaagtaataacagtttgtttcttcacccaaacccccatgtcccaagttggatccgccgctgatatgagtttgtggctttcttcagtatagatgaaagttctcaaatatttacctgcaggggatcttaagtttgttgttcagttgagtctaggcagagtagctccgaccatggtttttctgccatcatgatcaactaagattcggttcttaaatagtatattttagaatcaaccaaaatacagtttttgcttatccttcttatatacttgatctcgtacgtttccaacgtgcacttagatatttgatctctcaagttctgaacaattaatctgcaagggggaaatgacttaactttttatcacttttctctacatgtttataattaaagctgccacaatatgaatgctccatatgtaaatgaatctgctgagtccttcttaattggtcataaggatatatttacaaaatatgtccactcatagttttttcagtgtacatgtatgagggaataacatattgagatgcttatgctgagggaagaagtgctatttttttttaaaaaaaatcgtacatgagtcatggctgtacctgacttgatgtgtgtatgatcggttttagcattaatattcaagcaaattagtgcataggtcaagttgattttttcctctataatgatagtttgtggcatttctggtgttcttgtgtgagttgtgttgttgagatgattgacaatttggtacttcctccgtttcatattataagactttctagcattgcccacattcatatatatgttaatgaatctagacatatattaatgaatctagacatatatgtgtgcctagattcattgacatctatatgaatgtgggcaatgctaaaaagtcttataacctgaaacggaggtagtactacattgaagtttatggtgatcttgtggcctgctgttcgagaagctgaaaaataaagtttgcatcacgtaccatgagattatttaacgagatggtcacattttcattgcatcaatgatttgtttatgtgttgcagtcatggaaattaatactggtgatataaggggctatgcttatgttccctctcgcaaggccgccgggtcgccattatgccgacgccacgctccgcagggggcagtggcggctctcccaccacctccgcgccgcagccgcagccacaagcggtggtggtgcgcccgacgtgttcgatgcagtgcctgccctggacgaccgcatgcggtgcagcgcgctgctcagggagcgcgcagtgggaggggaccactacgggtgcacctccctcctccggtggatgctggcccggggacttcgccccaacaggctggcgctcgctgcggcggtcaaatcgtcgtccgcgctccccgactgccgcggcggcgcggcgctcgggaggtgcctccacgggctcgctgtcaaggtcgggtacgcggatggcgcggtggtggcaaaggcggtcatggacatgtacgggaggatcgggtctctcgcggacgcccacacggtgtttgatgagatgagctgctccgacgcggtatgtaggaacatcctgatcactgcctcctcccgtgctggactttacaacgatgtgttccatttgttccgtgcaatgcttgctagtggtgtagatgagagcatgccaactgcagtcacggtcgctgtcgtccttccggtgtgcgcaaagttgagggtgctgagggctggaaggagtatccacggctatgtcatcaagactggtttggagtttgacactctgtctggaaatgctttggtatcaatgtacgcaaaatgtggtgggagcatagctatggatgatgcgcatctagcattttctacaatttgttgcaaggatgtggtttcatggaactcaatcattgcgggatattctgagaatgggttgtttgaagaagcacttgcactgtttggtcagatgatctcagaggaatgccttccaaactattcaacattggctaatgttcttcccttctgttcacttgtggagtatgggaggcactatgggaaagaaattcatggttttgtggtccgacatggtttagaaatggatatatctgttagcaatgcgctgatggcacattattccaaggtttgtgaaatgagggctgtagaatcaatatttagaagttcaaaaatgggagatatcgttacatggaacactgtcattgcgggatatgtgatgaatcggtatccctcaagggcattgaaactgtttcaggggcttttgtttgccggaatggctcctgattctgtttctcttatcagcctacttactgcttgtgcccaagtaggcaatctcagagtgggcatcagggttcatggttatatttttcgacatcctgaacttcttcaagaaacatcattaatgaatgctcttgtcagcttttacagccagtgtgacaggtttgatgctgcttttcgatcttttatcactattcagaacaaagactcagtatcctggaacgcaattctctctgcttgtgcaaacagtgaacaccatattgaacagttctttagactccttggtgaaatgtggcatgacgtaactcagtgggactctgtcacgatcttgaatattatccgcatgagtacgttctgtgggattaagatggttcaagaatctcatggatattccttgcgagtcggttatactggtgattcttcagttgcgaatgctattctagacgcatatgcaaagtgtggctacctgcatgatgcagaaacactcttcagaagccttgcaggacggaacattgttactggcaatacaatgatttcttgctacctaaaaaataattgtgtggaggatgctgagatgaccttcaaccatatggctgagaaagatttaactacatggaatctgatgagccggttgtatgcacagaacgatttgtgtgatcaagctttttgcttgttccatcagttgcaatctgaaggactaaaccctgatactataagcattacaaatattctttcggcttgcatccatctgagctcagtgcaacttgtgaaacaatgccatggttacatgcttagagcatccctagaagatattcatctagaaggagcacttcttgatgcatactctaagtgtgggaacatagccaatgcatacaacctctttcaagttagcctgcataaggaccttgtcatattcacagccatgataggagcttatgcaatgcatggaatggcagaaaaggcggtagaactattctccaaaatgcttacacttgacattaagccagaccatgtagttctgactgctcttctgtcagcctgcagtcatgcagggcttgtcgatgctggaattaagattttcaagtccatcagagagatctatggagttgaaccaacagaagagcactgtgcatgcatggttgaccttcttgcccgttctgggcgtctccaagatgcatacagttttgcgttggatatgcctcctcatgtggtcaatgccaatgcatggggctccttgctaggggcatgcaaggtccatggagaggtcaaaattggtcagcttgcagctgatcgcttgttctccatggaggctgaggacatcgggaactatgtgatcatgtcaaacatctttgcggctgatgataaatgggaaagtgttgagcatgtcaggaaactgatgaaatccaaggatatgaaaaaacctgcaggatgcagctggattgaggttgagaagacacggcatttgtttgtagccagtgatgttcagcaccaagataggttttctatctacgatgtgttgggaagtttgtatcagcaaatcagaggtacacagggagggacagaacatttagttgtgacttatgagctgtgacataaaacactcagtaaattacttggtgttctggccccgtcattgttttgggttgccaaagatctccatggaactgagtgacctttccatcacatcttccgtggtgagcttggaatctcattatttggtttgattctgttttaaccttcttgtcactgttgttcttgatgttttggtgtaacactttttctcacttatgcttgccattgtgcagagtaataagtaacagctactgatgtttttcttggaatacttacactacatatcacttgcagggattgcaatctcatatctttccaatttttttcaggacaacaaatggagacatctgcttacaaccgtgaaccggttggagtgtctttgtcagctcaaaaaaagattggttcctggcgatgcattgttcttcctgaggtaagcaatgctaagcgtgtcatttggaggcgaagcaaaatcccctccacccacaaaccgtgcgaagaaagtatttttcgctccccggaatccgctgtgacccatgagcggttgatggatttcaggggaacagctgacgcagcacagacgtccgaagctagcaaggcatcctcgtcctcacgtacgtccgatctgcccccttccacgccgtggttccgggagctgtgggtcaacgccgacaaatagttgcagccgtcgcctaaggtatgtcaaatcgagagaggagattggacgctgtggcgctgtgttctgtgtggttggtggtgcttcttgggtcatttgcaaacacctcctctaagatagcctgtctgcaaacaccactttcttaatcgagaaggtggtacttcttgattctaattgatgaatcagaaagatggagtctagtatatacaaaatgtggtcatttgcaaagcagacagagaaaagggttgaagatctatattcagatgtgaaaaaggtaagattatacttccctgattccatgcataagtcatctttgaattcctaactcatttccaaatataagtcataacttgaggcaccttttactctcattttttttccttctttgtcctttatgaatacatgttaccactcgtgaacatgtccccactgtgtataaatgaagggcaacgagctgatttcatcactttcttaatccttgtgcacaagtataaaaaaccatttgtatttggaatcagagtctcagaggaagtatatattatcatttgttttgacattcatgtgaacatagatctaaggcagaaatgttgtatttcttctgggtacggctgctgctcagtctgaactacttattagctttatagttggtggttaatttacatgtgcctgacaggaggttgctgttggtagccatccttactttttttaaataaaacaaatgttccagatgagatataatttttggagacaccagggtaaagagaactgtgggaaattctagaataatatacccaaaaataaaatcccttttgtttcttgaaaacacaggactacgcttcattttattaagaagaagaaatatgtacaaacgagggatccaaaaggacccctcaatacccccaaaaaaaacgtcacaaaaggtgttgcttgactaaaatcccttatgagaaagctaataagtgaaatataaaatagtattggccaagtggagtactttcacgttcgtctttcctatatccaattcagcactccactggaaattctgtgtgcccctacttcacttcagcttggtagtttcccccacctttccaggaaatctgggatagaatactttatgcccaatcattccaactaactatttcatcctgtcttagcgtagcttttggcacaaaattagctgatgcttattcctcagtaatattcctctgaaaacatgaaaacattccatctaactatttcagatggtcataatccttttgtattctttggcaagccgttttgtactaaaacctgccctaatgtgcttgtgtgagtccttttggactcttttccttcttattaatataatgatgtgcagctctcctgtgtgttcgagaaaaaaaaacttgaaaacattgttgggtttgaccaatgattaaggactgccacgatcatcaactgctacagtttaactagttaagaggttccgagatactccctccatacccataaaggaagtcgtttaggacgcgacacggtctccaaaacacaactttgacttcttgtttctataaaaatatttattaaaaagtgatatatgtatacttttatgaaagtatttttcaagacaaatatattcatataatttttacattttcaaactcaacaacttgagagttatttatgatttatattcccaaggtttgacttaaatattgtcctaaacgacttcctttatgagtacggagggagtatgtaattgccaatttgccaagtgctattgctctgtgaagtgttctgaaatgttcaacacctcaacattcaaagtctctacatatttctatatgtactggcatggtagttttcattcatactatggaagctaaatagaactgtgtggcatctgcagataacagtgtcctattgcttgcatatgagagtagtaaataatttgattttgttgcgaaatacatgtgcttgacatgtatgcttgctgttaggttgatatcacccttatacaatgttccagataagataattgttcgatgcaccacattagaatttttttcctggcaacttcttttatgatatagcaaaataaaagtattaaaagtaaataaaatgctttattcatcaaagaacttgaaaatattcatatggatttgagtagggaagtgttatgatgatctccaacattcctgcagatattaaaatttctaaatttatattgtttctttttctttgtgcaattttctccaactacttagcagctaatcatgccttatctatgttttcgttaaagcagtgaacagaacatatgagcataatctgaacagttacttcagtgttaagggatgcttttgggcatgtgtttaacagtactgatttcattccatttcatttttataggcgaagatgaacttgatgaaggaatctaaacattcagtagatccagaagctcccttgctcatagcatagacccttgaattttattgaatagttagtttatgaaactttcgttactgaatatatgccagggtgtgcccccaagaatcacgtatttttggaatttgaaatgaaatagtaccaaacaaatttggagagtgatgaacttttttctttagtgactaatgttttatatttttgtcaagtgccatgtttcgtgctaactttcctaaactttacatatctctagacgtgagagaatgttcaaataactgatcatcaccgtaaggcggcaaagccgcggcaagttttctacttcttccgacccaaaatattgctagtagtatatatgtggttgttttttaagaaagaccctacgtttccctgttttagagcgctatccttataagcggaattttcgcttcttgggattgtatttctgtcaaagacgagtagttttccggataaaacacaccggtgccttagtcggttcgagggtatatgcatattcagtgtaaatgtgaggagttttttttttgcaaaaatactaccacgcgtcttttccttcgcggatgtacacggccgtgcttaggctaacccacgaaacccacttataagctaaaataagccgcaagtccgtttattttgatctataagtgggttcgcggctgacccacttacaccccttgcgtgctaaaacagcgcaatgaccagttgaatggcgtgttgccgattcctctcacccgatcgagtcatgctccagagcaatacaaacgtggcagcatctcaagacgccaaaaaattttaaaaaaaaagaaaggagaaaaaaaaaacgtggcagcatcccgaggcgcccaaaaaaataaaataaagagaaaaatggtagctttagtgtttattaattcatgattacatgtgaaactttgataatatatcgtatattaatatatttatattgttttattgaactgtataatagtacaccagtatcgactgtactagaacactatattccaagtaggtgtgggtattcggtctgaccgaaaatttcagtctcggtatttggtctttatgttagttcgtctttaaaaagtgaagaccgaatttcaacacaaaaatatcagtcctgaccgaaattcagtaacattttcatatatgcaaagaaataattgaaattttcaacacaaaaatcacaaaaaaaatcgcaaacacgtatgagaagactcttattaggttacatgcctgaataagtagagatgtgaaaattagagtttaatcctattgaacttagtggattataggttgtattttgacaatttttttaaatttggccttttcagttaaccaatgagactaaccggatttaccatacaaaattcagtcttttattacttaggactaaattggtctcggtctttcagttcagtctttttctactaacccctaattccaagagccaaacctcagtctttttggtttgttttttttttctcacccctaattccaagagccaaaccgggatggcctcccgaatggaattgacaaacttggatcagacggcggaagcttagcaaaaatttacaaatgcttgaaataagcataacaaataggcaaattttgctacaggacatcgcaactttgtggttttgactgtaggacaccgcacgaagtcacttttgggaaagaatactctcaaaagttgaatatttgctggtggacatcgcacccattaaaataatattttttggttgaggagacagaaatcacgtgaaagtaatgaatgcccttgggccacatgtcggatccctcctcctcgattctgagctcacgcgacaagtccaaccaccgtggcgatggatttctccggcggcgccggcgcgacgttgctggagatgtaccagaacgcgtggctgctgctgctgctggtctgccggtgccacccggacgcgtgccccaccctcgtcgctacccccagtatggcagaggccttccgagcccacctcattgcggatggctgttgacacgggttttggctcgtgtcctaaatataaatataatttgttaaattataaactaatatattatcttaaatatagtgcgtacaaaatatatataataataaataagaattttattgggagacagatggtgaagtaatttaaataaatagcggccacgaaataaatggccatgaaataaaatataattcacttatattggacaaaaataatttttggcttaaaataggaatgcatatacgcgttccacataaatatagcgtgaacaaatatttttcatgcgcttttcgtcggaccggcgaacgctaatacttagctttctcgtcgtatccgcatacgaaatttggcctaaaacatatggccatgaagtgggattttctcactacctcgaaatagtcacaccccgaatattttcagaaaaggcgtactcaccatataaaatagcatacaaaaattaaaatgtaagccaaaatagatgtttagctggctagtgaaaaaattatactctaaatagtcgtgacttaaaataaaaatgcatgttacatgcgcgccaaattaaagggggtcgcgtttgacattatccaatatttttatctcgatgtctagatgttggcttgagaaagccaccgtgataatatgcatgtcaagacgcgatgcgtgtcgtataaaataaatttacggcagtgacagtccgctcgatagaaaatgatgcactagaatatatacgtgtgcctctttaaaaaaaagagaaaagactcatatccaaagtgtttataaaagtaaataaataaataaattgaggcgcccaattaaatgggagtatatgcagtcaaaatataggacatacagaatagtcatgcatgcaaaaaaaataaaatttgaaatcaagaaagagacacgcatgtatttacaaacaactgaaatttaaagaaaaaaaatcagtcaagtccaaagggcccacacgtcagtgaaagcaaagagacaagtggtcaagcccataacctacccacgatcaccactaatcatgcatgcatgcagcaaataccagcacattcgtcccgtcaaactgaacgggcccacatatcagccaaagggatgtgcatgcagtcaagccattgcccacaaccaccccacgatctctgcgcgcgcgcgggatcctgttcaaaatcacataaagcaaattaaccccctttaatcctcctcgataaatagaggatcagggctagaggcaaaggggagttcgctggggagaggttccaagaaggttggtgtgagggctggctaaggcgaaaggctgctgtgctgaatcgctgctattacctccgtcccatattacttatctttttgagtttttgtttgtcaatgtttgatcattcgtcttattcaaaaaattttggaattattatttattttgtttgtcaatggctttattatcaaaaatactttacatatgacttatctttttttatatttgcactaatttttcaaataaaacgaatggtcaaacgttgcaaataaaaagtcaaaaacgtcacctattatgggacagagggagtagttcgctactgcaaagcaattgccgccgtgctagtttctcgctctgctgtgccggaagaataagaggtgttccaaggtgggaatcatgatcctccttcgttcttaggctcggccattgtgtacgagtcgaggaatctctcaattctccttcctctgctcgtgttaatgtatttttttgctgtctttcggttcggccaatgagtacgaactagggaattatgttcttgacatgttcctaggcttggccatcatgagtacaagccaaaggaatttttcctctttgttgtgtccttcgtctcagccaacgcgtatgagacaaggaagttcgtttcatttgatggcttttaacatgatttcacactttctcctatggtccggccagatgaatacggacctaggagtggtttccatgcatattcttttcatgtcatcctaccataccctctgatttggtcccgttagcagatacaagcctaggcgagattctcgctctcaggttcggtcctctacgagccgatacaaatcacagatacaaacataaattttgcataattcaccataagttaaataagcacttgcttcggtcacgcttcatagcttcaagccgtgctagtagtgatacaggcatagtgataaacaaaattaattgagcatattaattagcacacatatttgctagttttgaacatatgttcagccatatttctctaacaagaattaaaataaaatggcgtttattttctttcccgtcatcaatggcatcggcgatggggctagccggcgtccacgcgctcccgttccacccacggagtacagcttcccagccggcgtcgagctccatcgtgctcccctgcgctcggaggcggaggggcgcggtctggtggtgtggtgttgggcacgccaccagcggaggagcgccgctgtggatgtggccaaggtaggccgcgcgcgctcagcggcggggcgccgccgctgagcgggtcgctcgtgctccaggcgccgccatcgagcaggctgatgtcgcccaagggagaagcgagaaaagaggaagagagaggaagagataaggggtaatttagtcaacatgaaaacattaatttaatggatggagtgtgagtgtctcctgagaaataaccacatttacaaagcgtgttcctccaaaagtgacttcgcgtggtgccctacagctaaaaccacaaagtcgcaaatgtctggtagcaaaatttgcccaacaaataaaattcttttgctcgagactatacaacgatttgtcaggtctatcggtttctggaattgtagggacaaaccaaaatgatatcaggatgcttcgccaagttcagagtacatctttgaaccaaagatgaattgatgattagttactttaatcattggcatttggtaccccgtcaaggaataaaagactacacaacgaaaaatacaaggggaacaataaatacctctgccattgaaaagaaaagggttagcattgtgtgctttctaaaatacaagttaagttgattaaagattacatgtacaattctgtaattacagcatcgtgatgacttgacagcagcaacatggttgtgttgatttacatcttccaactccctctgcacagacctgaattaagttgcaaatggcaatccattaaaactagtcactttggcgggaaagaatataatagcacaggtgtaacacaggtcagctatatggtcagtttgcaacaaaaaaaaaagtacccaatgcagaaacgttagcaacaacgtatataagtttgtgtccttgggtatataattactatatataagctcataattattattccttatataattactatatacaaggaataaagggcaatttgttcctgaacataccaagccgtgctggcaaactggtcgcgacaaaattcccagaacaaaacagctagcctgtttcactgactcctttactccctcgagcaaaaattaaaaatattgatttgaagcaggttttatatttctgggccatctattattctgtgcagggtaatttctacttttagcgtggcagaaattttattgataaatctcatgcacatacaaagataatgaattcatattaatcatacccagcagcagagaagcaaatacatacacctatatagcatgagtattatggtatattataaggaaattttggtttggtgacaccaaaagattaccgtctttgttttataccactgattcacatgagcactttaataccatccaaagatcactcatgttcctcttaacatcattccatccaaataccattccatccaaggctaagctcgcaacagccataaaacgatttcggcactacaatttggcctggctaatccagacagatcaatttaagtgtgaaagctggtatcggacctctcaagacaaacctttaccaaaaaaagatctggtaaccggagaactttgtaatgaagactaagtttgaagagaaagatattagattggggggtctatggtaatcggagaactttgtaacgaagacagagtttgaagagaaagatatcagcttggggggtctaaagtgtgtgcccaactctgaccaccctcatgttttgtctgtctccactctacattgttgcagccaaccctagggagaggatgaggtggtgcagagacatggcaggatgcttaacatgatggcaaaggtgaatgggtggtgctggcaattaag

SEQ ID NO: 40243 - DNA, 784 bp, Oryza sativa
tttatctctctctgtgtatcgcacacacatatttgttagtccttacaaaggcacaagggcgttatatatttttttgtctgtgtgtctccagagagtgagtgtgtctaaaaaaatatatatatatgtgtcaatatttgtttttagtgtatacacagtgtctgcgtctctaagtatatacatacatattacatggtattctatatccccctctttatgtatatataaaaagacgcatatatatatatatatatatatatatatatatatatatatatatatatatatatatatatatatatatatatatatatatatatatatatatgtgcaacctctttaaaccaccatgtatagagcaaaactgaaatttactaggggtcattgtacaaaagcactaacaggtgtcattgtggaacaaataataataacatgaaagaacattgcaagaggattcaccattattatgatatttccttcctcacagggaatatgggaggccatatcatcataaagggcatgattgaaaacaagatttcatccttttctgtcacctcgtaaaccttgtgaagttgcctactcttaacatccaagtagagtgcacattcatctgttttcaagaacaaaaactcagcatcgtcccctacataatccatgtaaacaacacgactatccccgcccacacaatttatgtgcaaattagcgcacatcgaccgcaaacaaatggtatcaaccagagtccatccagtgctgccatgcttaagtagccaaatacgaagctgaggct

SEQ ID NO: 40244 - DNA, 819 bp, Oryza sativa
agtcttataacttaaaatggaggaaatacatatacagcgacagctctagtaaggccggtgcaagaacagaaactacatattttctacaactaggtattcatgcacgtatatttatgtagtcatataaagttctgtgaagatttccaacaagacaaagtacagagccaactcaagatcaaatgatcaatcgatcgagccctagctagcttagttttcgtgtgaccaaggtggcatgctggcattgtaccagcagtacagcgtacgttctggtagaagcgagtggcgtttggtgctgacccaacccaaagcacgagaaagccccccatcgtagttaattcgcactgcttaaaaagttcagtaaatttaaccaccactaccaggactaactttattgcgctgctgtcctagctaaacctgcccctcatccctgggatacttcaggtttcagtgaaataacccaagttagagctacccatgcattcataggatttgagtacttagtagttagtagctagtgtggcagtggagatccaattaatctaccacaattcgagcacatgtaatgtactacccgcaaggcagagctagctagctactcttctcctctcaccgaaccggatgcatttgccccgttgagtgcttggcaagggagtgatcactaaccactggccagacagtgccttctagttgcacgggaacaggattagcaaggggattaactcctagatgcaggttttgggcaagtccccaacaactcaaagcagtatgtgtaattgggtatgcatgatataatgcagcttgttgaagcaaaggatgcgg

SEQ ID NO: 40245 - DNA, 1113 bp, Oryza sativa
acgtcttggagtccgtgctgcagctagctatagatttgtagcctgctactcttctctcttatcttttatctctttaaaatatatttatagctggctaatagtgtgctattgtacctgctaacacgtatataaaagttttattcaaaaattacttttcgtttgcaaatatatcgtttgacttattacacgaataaatgaaacgatgggctaagttcaaaagtgtcgcaattaacaagcatatactccctgtgtactactccctccgtttaaaaaagggcaacctaggaggggttacatgctcctagtatctgtccagattcgttgttactaggaggggatagttgtctttttatgggatggtcacatcgttattttttttatggggagtacgttccaacttccaacttccaaggttagtgtactgtgttttgttttttttttcacgtgccaattggcaattttcctttcgtacgtgtgggctctcgtctccgccaataagaaagcgttgcaaatgtcccaagttggcaattttccttgcgtacgtgtgggctctcgtcttcgtcaatgctgctcaagtgctcatcatttgttggattaggcggtgcttggatctagggacttaactttagtctctatgtttagacactaatttagagtattaaatatagactacttacaaaactaattacatcaatgaaaactaattcgcgagacaaattttttaagcctaattcatcttgcgaattagtccaagattatagatgggttttattaataatctacgtttaatatttataattaatgtcaaacatcagatgtgatagggataaaattgtagtcgtatctaaacagcgtcgtactctactccactctaccccaaggtcccccacgctttacacgggcgccaggctttggatctcgatccacgggctgctgatcaaaagcacgtggtgccggtttctgcgtccgtgtggtcaccgatcagctccatgctggttcctgtataattttggcccctggctaacaagccaatttggagatggtgagagtgatactccctccgtttctgattgatcacctaactaaaaataaaatcagaatttatagattgat

SEQ ID NO: 40246 - DNA, 4839 bp, Oryza sativa
ccattaattgcgagctgcttcttcttcccgttcttgtcaagactgaaactcactggatcatcgaggagtggcaatggcggagcagcagctgatgcatggcaccctcgacgccaccatcttcgaggccaccaacctcaccaaccccacccgcctcaccggcagcgcccccgagggcatccgcaaggtcagcgaccgattccatggagctagatcgatcgaacctcgccaatgtttttctacttcttggttgccttctcatggtgtttgtgtttatgcgtgcagtggtgggaaggggtggagaagacgaccggggttgggcagggcgggacgcggctgtacgcgacggtggatctcggcaaggcgcggctcggccggacgcgggtcatcgacgacgagccggtgaacccgcggtgggacgagcgcttccacctctactgcgcccacttcgccgacaacgtcgtcttctccgtcaaggtctcgctgcccatcgacgccgcgctcatcggccgcgcctacctccccgtcggggacctcctgtccggcgaggtcgtcgagcgcaagctcgacatcctcgacgagcacaagaataagctcccccacgggccgaccatccacgtccgtctgcagttcaaggacgtcgccgtcgacggcgacgggaagtggtggggcgccggcgtcggcaacgccgggtacgccggcgtgccgtgcacctacttcaagcagcacaccgggtgcggggtcaccctgtaccaggacgcgcacgtgccggacacgttcgcgccgacgatcccgctcgccggcggcgcgcactaccagcaggggcggtgctgggaggacgtgttcgacgccatcagcaacgccaagcacctcatatacatcaccggctggtcggtgttcaccgacatcacgctcatccgcgacccgtcccggcagcgccccggcggcgacgccaccatcggcgagctcctcaagcgcaaggccagcgagggcgtccgcgtgctcatgctggtctggaacgacgtcacgtcgctgcagatcctccagtcgctcggcatcaagtggggcttcagccagacgcacgacgccgagacgttccagtacttcgaggacaccgacgtccactgcgtcgtctgcgcgcgccaccccgacgccggcgggagcatcgtcatgggcgtcaaggtgcccttcgcttccacccaccaccagaagaccgtcatcgtcgaccacgacatgccggccggcgccggctccggcctccgcagcatcgtcagcttcgtcggcggcctcgacctctgcgacggccgctacgacacgcagtcccactccctcttccggacgctcgacgccgcgcaccacaaggacttccaccagccgagcatcgacgacgccgagctcgccaagggcgggccgagggagccatggcacgacatccactccaggctcgagggccccgtcgcctgggacgtcctctacaacttcgagcagcggtggcggaagcagagcggccacggcgacctcctcgtcaacctcaccgccctcgagcacctcattgcgccgcagtccgcgatgaagctccccgtcatcggcaacgacgaccacgaggcgtggaacgtgcaggtcttccgctccatcgacggcggcgcgtgcgacggcttcccgagcagcccggatgcggcggcgcggctcgacctcgtgagcgggaagaacaacgtgatcgagcggagcatccaggacgcgtacatccacgccatccgccgcgccagggacttcatctacatcgagaaccagtacttcatcgggagctcctacgggtggaggcccgacgacggcgtcaggccggaggacgtcgaggcggtgaacctgatcccgagggagctctccctcaagatcatgagcaagatcgccgccggcgagcggttcaccgtctacgtcgtggtgccgatgtggccggagggccaccctgacagccaggccatgcaggccatcctcgattggcagaggaggacgatggagatgatgtacgccgacatcgccggcgcgctcaaggcgaagaggatggacgccgacccgagggattacctcaccttcttctgcttgggaaacagagaggtgaagaggagtggtgagtatgtgcccggacatcacccaagagatggcacgccatatgccaaggcacaaaagacgcgccggttcatgatctatgtccactccaagatgatgataggtatgctcaaatctagccccgcaaatttcaacccttcaatctagtagtaaatcctttccaaattcacatcaaattctagctgatataggataaactaactgggtggtccacgcaattgcgcggctagcacccatataaaattatatatttttaatatgattttacttaaaatttattaaataattatctcattgtcttaaaattttgaaaaagaccaaacattatcatcccttgctacccttacttctgtcatatcattttttttattaccttgctcgatctaccactgtttctattcattcttcttggaacctttaaaaattagatataaaaacttatagttttagagtttattgttctgttggccttcttttttataatttctaaaagtcacatatactcctctacaaccatccactgcatcttctctttattgtcattgctattttaaaattcgaacataattattgtttaggttcgtttttttactttctaaaagttccactaaaagtcagggactttgtcactatactcctctacgactcgcccgctgccgtccttcttttttgtcattgagattttaaaatcaagcatgattaccattgggatttatttttttactttttaaagcccgaaccttttaaaaattgaatcttataggttttagagttttattgtctcgttgggtttcatgttttttataatttttagaaatcccgtcaaacactgccactatactcctctacaacccgtccgctgcataatctttattgtcattgggattgtaaaaatcgaacataactaccgttggaattcattttttactttctagaagacccaccaaccatcgtcagctctaccattgtactcctatacgacccgctgcctctcatttttattgtaattgagattttaaaaatcaaatatgattattattggggtttattattttactttctagaagtccctcgccaaccgctttgactgattgcttcacaacctgcccgtcgtccttctttttaatcgtcattaggattctatttggtgttttattaatattttttagatgtctcatcaaccgccaccactctacttctctgtaggcttgttacttaattaatcttgtcatggtcttttctttcaatagtctaatttttattaccaattttagctatttataaattgtattcctaattaaattctttttttctttttctaatttcagaatttattttatttattattatgttcttttgatatttttattttttattttcaattttagttgtttcaaatttgtattcatactttaactctctctttaatttgcctaatttcggattttattttattctttattccgaattttaattaatctaccatttagttcttatatgtactcttatttcaatattgcttatatttaattccgaatttaagttaattttaaattgtattcctacttgaacttttattttcttttcttttttctaattttatttttttattctgaattgtaattaatctcgtattggattcttgtatggactcttctttcaatattccttatttttaattcggaattttagttatttataaattgtattcctagtcgaactcttcttttttctttttctaattttgaaatttatttttttattattccgaattttaattaatcacgtattgggttactatatggactcctctttccatattgcatatttttaattccgaattttagctatttttaaattgtatttctaattggactcttcttttctttttcttttgattaatgtgagaatttctaacctccacagcgaacgtggtgtcttctttcaaggctgttttaataatataatagatagatagatagatagatgttctaatgtgcttatcatgtcatttggtacctgtacttttcaaaaagtttttaaaaattgttcgtttgtttcagtcgatgacgagtacatcatcgtgggatcggccaacatcaaccagaggtcgatggacggcggccgagactcggagatcgccatgggagcattccagccacaccacctgaacatcggtggccagcttgcaagaggtcaaatccatggcttccggatgtcactatggtatgagcacctaggaggcgaaccgcacgacgacttcctgcacccggggagcctggagtgtgtccggagagtgaacgagatggctaacaagcactgggagctctacgccagcgaggagctccatgaagacctcccggggcatctgctaacctacccgatcgccgtggctaaggacggcacggtggcggcgctcccgggggcgaagttcttcccggacaccgaggcgccggtgctggggaagaaggcgatcaatccgttgatgacccccgatatcacctcgtagatcaggtgaaagtttgtgctggtggtgcatgcggagcaaaagtttgctagtcctacactggagtgatgctgcttccatcagaatgtgtttgtttttcaacggtgtaagttgtcctagaatgtcaccctctacctaatgttgaatcttaattccattgtcctaaaataaccaaatttgtaatgttactggaacaaattttgggggtgcag

SEQ ID NO: 40247 - DNA, 1968 bp, Oryza sativa
tcaccgtggcatgccatgtcatctcacggagcgggttgaaacccgtttggatttctatatgacacacatgacaagtttggggacccaaaatgtattttaaaagtttagggacctagataatacatatatatacaagtttaaggactgcccgtgcacttcactctgaaaaaaaaactaagaatctagctccagcttctagcacctatcatccaggaaagaactcgacttgcctgttcaaacagcctactccagctcaaaagtatcagcttaagccaaataaacgacaccaatcaagggttagccaaacatcaaccacatcaggttgaatatttaggttgattttctaaccagaaaagctggagctggagccatgtgaacactccataacaatagcaggaccagggcgtgcaccgttcatcatgcaaggaatatacaatttttcttaaggagggcttagaggacccagcacagcaatggaggagagaagtccacattgtctccatcttaaatcttggcatgtttctgggggaggaggagatggaacttgacaaaattatcaccactcattcactcacaaaaagtcactataaggatctcaggctgtgtttagatccaaagtttggatccaaacttcagtccttttccatcacatcagcctgtcatacacacacaacttttcagtcacatcatctccaatttcaaccaaaatccaaactttggatccaactaaacacagcctcaagctttcaacacggtagctctatgtaatagtgtgcacgcatgcctgccgtttgtagccgcacatgggcgctatctatgtgcagacgtgcagttaacctgggaccaaaaggaccggacggaacaactcagccggagtagcccggcagcgagagtggacgttgccacacggcagaaaggctttacacggtaccaagattccaagacccctcaatgcatcaaatcatttctatcgatccacacgtctacatagatcaaaacaatgaaaaatacaaagtacatcgagtagtaagaatgagagaagatatatctgattgcggggtgtgcatgttgaggctggtttgttcagagagaacctcagatcctgggagaaagtcaggtcaggatgcagctaaagctaacactaaacaaggcaacaactactggtctactgctgctacaacagtggtgctaccacctggatgcactataatatatgcatcgtcatctgcatgtaatgtaactacccgtcgacagcctcataattatgcccggccaactctcctggcccttctcccctaacgttttcccaagtttccatgccaacgcttccggtgtccccccaagcaatattggtgatcatggccaggcacgtactgacgtacgtattcacacatatagattgttaattaccacgacttgacaaagcaaattaaggctagctacagcacagcacagaactatgacccattcttaaatggatcaaactatggacaacagtggctagctacgctaaagcacaagcaagcaaaacgtgtgcgcctgattggccaatcgatcctcacaatttacccattgaaaggaacgacgttattagaaattacagaaaaatgaagatccagccgtgttcatcgattgtccacgaaacctcgaacatttgcagcccaaaaatatcctgtacaatgcagcgagagagcaattaatcaaggggtcattttcgatgaggcataaggcgcgtatactgatgctgacctgccgctcgctcgcgcactcgataatcgtcaagaaattggccacgtcaatcacggccacgctatcacacgccagcgaccgacgcagtcgggcactatgtgtgtacacagggttggtggatccgtgtgcatatatgcgaggatcatatcaatgcccggtccagtgatcagctcactcactcactcactccaggccagctgatttgctgattaattccca

SEQ ID NO: 40248 - DNA, 3244 bp, Oryza sativa
taagataaaattttagttatttgtaaattatatatattcatatatggactctagactcgtcttttaatatttcttttttctgtaaattgtatttctatatagactatatgttcttcttctaatattatttatttttatttctgaaattttattatttctaattgtatttctatgtggactctaaactcatctttcaatattatttaatttttaatttcgaattttagttacttctaaattgtattcctatattagcattaaactcttcttcccattttttcttaatttcgaattttaactatttgtaaattgtatttttatacggactctaaactctacttttaattttattatgtttattccaaattttagttagttttaagtttctatatggactctatactctacttctaatattccttatttttaattccgaatttcagttatttcctaattgtatttctacatggactctatactctacttctaatattccttatttttaattccgaatttcagttatttcctaattgtatttctatatggactccggtctcctcttctaatattccttattttttaattccgaatttcagctatttcctaattgtatttctatatggactccggtctcctcttctaatattccttattttttaattccgaatttaagctatttctaaattgtatttctatatggactctgctttttctttttctccgattaatgtgagaatttctaggccatgagagcgaacgtggaggctcctttttctattcctttaattatataatagataataataatttagatctccatcctattcttgaagtgtggcagtagatgatgaggttgttgattataactagtaattatcatacctgtcacataattgtgaaggtttgagctagagggacccttaagattttcttccttgaatcgctagtcctagcatttgtactgacaatgtatatatgatcagtgtggtgtactagcgtttatagtgctcacctgtcaacggtttttactggacgacaggtcctgacagtccttggcaaccaccacaaacctgcctgcacttttccatgtaaaaaaaggagtgcgtgcatgtgtacgacgagcagcagcagaagaagcttccatccctgcaggaactcactgacacacgtatctgtgtggagccgatggaactgtaaaagcacccggacggaagccccattcaattcgatcggccggacaaacaatggcaacgaactcactccgccattaactccgtttcacctttttacggagagaagagcaagttcttctgctgctgcaatgctgtgtgcgccttccttgccgatgcgccatggatggatggatgattggctgcttgattggggcagttattgcaggccaactgctctgtcgaaagagtgtccctcggaaagtggctttagaagttggagtaaaccttgcagtgcatggcatacatacagcatggagtggtattaccttggttacgaacgcccatcaagtccatttctggagtagtacacactgtccaagcttcagtgtttgtacctggaaagaaatgcacattagccatatgcgcaaggcaaggcaaggcattgagcaaagttagattcatcagttactagtttagctagttagcacatacacactactggacaatgactagcgagtgagcttagctagctgatcggcgacaagtgacaaccagctagttagcaataagagctggtgatggttagctcatctcagttcatccttaggttttcctccagtgaaggccataaatgaggtcgccaagggcgtaggtgggggagtttattaccggcgtactggcagagaaggtggttatgccgctcgccacagttcaccgacagcccaccccagcagcccatgagggccccccatcctctttccatctatctctctcttccactaatctcaccaaagagtcttcttcacttccttctctaggcttattaacagcttatttctgatctctcacatgttcagttttatctcatccctcctgctagatattactgttgctggccccaaccaccctgcatggattacaacacaagtttatcagtaccactgtggttcaaagtagtgtatgtactggactcgtggagttatgaccacaaggaaattgaccagaaagttaattacaatgactgaaggtgtgtactcacttggtcctggcagagtagaaggagagtacaccaactagatctgaaccctggtgtgctactgtaccaaaaggctaaggccactgacagaggagatacgtgacagacaagtcccagttgagttactgtccaacccccaaatctaaccctcttctaccaccacccccactcgtgcgccacagcgctctcacacgcgcgccacactcatgccatgtatgtctatatatatgtgcatctatatatcttagccacattgaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctcctgtaagtctctatctcactagtgatgatcactagctagctatgttgctctgatgtgttatgccactgtcgtgatagatacattttgatggatagctagtggttctggtttgttgttgctttctttctttttttctttctctttcatggtatgttagtagctaactcaaggtgcttgggtgcgtgcatgcatgaatgatggatgatgttttttttgctacgtgcgttgtggcagtaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctca

SEQ ID NO: 40249 - DNA, 4280 bp, Oryza sativa
  unsure (1)..(4280): unsure at all n locations
tgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgtacttttgtggctttgctttttctttcagactacttgctggattttcatcaaaagaagatgaggaatatgatgaaggtgatatttgtgaataagacatgtttcctaaatggttttaaaagaaaaaaagacatgctttataggataatactcctacaatcatatctatgaactgttcatcttatccaaagatagtagtactccaagattggaaaattatggatgattgtcatattaaagacaaacaagcaggagaaatatttttcttcctgcatcactccaattctccaaccacatgagtccactcaaagggttaattgatcaaatgattaatgcaatggaagaatttggtaagatagacatggtgcaaaacatagtttactggaaaaaagccgtaatttccgnttactacaattcagtaaaataaatccatactccaatgttctggttctgttctgtcttctcactttcatcaagggaaccacctagtttattaataggaaatacaccaattcctgcaggaaaaaggtgttccaaaggaggccttagcatagtaaaaactataatgttttagagcagtcgttgccaccagaaaagattcacttgtgtccacttaggggggatttgctgatagttaaaagcaataattatgcaataaacagatggccataactcacaaggcatcaactaaattgcgacagtgcaccagactacatgcattatgtcagtgtgtttattcacacacaaatatatagcagcacaccacacagtacaagcagtggtgtttctaactgtgatgccaaccctccgaaagtaaaaatggtgacaccaatccagcacaaacaacttaaagaacttcaagataacatcatacgtggcatatcaaatgaaaaagaatgaaagcactgaaatggatggcaaagatcatggtccccatattatttccccttcctaatttcacaacatacaaataggagcaatgaagcgcgaatcagctccacagttggttctataggttggtaatgcatgaagtcaatgcgaaagggcccagtcagttagttggtcagtcataaagtacgatcatgtcaaaaaaagaagaaaagaaaattaacaatatgagaggatacactattctaaggtcttggatgttgatgaaaacaacaaaggcactacatttagtagtacacgaaatgacaaaatggcatatgattaagaccttagtgaaattcaacgatggccagaaccaaaagctatgcttacatagtgagccaacatttaagttttgatgcttaaaataaacaaattggttttcctttatcatcatgtcctttcagcagaaaagtgctcaccaatttgtgtctcaatccatcaaaacctaataaatgggtttcttgcataaaaaccatcaaactcaaatatgacaaataattctcctaatatgtgctgcagaacaaattgttaggtgtatgatgttcgcctcataatttagagatttgatactcatgctactgctcctaaattttggaaaagtaacagctcacaactagtttcgccttgataccttgtggtgccacagtagctggttaaggacctcccatgttgcaaaagcatgcattgaatatgtccagtaggatagctgtatcggtccccacaacattaactctgccctttgcttcaatctcattcgaatcaatctggtgatgtcatcttaattaagattgtaaagcatatagcaccaagttacgctgcgctcttgacactgtcatccgccagatctacctaaaatagatcaacacatggtccatgtacatgccaattaatccattaatgtcattgtcaagtggctgtggacgacagaagtgtagcaaattagcaatgagccaaaaagaaaaggaaaactggcttgtttcaacttctgactaatgagaaagacactcaagtacacaaacatgcgctgaaaacaacatatcataacttgtatcagtaataaataagcatttcaaatgagcaacattccaattccagggggctttccgttctttaaaatctagtaaagaagttaccatctggtgagcttttgtaattattcttcaaagcatgggtagattagttggttaagatatctatttagtgaagaaactacaattctactaaaaaatatgtaaaagagatacagcatgaaagaattacccactagtctatcaaaatctgggaagatgtcaatgaaatatggattcacaatgtacagaacaggtggcctgcttggcttccatgtgtaaatatactctctagactctagactttatccagtcaatcttgtagcaaaagatttaggaatcaagtctgacacaacaatttctgtaaacaactaccccttttttggcctctgtaaacaactagcagtagaccagccagtgaccctaaatgcaaagcgttggcaagtataactgctactgcatgacaaacccttgcccctctgagggcatagtaccatggcctggtggtcctagttagttgttacattttgatgtacttacgtccattcaaaatgattacatgcttggcatgtcattatcttggttcatttagcaaccaaatctgtaaaaagtctaatttttaacaatcagttacataaaagtcaaagatatgcatagtcgtcttttacaatttacactaccttattaatccccacttttatattgtggggtatatgtgcagacaaactttagtaactttgactgatatactggattgaacacatggaagtgataccggtgggtaaattgccaatgataacattatacttttgccagattttgatcgtaaagtatataatatattaatgactaagtttaaaactcaagggctgaacatcaaacagaaaaaattgtaaaaataataaaatgtataaaactatacaagtctagtttgctttcactttttcaagtcaagcattacaaaccagcaacagcaacaaaaaaaaaaaaaaagaaaggccaagtcagcttgtttccaaaaattgtttacttggatagctgcagttttgagtttcatcacttcaactcctcaaaactatgaagaccaaccatttggagacatatttagtatattgctacccaagtcattgcagagaagcgagtttctcaatataaatgaccctgtggccaagaagtagtctaaatcatttcatttgcatgttgttaaccccaatgtagttgtcagtcacccgatgcatgtgtttcagaagcatggtaattgagtaaagcgatacaatgaccagctggtcaatttaactaacagatttaactgtgtaaactcatatgaacaatcagtgactgcaaggttcaactattgacagacaagaacacaggtgtgcagcaggcactatgatgtatcacatagaccagaggcaatgctgatatgcatttcctttcagatttttattgttgaagtaatgaacaaatggcaaagtaatagaagtgcatattgtctgtcaaccacagtttaaatgtagcccaattagttctcaagtaaattcaatttatccaaataaacaattcctataaaaaaaatttaaccacccaatgatcaaatttaaccaagctacaccacatctttcgttgttttgttctgtacatatccaagaacatccaaacaacaagtttgaatgtttaacccatataattaaatttgcaaaagtgaaaataaaactatattattgcaattcagtgaagggaagtaaaggagaaatctagccagactggtggaaacaagataattattgctgttcccggcaaagactcaaatagtaatagcttagaacaggttggcaagtggcaatataa

SEQ ID NO: 40250 - DNA, 3332 bp, Oryza sativa
atgcaaatagagataataaagtaaggaagataagctattccatgccacacaggaaaagagcaatttccagggcaaaagagttgatttatgcgcaactattatataagcgagataggagggcgtatagtcttttaaggaggaaataaacacccaaatttcgagctaaagaggtcccaaacctgggttggggggggggggggggggtaggccgttgcctccacacctcataggctcccaccgagtgagctagtcccggttccatttgcaacagaacattggcaaccaatatccatgtcattttgtttaaaaagagtgtagagccacttcgaaatatggtaacatatcattcaaaattatttgcatgaagcaagcacagaaccaacagagctaaagctatatggcacaactctaatagatttcatataaattgaacaatggagtgaaggaaaatgaaaatcataccgtttttatttgactcatgtagacacaagaaatatgcgccagatagtttatacttttcatataaaaatatgctataaaagttgcatgtggaattgtggatcctgcaggctttcaaaacctgaacaagctctctctgaaaaagcttccagtcttcatttcatcataaagaaaattggcatatcctaatcacctattcaaggtactcttgcaatttcttgaagatattcactggtagaattcaaccagttaaaaaaagacccaccatacttttaagattcatgatctggtagaaacagttgaaagtatctcctctattggcactttcaaactgtcctcttgccatggacggaagcaacttttcaacatagtagcacggatttgcttcaagtttatctgctttagaaacactaattaaatatgaggaagaagttcttattctagaatccacaaacatgactgctaggagtgctattataacatatgtttcttcgagaactccagagtggtgaccagcttactgcatatataacttgtttgttcggtctagggattcccacaggtatatattgtagtactactgaaaatttgtcaacaggctaagaaagataaatgagctgaatgctgaatatcaaaaaactaggacagagaaatggcttgaatgtgttgtgttgcatggcctggcactcaactaaatccccttggccatcagcaatctacaatcagcaccatcaaaaactgatgcagaatgtcgttaggtttcacattgtaagatcagtcagtttactgtgactctgtgtgtgagagaacacatgtttctaatcctgtagttctcctgactcctgagaagaccaagaaaaactgatatagaatgtcgcaaggattcacattggcaagatcagtcagctgacttgtaaatctgtgtcaaagaacacttgtttctaatcctgaagttctcttgactcctgagataaggaactccactgcagttttaaaatgatgaatccttaccaagctgtcaatcactattgaaatatctgtttcgtaagctgatatctagcatcagaagaaacattatcttccattgtatactgccaaatggcttccatgcatactcatgggggaaggcataagatcattgcagaatctcccctgcaagtcatatgtgattgcacttcttgatcttgccagtacatgatatagataataagataaagtgggaaacagctgcctctagaacataagctctcatcaacaattacaatttcagcaacggtttgctcttctactgctagcttccgcttagaagcaatggacgtgagacggatgctcttgaaatcatcatcaatctggccacactttctactgccatcacccaatggaacaccttaggaagggtttctcccagctcaaaatatattggcaggaaagtctttcaggctgcagagtaatagccagattccttaaccagaggcataaaggaggataaggaccctgcatcatgcacattgctttgcaaagttacataaaatcaacagttacagtgccaaaacacaagtaatagatgaaatcatgaaagctgggatagtagcatatagccaactgtactagttcagcattggactgagaaaagttctatataacagattctactcacagcctttagcacaaaagctagccgattctactcacgtggaataaactgtagcaaggatcactgcactgcaattccacacataactctcttcaaacaccatgcaaataattagttgcttgctcaacgcaactctacaattttttggcagaaaagttaacccaacaaatccagcagaaccgactaaaatttgccgttaacaatcacaaaaaacaataacaatcacatttgcacattcgatgcagaaacctcgaaccagtcaactcctgcactccagcccattccgatttccgaaccgcacctccctccattgacgcgatcccgagttcccaccctaccacggttcagagagcagctagctttgcctaaccctgcatcaagctaaatctgcattccgtctcgaagcccgcccccatgcgaatcgatgcgggtcgcggcgttgctagcacaaccagcgcgggcgcccggcgatctaccaggaaaaaacccgagagctcagttgtgcgcgcgcggcggaaacccctctcgtggcgcaagcgtaacccccgacaccgccggcgcagagcaaggccgtgtctagtttcagggttgacgagagaggcgtacctcgcggcgcagcggaggccgccacgcgcgaggcggcgaagctcgttgccggcggcgaggggcggctcgcctgagaggccggccgggccgggagcaccacggggagagaatagaggagaaaattgagatttagccgttgtcaaaacgggtttcactagaatgccgcttccaaaatagtttcattaagatgccacttctaaagtagtttcgttaaaatgccaccatcaaatacgggcaacatgttacaatgccattttatccatttattctcagtttaatgttttttttaatatttttttctcgctgagatgaccaaaatacccttgatcttatctcatctctcatctctgtcttcctcctctccgtttggctcggcggcgcagttggggatagggatgacggcggcgcggctggggacggggacagcggctgcgcacccagggacagggaaggcggcggcgcagctgggtacggggaaggccgcggtgcggacagggacggcggcgacgcggctggggacggggaggtggtgacgtggctggggacggggacggtggcggcgccaacatgattggggcaggtggggatgttctcctacattgatggggtgcag

SEQ ID NO: 40251 - DNA, 3162 bp, Oryza sativa
gcccacctcatcgccgaccccatctccatcctcctcgacgacctcctccttgagtgcctcgccggtgtcccctatgccaccctcccgcggctccccaccacttcaaccacgctcgttgcctccgtcgcgcccacggcgagctccgcccctcattcctcaccctcttcgtcaggccttgtagaagatcctagtggcggcgcctagggagagatcatcggaggcgatgaggtaggaggcctgaggccacggcgaaggatgccgcctcaggaacggtggcgcggaggatgaggacggggagccaacggatgttggcgtggtggtggtgatgaggacgaggagccagcggccaccgactatgccatttttctatgcagctacgccccgtcgccgccgccgccgccgccgctacgctccaccaccggtgactggatgggaatcgatcccctttctcctttctcctgtaaagtcaacaaaatagccatgggcacatatgtcagagcatgatggaaaacatttgaaaatcaattaaaatggttgaaatggcattctagcaaattggcttcatttgacagtggcattataacgaagccatattcgaaagtggcattccagcgaaaccccatcccgaacatggctaaatgtcaattttctcgagaatagagagacgagaagagttgtagtgggctgggctgtgtcttctcgtgggctcttgaagccgtgatttggagtggagttggggttcgcggttgtattccaggctgggccggatgcttctctcggaattctttttatttttcttttttatatgtttttggttttcgccactgagactggggtggctaatgggcgcgcgcgcatgccggcgcgcgccagctggccccctcccgagcgattctttttccttttattttttcgtgtttttttttcattttcccttttactttttttctgattatttttttaatcttcaacatatgtgttttcaaatgtttcgactggaaaattttcaaatctcaagttaaaattttcaaatctcgagttggaagttttgaaatctcgagttgaaagttttcaaatctgagttggaagttttcaaattctgagttggaagttttcaaattttgaattgaaaatttttaattttgagttgaaagttttcaattctgggttgaaagtttttcaaatttgagatgaaaagatgaaagtttttaaaattgacttcaaaaatttcaaatttcgagttaaaagttttcaaatatgggttaaaagtttttaaaatttgactccatgtatagatttcttttcaatcttttcaatctgttaaacaaaagctatcaaaaaaaatcttacgttaattgtcgttattatctctaactaacaggattagttagtaggtgtctccgagaaaaaatcccgccgcgtgctcgttggcagcgcatacgcgcgagctagcttttcccctgagactgagagcatatggtcattgtatgattcatatgagagagcaggtgcaataaggtccaatcagcagacggtacagctatccacgtcaatactataatctaaactgaaagagtgaaatgatgagagaaaaagtaagggcgctaatcctatcgcctagcgacacacacaaaaggcattgtagccaacattagagcaggtccaatagcatgttataagccagctacaaacatattttaaagagttaaataaagagagagaagagcagcgggctacagatttatagccagctatagcacggactccaagacacagtgtgcgtatgacaggtgggatcaagtattaatagtatagtatatagctattatataaatgggctattagattagctataaatgaattggagctgctagttggctatactattaaacttgctcttaccatcggtgttggctgcaacagccattgttatactcccaatgcactgagtagaaaggatagaatgattggtagagatagaaattagactagaaaattataaagtgatttattggaacccgtgtgtacctactcaatagcaatagctattgtacattcaagctggagtatcttttactgagataaacatttttattgccggctactaagggagtgttcgttaggtggagataggagagattgtctctcgttttccgcgcgcacgcttttcaaactactaaacggtgcgttttttgcaaaaaatttcaataggaaagttgctttaaaaaatcatattaatccatttttgaaatttaaaatagttaatactcaattaatcatgagctaatggcttacctcgttttgcgtatcttcccaatctcctcaatccccttctcttcaaacactccctaattgtactgagaatagaatcatgtggaagcttgtacaatgtataggactagtaaagttctatggatgagcccactatgttggtgcatcagccttacggcctcatcttttcatttatacttatagttatcagctaaaatttatttttttaatcttaaatttagagttgattttgggattttctcatcgaattttatttttcagctcttgcttttaggtcactaagaacacgcatataaaagttttattcacaaattatttttcgtttacaaatatgccgaaacgatggggcctttagataggtgggctcggacatactttctctcccctagagataggcactctgactagcatatagggcatgtttagttcccaaaaagtttttccaaaaacatcatatatatatatatatatatatatatatatatatatatatatatatatatatatatatatatatatcgaatctttagagacatgtatagagtattaaatgtagatgggaaaaaaactaattgcacagttatgatgaaaatcgcgagatgaatcttttgagcctaattaatccatgattagccataaagtgctacagtaacccgcgtgtgctaatgacggattaattaggctcaaaagttccatctcgcggtttactggcgagttataaaattagtttttttttattcgtgttcaaaaaccccttccgacatctgatcaaacgataaaacaggcccctagttctatggtggaaagggattagaacaagtgctacaatatgtatagagtcaatcctacctccttttctctcctatagaa

SEQ ID NO: 40252 - DNA, 831 bp, Oryza sativa
tctaacattgcagatgctatatgaggggtagaaatggaatttcaagtgcaaattgagaataattgcatatcaccatgagtaagtggaagcaagaactttttcgaattttgtttgagaaaaggagcttgtatttaacttatcatttggtaaaaggtaaaatctctacatgtcaatcatttacccagggaagaagagaagaggtacacggaagactgaaatttcaatcagcggttaagattaaacattactacaattttccgtacatttcacaatgcagttcttagttacttatggggttttccttcccaccaaaataaaattatagatttcccctaaaaataataaaactatagatatatatttaagacaaaatagatttgttgctagctcttactattactagttggtaccccgcgctttcttacaagatatgtgaataaatgcatattatatattatataaattgtagatgtatatatttaaataatgtgaaaatgatatgaaaataatgatttgacattgcttgcatcttgagttctaaaaataatgatttggttcatttaaataacaaaattataaatgatatatcatatttgtatgatatttaaaatactctagataataattgctagtgggtgatgatgtggtacacctgcatgttatttaaaattctctagataaatttaaaatactatagataataattgctagtgaatgataatgtgacacacttgcatgttgagttttagaagttagtgaaattaactttataataataagataggatgtgtgtaatgtttcgaaaacgctctgcaccagtagggccagcca

SEQ ID NO: 40253 - DNA, 4791 bp, Oryza sativa
gatcaagacggacggaaaacgatcaagaattgatggaagtgttaaaaatagaaacatggtgaactttaggtgctattaaagagaaccggtaactttcggtgctataaaaccaaaaacgtgaactttcgatgctatataaccaattttacctttttaaaacctggagtattattttccatcagaaatgctcctgctcgaagtattgctacaactgtacaggtgagcacggccactcccatctccgtgattgcgtcaggcgatgagaagaatatgcgaggagaggtgctcgcgtggattcgggtcattttcgtatttttcaggcggagtccgcaccggccagtaggctgaggcagctgttgcttcttggacagttcagagtttcagagtttcagaaattcagatgatgggggaggacggcctcctgtttcttcacgtcgcgtcgaattgtactaaaaagggtcgtcctttttcgagagtgatcctttgtggagcggatctcgactgatggttttggtttgccggggggtttatcgctctccaacgggatgcgattgggatgggcggcaaacgggccggctggatatttttgcaacaacggcaggttttctctctggctaaaatcgttcgtatacagactctgtaatactccctccgcccataaaaaacataaaaaacaaatttagaatccgatgtgatatattttagtactacgaatttagacatatgtatacctagatttataatactaggatttatcacatccagtatatgttatttttttttatgtaatggagagaatatgacccaacgaagacatgatcatgtagtgaaatacttctaattaagttaacacatttctcgtatcctatctatgtatgctggtgtttttttaattagaagtgttctctttcaataaaagatatagattaaaagaaagtgatattgaagttttacaattgtttacatgttcgtttttgggagacaaaatcaaaagtccaaatatcaccataaactttagatagaagtccgtatagtaccttgaattttaaaaccagacatccaaccccctagatttagcaaaatcgttcatattatctcctaaggtggctttgtatagttgtttatatctaatttgtatataacttggatgagtttgatcatatgacatacacattagacatatgtattaaaattttcacttcaatctttctttttaatcgcttgttagctctcacttacaaacaagtaccaacgtaataatagtatggtatcattgtataagtataaattgatgacttacaattgatgatatgcaaatatgttacattagttatccaaagttgtttatttaagcttccaaaatatgaaaaaccaccatccaaaatcaccttaggggatgattataaagtttagaggttagatgtatggttttaaagttcaggttgatgtactttcatccaaagtttagggggatatttggacttttaccaattataaatatatgtatattaagaaaaaaaaatttgtaaataaatgttagctctagctacaattttatcttgaccaccaattaatcttaaatggttcacatgaaagattttcccgtacactagaccctttttgttttcaggtggatcataagtgcaaccgcacaggaaaatggggacaggtgctgggccgttgcccacatagaaaaatcaattttcgtgtgcggatcacttaacaggcccacacacgaaaataagcctattttcacgtgcgggcctgttaagtgacccgtacacgaaaatagcctaccccacgcgctgcccatcctcccatctccctcttatcctcctccccatcctcccatcatgcgagcgctgccatttatcctcctccccatcctgcccatcctcccatctccctcctccccttcctcccatctccctctccctgtccctctcctcctcggcgatggcggcgctctcggttagggcggcggaggcggcggcattggcgggcgcggcggcgacatctgcgagtacggcggcagcggcattggctacggtggtggcggtggagcggatccgtctccggccgccgcgtggaggccggatccgtcgctggccgccgcggagaggccggatccgtggcttgccaccgctgggaggccggatctgtcgccggccgccgcggggaggccggatccatggtctgccaccgcggggaggccggatccatcgccggcgaccacagggacgacatcggcgggcctcgggcaaggcggcgatgatgacggtggtggcggcgacaacgacgacgacaggcctcgggcaaggcagcgacgacggcggtggtggcggcgacaatggcggcggcgatggtgttgacggcggctagattagggtttgcgggtggattttgatttttttttcggtttcagttttttattttctcgtgcgggtggcttaagcgtccgcacgtgcgggtgcatcacccgcacgaaaaaatcgggattttcacagactccacgttccagacgggtggaagctacgcacgcgaaaattgattccacccgcacggaaaaatctttcatgtagtagtggttagaatacatagttttatgtttacgacacaatgcactttgattatagagcatcggtctcttttaagtatttgtagatctgttttggaagaaagaaaatatgagaggtcaagtttaataaatgattagttccacctatctttaaacatgaacggagtgctatattgtatgataaaactcatgcgatgtatgacgttttgcatagagaacgatcaaatccttcataatactacaatgcaatgcaataagttatcatctacaatactgacataagtgaaagggtggtaatttgtgctaccaaaaaaggattggtctatgccataatactagtaaatagtatgtgtccatatcaattaaatattttactcccgacataaccatataattatgcaaatatactttaaaatgagtgtgccgtaataaaagcacaaataacatatcatacaaccacttgtcaaataacaattcaaaagcaataaaactatgaccgtatgtggttgtctttccacatggaccaaaagtttgaccaatggtcatgtgtacttttccctataccaggagataaaaaataatatctcatgatcatgtcggatggaccgcacctccgaccaatgactaacatgcacttttttggccgaccactaacacttcactgtcttcaactaatccaatatttattggtcgcttcagatcttttctaactttaatctcttccttaaatattcggacagccacccaacctttctttaaataataagacagtcacttggtgccacgtgggccactacacacaagaactcatgagaaacactcaacttttcctccaacgaatccaaaagtatacttcttggacacatcactgttccagcatgcaagagtggctcatactgtagagcgcacagactcagagagaactcagcttagcttaggattagttactttaaaatggaatcattacactaaaaagacatcgaataatcacttgctcgagtgcaaagttcgtgtacacgaccacgataatctctctctctatccagaagataatttcaagtctcataggcttttttttttcatttccaggtggcagtgagagagagagagagagagagaggacatgggcttttaagggcgacagtgacgtgcagaggatctgtgacatatccggatggatattcccctcgcgagcaaaggattatgccccgaatcttccatggctgcaggtcattttggctcatggcgtgtacggagtacattgtacttggctgagggatttcttgcggatcttctgcgccgttcaggttgtgtttcccatgttggttgttttttttttaaaataagttcttgatatatgcggtgggttgggttagttgtctactcccagatagctacgagtatttactcatggccagtagtatactcatgtagcgtcgtcgcgtccgcgcttcacaagttttatactatgtcatatgaatggctattaaaaaagaagagtcgtatattattgagttgcttgacagaaactttaagatgggctacataagtgatatgacaaaatgaaagtgatatagaatatgtatcggttctttcaaaatagactgtgtttttgttatgtggtgaaaatgttttattgatgtttatatattgaggaaaaagtgaataacatatttgggtaaggattattattctaattagttaaaggcaagtcggtgaaaaaaaaaggcactttgacgctagcacagtgtagtaattcaactaataattctaactctttagtggatctggtatttatacactatggctgtttcagctccctgtctataccttgtcaaattgcaagacgcatgacaattaattataggaatattctgttggatatctttgcatggacagtagagtgctacttaaataatactgtcaacaaaaagaaaatcacaagtcggttagctctcctcaagaacatacgacttccaagctccaagtgctaacccatattagtattttcttaaagctatttgtacttgcatgtttacatatttcccttcgaacatggtcaaacagggcctgaaatttttgattattttttttaaaaaaattgttgattattaaaaggtgaactaggtagcaccgtaatgtgtatatataaacgattataacgtagtttggtaagtactccctccgtcccacaatataagggattttcagtt

SEQ ID NO: 40254 - DNA, 11601 bp, Oryza sativa
cccccccccccccccaaaaaaaaaaaaaaaaaccccaatcccccttcccccgcttgtgatttgtgaagcgaaagcgaacggagcacataaacacaattatatcctcccccgcgaatattcccatcgtctccttcctcctctcccccgcatatcctccgcctccctttcccccctctcctcctcaaccctatttcaccaccacctccaccgctgccgcggcgagaattcgatcggttcttggcagccgtagtgcagttttgtgcagttttcttctctcttgttgttgaggatgaagtttgggaagagcctgagtagccagatcgtggagacgctcccggagtggcgggacaagttcttgtcgtacaaggatctcaagaagcggctcaagctgattggtgggggtgggggtggggaggagaggcaggcgaagcgggcacgcgttgcagcggatggcggcgaggaggaggccgccgccgcggcgatgacgcccgaggaggcgggcttcatgcggctcctggaggccgagctcgacaagttcaactccttcttcgtcgagaaggaggaggaatacatcatccgccagaaggtgcggcggtgatcgatcgccatttgtgcttcggttcgaatcttcttcttcttctcgagtttcttggttctgatttgggaaatcgacgctgtgtgtgtcaggagctgcaggacagggtggcgagggcggcggggagggagtcgaaggaggagctgatgcgggtgcgcaaggagatcgtcgacttccatggcgagatggtgctgctcgagaactacagcgccctcaactacaccggtgagtgtcccagtccacgcacttccccacccgccgcatcgcaacacccgtagttttcagttttcacatgtctttcactaattatattattgcaaagggttcgttagctgttgcttatgttgtttgttaactcttcttggaatgttctgtgaattggggaggtagtaataagagaggttggaaaaactggttaacatagtagtttagtatccttattagaattttttttgattggggaggtagtaagagaggtagaaaaaaattggttaatatagtagtttattagtgttctcagaaaggtaatttagcacgcatcatagagcaggcaggagtaatggaagtttcctgaacataggtcaagaaataggcgacttattgtggttgtgggcagctatggtttcgcatgtccgctacgcagcactcgtgtcgctgtcaaggagaatggatccttgtatggcaattcagtgcgcacacgtttttgctctctattgatgaatggatacttgaggttgggctcagcagctaatgttgggggcactgtatataaacagtttgttttctcgtgcgagacaagcaatttatagtatggccacatgagtgctaacattgtttatggtggagcactctgttcctttctgctgcaatttgaaatggtaacagtgtgtcatgcatccttctatcgtgaacagattttcctttgactcgctataagaaggtactccctccatcccaagatataagtatttctagctatgaatttggacaactgtgtccagattcatagccaaaagttgctatattttgggtcggaggtagtatataacaattgtaaacaaataggtcaaaaaatttatccttttcaacaggctgtaatacagttcgtcaccaaccaaatggtgcatagaagtttctacaagaaatatttgactaataattgacttggtatcagatattatcttggcaatatttttcactaaaaatacagtctgattcagggttcacatgatgatgcagtagtgtgtagtatagtatagtgaccttgccctctactgcagtgttccatggtagtctggtagattatctgcttccttacctgtccactggcagcatatgcagtgcatatgcaaagtaatgatgtacaactgtactgctttgctatttttcggttggcctttgttatgccttaatgctgagtggttgattttcctctttatcaatgtgagattgtgagtggcttctaatatctggaaattttcattcctagcctgggggttacaggttaatcatacaactcaattaaatctaggtcggtttctgttggcagttgggacgaaaattactcacttgaatatgatgttagagcatcatttctatcataagctccatagttgttttagaaatattgatttagtaagcagggcagcgtatgcctcccctcaccaaatccaaaattaaattcactatgcatcatttcaaagattgcctgaaattccgtagatgcattaataatactatatgcacaatttgcaaaaagttgggtgtacagtcatctgcagttagataaataaattaacttgttctaaattcccaggaagcattcacgcctgaaatactgtagtagacaagtttgcaggctaatttttgcaatatgttataaactatttcaaagacatttatagtttttatttttagtacggcgcaaaatacatatttggtaaacgggggcacatgcttcattgccaaatatttttcatcagttgacgagtcttctgattaaaagtcatgcctaacgaaacaagaaagtgcaattcatgttacgtttgtgatttgcgttccagctattgaaaataaaagaaattagttttgcatatcatctaaagatatggtattgctcaacagaaatttgtgtagctaatttcatgatcttcattagttgactcttttatgcttagctgagatgtgattgatggtcctaactttgcatgctattcgtcatcctagtgcttctttagtggactactttttaaagtcagttttttgctagctgcaatgaacttgaggctaatgagtaccttggttactgtgttattatgtgcttgtggacaatggtttcggtggacgtactgtgaaccagtgacctgtgaccactctttgtatcagcatcttgcttttttctgtttttcctttgcaagatgcaagttgatggtgtcacagacctatatggctatattgggccaggttaacacacactaatttggggagtcgacttttcgaatgtgaacacattctaaagatgaggatgtcacacaaaaagtaaatttgttgttttgcatcatgcaagcttagtatgttttgctcaaccaacagaacagaatgcaagttgcatgcttcttatatgcctgaagccctgaactggaatgtgttactgttaataaccatcattggtgctttgcaactgcacaatacatttctgctgccattttgctcatatcatgctggtctatttcgtatgcttatgcgaataagaaactatattagtgttgtacaactgtctgaaagttttctggttatcatttgcaatatgaaatgttatcctatctcaaccaaattgactagcatctcctttagtggcaatgtggtaccctttacacatcactaccatgctagctttcctgatatgaaaatttactggaccatgcctcacgagaattcaggttcattagctagggatgtgacaagttacaaatggttttggtgcctcagacagacagatgccacagcctgtaagccatacaagggcgtattttctatttccatcagtttgggcagatatcacctaaactaaaatgtttagtctgattgaaccactagcaatagctcatgtcagttatccctgtttattctcttgagggaaaactctttaagaaaagttgtgatattggaagtggattggatgctatttgaaatttggaagatgtaactcttgtactttgttttagattttcaccagttgatacttacgttccatgttgctgtttacaggattagttaagattctcaagaagtatgacaagaggactggggctctgatccgtctgcctttcatccagaaagtgctacagcagcctttcttcaccactgacctcctgtacaagcttgtgaaacagtgtgaggccatgctggaccagcttctaccatcaaacgaactgtctgtatcgagtgaagatgggagaggcgatagcactaacgaggacaagccttcgaatcccagttcatccttggttaatggtggcactattccagagttagatgagatcgagtacatggaaagcatgtatatgaagggcacggtcgcggcgcttaggtctctgaaggagatccgaagcggaagctctactgttagtgcattctcattaccacctctccagggcgacagttcgccagaggagcagcaggaactgtggaataagattccggtgattgagcaggccgccaaatgacacgaccggcatttcactacatggttatgtacactgcatgaccttgatcttgacatttgctggagatagtaccggggatctcattcccctgtcatatattcagtaatttgtatgattccaggattcctaacagttgtaaaatggtggacatgttcagtatacattgtaaaatcatagaaacccatcataaccatcagacagaactgagatgttttgattcactattgtgagttaaatcctgtactttttgctgatctacatcctctttcatgaactctcggtacagaattagttaatgttgcagtataacaattctgattttgacaatctcgattcggagatgattttgttaaagttgtgcaacgtcttgttatgagttagcatcatgtgtagcacacttccactgaacttgtttgttgcctggaaattgagttgattgcgcagtttttactggaatgggaaaaaagttttactggaggggaaaataagatgtctgtaaaatttattcagagacggcaagtattgctgtttaggtgatcaaataagatatttgtatccttttgcacaatcaaattgactatcatatagtgaatctgtttgtgatcatgtttatattatctttgatgaccatgcttatttgatctcaagagccttgtagtttactataatcatgttccaggctcaacaacgtgggcctaactaggctcaactttgatttgcacttgtttaacaaaattgaggaatgttctatacctgtttttagtggttgagactgagacgtaaatgaaaacttcaaccaaagttgagaatttggagagacgcaaaatggaccttttcctaattttgtaaacttgtagggactaaaataaattaagcccacagtttagcccattttcacaattttgtgaacctgggggcccaaacgagattaagcccacatacatttcggctcactttcttgagggcccaaatgaaatttagctacactatgcagtctggcccattttctttcgccacaagtcagagcagagcagttgcggagtgggaaaccccaaaacccccacgtcctcctcctccgccgccgccgccgccaccgtcgccgtcgacgagccatgccgccgcggaagcgcccgccgccgccggccaaggcgccggaagccccaccggaaaccaagcccaagatctctccgcccgctaaacccatcgccgcggcgccgccgccgccgaaggcggtcctctcggacaccgtcctcgccgccttgtcgcagcacgagcgccccatctacaagctcgtgttcgccggcggggacaagggcatgtcgcagacggagatccggatcaagaccgggatgccgacgagcaccctcaccaagcacctccgcggcctcacctccaagggcgtcctcaaggtggtcaacagcgtccacaagcgcgccgagaagatctacatggacgtccgcatcgacccgtcgccggagatcaccgggggaacctggtaccgcaacggccagctcgactccgacgccgtcgcctccgcgcggcgcaggtgcctcgaccagatcgacaagctcggcgtcgccacggcggagtccatccacgagggcatcagcagggaatgctccaacctagcctactcgaccgagcaggtcagggacatcctgcgcaccatggcgctcgacagggaggtcgaggaggtgaggagcaccggggcgggggagttcggcgacctcagggcagggagggtgtgctaccggaggggcggcccggtgcagggcggcatgatggagaggatcccgtgtggagtttgccccaggatcgatgagtgctcgccggatggcgttatctcgccgagcacctgcgtctactacaagaagtggctgcagatggacttctaggtggtgagctctcttccgcgccgctgtttatggtgcgatcgcacgcacaattcagcttccaattgctcaattggcatttgatctatgctatggaattgccacagttcatacattgcggcatgtgatcccggataggcccatgagatagacatactagatgatatcatctgattatcttatgtttgtatttaaattagtaagatttgtttctataatcattattacttagccttttcccctgttagtctttctcatgtatttatctgcaacaagtttagaaacctgtccaacatcaatattccaaattctagggtgcgtgagagtttcatccattgttactcaatcataatatgggacctgagcacaataaagcaattgcttctttacaagcatgatctaaagcattctgctattaacaaaaagaatgatcaacatcggtgaattgaggcttagtttgtcgcgatgtaaagtttcgccattatatgaaatctgaaaaccctgatggctttaatgaatagtaacctgcacatgcaaatcttattgtatctgtgtttcccaacgtggtttggactaagcattaaataatgttaatctgtcacaactcacaggtttgttgtacatacatttgtaagtgtgttgtcccagtagttatactggttgtgaacatatagatattgtttctctgaaaccatagtgcattctccagtcctgtttgtccaccacatttaccacacagactgattttggacgaacctataattgtttaatcatgtggaatttgtgtacactagttcaaatgctcatatatgatctggatggatttcacggtgtagaatagtttactaatagcgccaatttggttacctgtgactataagaagtggtctggatgtggatggatttcacagtgagccagtggggtctattgatttgtgcaaaagacggaaccagatgttctgtgtacgcatgaacaaatcagatacttgaaaaatgacagtgctcagtatcacatttctacatcactatgtctctaactaactgctgcttaacattgtgatacattatacattgtatagccacacctatgtacaaaacagaatgaaacaaagaaaatgtttttttatgttagagcataaggaccacaaaaaccatgaatgattgcagagctctttcgtgagcttgtatgcaaattggaagaagctcatgagagatcatgaccttcatggaatggtctacacctagtgaatcttgatctttgatccaaggttcaaaccaacccaaatatctacaccaacaaattgttcagttagctccttactttttctagtacctacccaaagcagcatcttgcattacaatagaatgtgctatttatgattaggaatttagaatttatgtctattctttgtatatctcatctgtcatctctgatattctaaattttgacctttgattgatcccaaaccactaagtttgtagtgatgctatagtaatttaggtttgaatgttgagagaggctatataatactgttactaaggcatgatgtgccttctttatttttttttgtttctcacaatgtcatcaaaacaattctaaaagtcttctcaattcttttagtcaacttgagggaggacggtggcgtgctggagataatgtatgacaactattttatcaagttgttgatataaatatttgtccaattgtccatttccttctttttgtctgtgcgtgtgtgttgtgtatgatacaaaccacacaaaggatttcatatattaccgtgaacacttctaaaattatttctgtggaagtcaaggtggcactttttctttattaccttcagtttagcccaataagcttacaagatattccaatgatgtattttgcagctttaatcttctgtgtagcaagctgatcaactaacatgtattcagagaaatgggacaagctgctgataggctaattcatgaaaataattgttttgtccaagaacatgggagttgacatattcttcttttatggtttgtactgtcatttggcttacatgttagttgtgtcatcatcttcatcactcatcagtctcaaatcaccttaagatgtgtgcactgcatctgaaggtgatgcactcttatgacttataagttgtgagtctttcatagaactatccacaattccatattattcatattgatgcactgttggcgaatcctagattttgcttccaacttggaggttgagttccatgcttgcttctgtccatactaggtgactgaatcttatgttactgcaaataaaatctcgaggtaatttgcattttatctggtaaatatacaaccgggtgtccttcataaaggatttttctgacaatgcttaacttgtgttgcatcctggagcatcatttgcagccatttctgaaggtgagtaagtgacttccattggaattcaatcaaaatttgaaaagcgacatctgatgaagatctcagacgcctttaaagtgacaaggtatcttcttggaacctgtcaaaagtggattatcctaacaacatgttaacaccagagacttggtcttgcagctccacgttgggcgttttcttgtacgcttctatggttgtgctgggccaagcgcaaggaagagcaacagtctgagtcaggtcatgtctcatgcctcctgctgctgctgcattgtcaaaccgggagaaagtgatggccatctctgaaacaaggtactcgctcagctgttgctgattaattttcttgggaagacgtgttaagttgtgttctttacccagcttacctgctaatcttttttgtgctctttaccagcttacctgctaatctttagcaatgagcgcgatctgcacctggcggctgtgtttaatttgcctttgcattgcatacatattgaagcagctccgaagctacggaaaaagtgcggttgctttaggttaatcttcgctcaccagtgacgttttttattccgatttaacccgtgttgtgtagtatttgttagtgcttggttatatatgtcaactttgaggtgcagttctgggtgaaaacggaaatactgtattttccatcagctgtaggcttctcatttggttctgaccacatgtgctgtgtacgcatatgaactacttgttgcaaattgcaatatggggtattgacttttgtcatcaacatcacagggataaacagtccattgaatagtacttgttggggcaaggtacaatagtcaatagaattaaaaaaaaactagttaggagaaaaaaactgggccatgaacagcgataagcggttttgtactaggtggtttcagtcgtaaaatttaataaaatataagtttgaatatgttcgttttgaccggttcaggggctgggtttgccaaatttcttgaaggttttccgaaatctgaacttctaacgtcacaaaaaaaacaataacgagccctcagctttctagtcattttgggactgctaagactgcttcgtggtccatgtatatctataaacctataacatccctttcttctcttttatcgaatctttcacataggtagggttcagtaaaccattttggttagggttactattatcccacactttagcgattattgcggtaacaatcccacactttagcgattattgcggtaactgcatggttaccgtgaaccatgcagttaccattaggtatataccgtggttttgaaaaaggttattttgaaaaatgttatcacacatgataaccatgataaccgcacggttttgtaaaccatgcatgtagatagagtgtcaccaccgctcacgtctccttgatccaatagatgctcgctagcctcaacacactgccgcgcccatggcttccctctaaatttgccacttccacccatccacctctatgtgttttattggagtttaagtcattgctttcacatgatcgctgctaggggtggatccaccacctagtgacccgggcaattacttgggctcgttaggtggacacgtgatgctaaattttcagctaccgttacactccatcaacgaatggagttaagtttcccaatttaccttttctcgcactaacattttcctaactattaaacggtttgtttttcttaaaagaatatgaaagttgctttaaaaaaatcatgttaatctattttttaaataaatagctagtacttaattaatcataacgctgatgaatcacttcgtttttcatgcgtgaggcattagttcccaacttcaacgtctgaacacagcctagtatgtttgaaacaaattgagtcaaatcatcacgtatggacaaaaagtgatatttcaaaagtttcaagcactttcttatacatgcgccaacttgttgaattcattggttagcgatgaatggtgtcgaattatttcgtatggatcaaacctcacagtaatcgctttatcataaaatctaaaataataaattgaaaaaccaacttttccattctctcttcttatagcatcaccaacagctatctaatgttctatcccctaaatctctttttaaaacctctaataagaatttaaggatttaaaatacacttctttccaacatatagcctaaacctagctccctaaaataaaataaagtgggccatcctctcttcgccggcgatctcgctcgcacaacttccatgcaccgatatcgatcgcgctcctcccgtatgcgatcggctttttgggagaatgtggctattccctagacgtggagaatgattggggattctaaattcttttcacttcaataggataattgttggatcccatttttcttatagaaaaacccattttcggggattaggttttactttaataagggaagagttggtcaatgctcagatatatctaactttgcaaacaaggccctgttttatccaacactgtctctcccggccttccacaatactccctctatcgaaaagtctaagtcatatttcatttgtcaccaagaccaatgagaaattaacttatccactgtgacaaaaccaaaaaactatatacatacatgtaatcaataagagcaaattttatagtgcagctgactgctacctccaattttagccatatcatttactcattgattaagaggcaacatgtacaacaatttacctccaacatacaaaccccaatatttcttttggttcattctcacactattttattttgttctttgagtatgtgtagacataaggaagagtatcttcagacttacttccttctaacgtatgtcactgacatatgttctctctagatagtggacccatatatcagtgacttaaagtcagaggatctcaatccctagcataaggggtggctcaccctcttcttggttctcttttccacctcatcacttagtcatatgt

SEQ ID NO: 40255 - DNA, 4149 bp, Oryza sativa
taattttattatgtttattccaaattttagttagttttaaattactatatggactctatactctacttctaatatttcttattttttaattccaaatttctattttgttttcttaattgtatttctatatagactctatcctctacttctaatattctttatttttaatgacgaattttagttattttataattgtatttctacgactctatactctacttctaatattccttatttttaatttctaatttcagttatttcctaattgtatttctatatggactctagtctcctcttcaaatattccttattttttaattccgaatatcaactatttcgaaattgtatttctatatggactctagtctcctattctaatattccttatattttaattccgaatttcaactatttctaaattgtatttctatatggactctgttttttctttttctccgattaatgtgagaatttctaggccatgagagcgaacgtggaggattctttttctattcctttaataatataatagatagccaaattatataatagttacgtataaatatatatactacactattaatatcttgtcccacttgtcatacacacattgtgacttggagcatgtgctgcagctgtctataaatttgtagctcgctgctcatctctctcttctttcatctcctcgatatgtgtttatagctggcttatagtttgctactgtacctgctcataggaggattaacttaaaaacagtcttatagtatattgtttggtgtatctatatagtccaaacacgtattttcataaaaaaattataaaagtattttacaaaacttaaataacgaatgaataagtgtgacaagtcaataacattttatcgagaatagtagagatttttttcttgaaaaaaaacagtagatatttcatttaaactatgaaaagacgacggtagataaatattacacgagcagccccgtgaatgcaattcaggcacagctttgacaacatagatacgaacacattggatggaccgagtggcacgtgccacgcagtatcactcttgtcctgtcgccttcgatttctcaagttgaccaagccgctctttaaatccctaatggctaatgctgccaaggctgcctccccctcttctatctatatatctcacttgcacctcgcgacccattttagcctcttgctgtcccactcaaaatctctttcgtgtccacctcaccttgcaccacctgctccgccgccgccgccgccgtcctcgatccatccatggccgccgcgagcttcgacggcgccggcggggcgctcggcgtgcacgcggcgtcgcgcaagatcgggaaatcggcggcgcatcagcagcagcggaagccggtgatcatttacatggtgtcgcccaagatcatccacgtcgaggcccacgagttcatgtcgctggtgcagcggctcaccggcccgggggcggcggccgcgggcgacggcggcaagaaggcggcgtcgtcgtcgccgagggaggcgcgcaggggggcgccgccggtgcgcgtcaaggcgcgggccctgaaccggcccgccggcggctcggccgtgtccgtgtcggtgacggcgacgatgcggcagcagcagcagctcgcctctccgtcgtcggcggcggcggccgggccgtcgccgtcgccgtcgacggggttcctgttcaacgacctcagcccgctccgcggcgccgcgctcaagggcgaggccgccgccgccgcgccgctcgtctcccccggcgccggctggcttcagcacgtcggcgaccacttcttcagccccgtcggcgcgccgggggcgctcggctcgccgtccgccttcctcgacatcttcgggccgctgccgtcgcagcaccaataatgatacaaatctcaccggagcaacggcgacggcgacggcgacgcagtcgctgtgcatgatgcatggtcgccaattagggttttcctctcgcgaccttgcacttgcacggcgtaataatcgaaaaagaaattccgaaatgagcttaaaatcatcttggtttgcatatgtataggcttgtaaattaattagttcatcaaaattgtagataatttaggtggtttacaaaattttcccttaattgctcgcatggctctacacgcatgagccatggctgcagcaagggaagaggtcgatcgagttgtgttctattgatttgttcatctgattatacatagatgattaccttttctttaatccttttttgcgattacttgtccttaatttatttgcttgtgcaacttaatttttttgttacagcatagaccatatcatgatatgggatattatccatgtggttttttaattgttttgtgcagtacttcttgcacggcattgtaaatatatcttgatgcacttaattatgatgaattaattgtttttttaagctcgttgtagtgtcgtgcaagtagatcaattgacagtgatttgctcttgcagctggagaattaattaggcgcttgacacaaatattattgttatatatagttgtacagtacaagttgttgatgcctacctagcaatatatataagtgaattttcttttcctagctagctcgatcgatcattctgtcttggacatggaaacgacgacttctaatgattgctcgatcgaggagattaagagcagatcggtgtctgattcacagatgatcgatatctcttgatcaacattgacagagagccataaatggattagttagatacaattcaattagttgccaaaaactgacatcttaagccagttgtaattaacttattgcagttggccggatgcatagagtacggcaaatgggacccgagcgtatagttgtgtgcatttttctgataattgttgtgtgtgcattttaaagacaaaattctcaatcagtatatatacataggagtatatggaatgaagttctatactatattctgcacaatctcaaagtcaaatttcattgttttcgaagagagggagacaggccaacattaactcctcaaaatagtatattcctaccaattctctagttttggtctcgatcacctaattcggtcaagtcatgaatctttaattgacttattaaaaacctcatttatagcatgttctttttaagcaatggaagaacggactaatgcgacatgcttcgtgagctcctaaaacggtgccattttcaacaaaatattttctatatataaattttaaatctgtttttcaacttcacaatagttaattcattcgtttgtaccttcaaatagtcatcacaaaatcattcggctatttaggggaaaaaacatgcccgatttatggaaacacaatgcccatttcttatatttttatcggtgtaaaaacaatattcttaaatagtccacatttgccttttgaaaaccgtctctattatctgtctgataatggtcttcagttagtatagcattcaaccacctaccatgtgcgcatcagttaaaaaggcaaggtgaaaagttaaaacgtccgaagggcatttggtctagtggtatgattctcgcttagggtgcgagaggtcccgagttcaattctcggaatgccccttttaattttttttacgccctttctttccagagttttcacaagctcactgcatgcaattatttgatttcttttagtttcattttgatttattgttttcagttcgtatggtgttttggttggacactaattaagacaggcataaacatcctttcgtttattttccttcaatcttttgcagattaacagtatgctctccatctatcctctagggttttgggataaaagcacgcaattacgctgttaattccgatgagccatagcgtttctactctagctgaaatccagattgttgctgcattttcaccgtgcagtgaaatttctgtgaagagctcgacggagaaatacaagtgatgcaaggccagaaaaaggcccgtaagcccaatcctgatatgggccacatggtcaggcccagtttcttcacagctgaagaagtggagaaatgcacccacggagggagaattcttcatattcatcactggagcagataattttttttctagtaattttatcccccggaattgatcaattactactagttcatctatatt

SEQ ID NO: 40256 - DNA, 4791 bp, Oryza sativa
atttgctacagctacagaaggaccgtgcagcttgctgacacccagcacaaacgatcaatgccactcatgatcggtatgtatactcatctctagataaacaaacaatcgatctattactagttaattacatgttagtaaaaaaaaactagtaaattacagtgtagggtccctatcggagactatgattgccaaattgaaagtagtgttctctccacaccgtggatggatatgttcgaccatccaccaacaccttatgatttttatgattaatcttatgctaaggtcaccgactcaccgtcacaagattgggcaaacactttggtgtcacaatcatcttcagaataaagcgtttgcacgcaactgccgtcccagcagaaaggattaagcaactgccgcccttagcagtaaaatatcttgattctggtaaggacggcagttgctctttcaggcttctcttaaattttaaaatcaccctacctattcaataaaaataaatcctaatactacttagactaaataagtacttattaactaatttaataagctagaaacttaatttattttccgttgtaacgcacgagctctaggcttgtattgaaataaatacagttgcatatcttgtgccaacaaaaaaaaaactgcagatcttattttgtctagagaggatctaaactgtaagatggtacactcatgcacagctaataagtataaatcaaattaggcttaattaacttttattctctctatcttataatataagacgtgcacacatttcaatattcaactttaaaaacatttgaccaataattattataatataaattaaattttatttgttaaaattaaattattggattaacatttaaatttactttaagatgattataattttgttgcaacaaaccttatatatgagaaattttaagttaaaaattagttttgaagattgtactaagtttgacaatagcttatattttgggatgaagggagtaggtcctacctactactccatttcaaataatgcaagcggttagagagagatttcttcctcttgagttaaacccgggagctgtaacgtcaaacgtgcacgcctgccactgcactaacctttgcattcataagcttgtacacatatatttcgttgctcttgcactgatatatggacgtcatctttaaattaaaccatcacgctgaagtttagaccgcatttttttaagaaaaagaatttcactggaaaaattaattaatatagcgacttctacaagatatccagtttaatccactaattacgaatacggaaaattcccagcttcgaaaccaagcttttaattgtagtttcagcattttccaacgatcaatgtacgttgctttccagttttgtgtgggtgaagctagctagtgggtaacattgaagaaagatacatgtggccacgctttcaaattcactgcgtgacggcaccggaaagctccatccccctcaacccatgttattattcagctatccactgaaaaaaaaaaatcttactccctccgtttgacaatataaatcattatagcattttctatatttatattatttgtctagattcattaacatcaatataaatgtggaaaatgttataatgacttgtattgtgaaatgaaaaaaatattagtttcgcaactttttaaagtgaagaacgacagaagaatatcacaagtgatcttaatgtcttctcactccaagtgtaaatagaaagcatcaaatacctttgtaagtaaaatttcaaataaattcttacgaaattggtgtgtttggagcatgtaaactatagcagactatcggtgttaagcctctataaacaaaaggctttttttttttattttcaaagcacactactatagtcgtagtctcgtagattctcatatatacatgcatatatgcgcgcccatccctacccgctgttgacaagtatatacgtcgtatcataagtcgttgaaagagtgattagcacgttaagtctactatttaaacctagtattcacttatttaaatatttatattttagaacagaaagagtgttaaatatagaggaaggattttctatatgagaatatgtggatatcgcatacagttctacggacaaaattactgtatggattgtaaatgagactatgacaattataaatcacgtgcatggacaattagacgactgttcttgaattttactaactccttgagcgtcccttaaccattaaaaaatgaagggaaagaataatattaaagtccgcccggttcttcgtataaactattgtgcacagaaattctacattatgaaaattgacatgcatgggctaattttttttattttgcaataaataacggaaaatgttagcgattgggcgctcgatcagcgccagaaaaatcgtgcgcccgccgcttcttgcgcctccgcgcgcacctccgtgccgtccccaccacgttccccaccacatacgccattgcaacaaatcacccacatattacgaaaacgctctattaagaaaatccgtttcattttttgttccaccaacaatgtttcagcaattatactcgtgatgtttcattatgtatagatcaaatgttgcggtgaattgaaacatcctttcgctatttgatgaaacattatttttatatatggtaaaacaacttaaaaaagacaaaaaaaaaacattgattcatacgttgcagcaaaatgtttcatgagtggtgattttgttgtgtttcaacttttaaaacgattgaaacatttttttaatctacgtagttaaacaattccgaactacttcgtgcagcgtccgatttatagacgcctctagataacaactgttttttccaaatgtcccttaaccacatataatataaaacaaataaaaaggacagttagaaatgggcgaacatttcgacatgggcccatccggcccaataaagaactaaaaaagaggacatggacatggaggagctcgcatccccagtccccgtcacgtggacgcccattggccctcccgccccccatctccaccatggcctacacgtcagcgaccgtcccatctatcactccatcccctttgggaaatcccaccacctaccattccccatcctctaccctaactcactgacatagcgggcccacttccatccgggcccacctgtcattgtaatgggtacgcactatgtaggtgagaaaggagagtcccttacccgtcgtcttcctcctcgagacgccattgctgccgaggttgcttgccattcccggccattccaatccactcccaccaccaagcgcgagctcgattatttttttaatcgattttctccgatttaatccgtagaaaattccccactcctcctcctcctccaccgccgccgccgacgccgcactcctcactccgcagaagcaacaccaacgccgcactccaacgccaaccgcctccgcgcgcggcccgtcgccatcgtcgagcaccttcacgcttcctcctcccccgcacggaacggagacccctagcgccgctataagagggagagaggtgggcgggactcatggcgcccgcggcagcgtcgctcacggcccccaacgcactcgcggcgacgtcgttgcccttcttgcacggaaggaagagcggcggcggcggcgtgtccgtgcacgccggggcgccttcgccttcgcgggcggtggcggtggtggcgcggaggttgtgggggagcgctagcagtagcaggaggatggtggtggcggcggcgacggcggcggagatggcgcccgcggcgagcggggaggaagggaagccgttcgtggaggagatgagggcggtggccatgcggctgcacaccaaggaccaggccaaggaaggggagaaggagccgcaggcgccgccggtggccaggtgggagccctccgtggacggctacctccgcttcctcgtcgacagcaagctcgtcttcgagacgctcgagaccatcgtcgaccgcgccgccgtcccctggtgtgagtgatcggaaaagctcttcctcctccgtgctctactttggaccgcttggaatttttgtggatgacgtttttttttagaaaattttgaactgaaatgatatttgattggttcatacggcgacacccatgaaagttggaaatatttctcaccttctgttctagaatagtcaaatagtataattgtttagccagaaaaaaattggatgcacagctttttgtgaaggaaaatgtcaaattgaagttggatgtgccatatggtgggagtaggagcacttgcaaaccccctgttttgagtttggtttggatgcttgagaaaatatatgtaatccaagttaaggtattaaaagactttgagcctatgattatttcatgtcatcgaggaaattgcatcagctttggataagtcagctaccgatctgaaatttaaataaaaaaaatgtatatttccccttctgttacatgatatgctcttccactgaccataagaccagtgccatgtgcaggtggatccaatttaagtaacattcagcccacattttttaaaataaaacaaaggcatttctttgtcattgagaggcatccttgcctggcatgctgctagcaaaacatttggcaggcacagaatatgtttttgggagggtcttgataaaattgtttaggtgtttcgaaagtgttaaaacgctttactggcaacatttctttaagagtatcatcaaaatatcaatgtttgcctatatgtatcaagtaagaagtacaggaagccatgtgcatgtctatttgcagt

SEQ ID NO: 40257 - DNA, 5537 bp, Oryza sativa
tgcaaacagcttatgttggcaccatggtaccccaattttacatactcttgttctgttattctgctatggtctggtatgcaaataacacaataaacgttgcctccaattttggggggtgcacatcatgcagttattctgctagttgagttatgggcagcattttctttataacaggatttcttttgaaggaaatccttgagtctttataacagaatctttctggaatccgccttgtccttaacccttgagtctttgttacaccctttcatggacctacgttgtccgtcaatttgcctccactagctctctgtgtattggatggttggatgtgaaagcctctttcttattgatgattactttgcattttgcaaggaaaacatttcactagcaaagaaaattaaataatatataatgttaacaatgataccctttatatcttctagcttgcttgctgaagttttatggtatctggattgtctgcatttatctgtattggtgaaactctagatttttctatttgttttacacttaagttttagaacaacacgtagcttggtgtttggctagttgaccagttccacttaagtacttctccgtttcatattatagtcgttttgattttgttgtagtcgaactttttaaaatttgaccaaatttgtagaaaaaatatagcaacatattcgacacaaaacaaacatattatccaaatatattaaatgttagttttaatgaaactaatttgatgttgtagatgttgctaaatttttctataaacttcatcaaacttctttaagtttgactaggaaaaaacaaaacgacttataatatgaaatggagggattagtaaataattgagaagcaaataatgagtacctttattctactcctacataataccgtgtgcaatttgtttgcacctgaaatcttagcaggatagagaacttttgtagttttgtttatgctgtatggaagtatggaacaatgagtcataattacttgaacgtccacataaaatctgtaatattctttttagatggaaaattgaaactactataaaacagctagaagatttcttccatcaatatttgcaagaggctgcttattgacttcctatttatctgtatgtatttcagatgctgagttcaggaatactgggttggagagatcagaacaactgaagaaggatctggaatggttcaaggaacagggtcacacaattccagaaccatctgctcccggcactacatatgcttcctatctggaagagctggctgaaaaggactcccaagcttttatctgccatttctataatgtgtattttgctcatacggctggaggccgaatgattgggaagaaggtacagtttctgtcttttttaatgatgaattttttatatcattcaaaagctcactatcttttggtaacatagttcagaatggattcctataaatgcgtagaatattagctatcgaagcaacaaaactgacactaacagaaagtttgttctttgcttcattgcgctttcctgactgtatagtgtggacacttttgatgtgagatggtttcttttcttaggaatcagattgaccggttgctttggatgcttatattggtattttgttctaacaaaattatagagtacgctagtcgagataatgaaaatactacataaggcagcgagtgctttggcacgcagtcccttttaggatcctcttgccactactgttctcaagttgtgctgctcatagacgtcaaggtttttcaacccacctgacattattacaatgcggttttgtttgggcatatgaatagcagttttccatgcttgccacctcatttggttcaacttgtttgaatttcttaaacgtttaatcatgcccttgttatcatcttaggtctctgagaatattctgaacaagaaggagctggagttctacaaatgggagggcaatctgtcccagctgctgcagaatgtccgcaacaagcttaacgaagtcgcctctgtaagtccaggagctctatttgccacgccactatctcccccaattctttgatacgagcagtttgaaatgttgctaataaccaagctttaattgttccatttgctggccttgcagagctggacccgggaggagaaggaccattgcctggatgaaacggagaagtcgttctcgtattctggagatctcctccgtcacatattcacctaagcttaattgatcacggtgtctgctatctagtcttgataaacgctgtaaatactaaagttcacgtcagtcagacagactgttactggacactgggcagaggtcatttacttactcaaccagttggccttgcctcccatcaaattgccaaattctaataatccttcggtgtgccacttgtctgttgctgtgctagcatctccttgctaattgccaaatgggtaatttaactgaaagttcttgcgttttcaggcgactgaaatgtgacaaaacaaatagcataaatgttgttgatctcctcgacgtattctccaaacaggcttatcagttatcaacatatgtaactcaaatttcgagtgcaaaataatgaagttctccctccacaccctaataaacatacaatttcacctcctcgcaagaaaaaaaaaatcagagaagtcctttttttttttttttgctagttgagagcaacttactagtatagccttggtccaaatttcatccctgaacttttatatcatcaaacatactacgtctttcaactaaaaaaatgtttgcttttttatgtgttgtttacgcgtagcgccaacaaaaagaagatgccacatagaagttgtaagttgtaacaccctccacaccatgcaagctacaaccacttgtctttttttggtttcagcccttatcagccaattacatttttatttaaatactcagattttctttattcatatataagtctaacattttatattacgcactctgaaaataaaaaaacttatataaacacccaccctcccctttcactatacctatacgtcactcctccgtctcccgtcgggcggcatcaccgcctctcccctccttagcgacgcctgcaagaagacgagctcgagctcctctctcccctcctcggtggcagggacacaaatcgaggtggcgtggtgttgatagggacaacggcaatggatctaccctatataacgacctcgacgacggatctgccgaaagcggtggttggggttgtgaaatagctggcactggtgcagattgaggcgccaatgactggcgaagcttcccggtgacgtcttcccgtgacggagtgtcttgccatcgtatatgcccttattcttccctgccattcccctcgccgtctttgctaccattgcagagtccgtcctcgagctcgcccgatctgcacgacgatgacaaccatgacctcgtttatggctataagggcgagaggcctcttcccaacgcgattactcgcctaatcctcacgcgtggctctatcgagaacacatgtgcctcctgtaggattcgtgcaccctagcagatccctccttcttgacgcgaatattctcgttgggcagggcgagaccgcacgtcagttaggagtgttgggcaatggtctaagaagtacacgaagcttaggaacaaattcatatcaatctaaatgtggttaactcgaccataattctaggaaatacatcagacatacaacaattcctaatatataacttgtatatgtagcggttgccaacgttgtgatcggaggcggtatataataataatcatagtttgagaactttctaaaatctccaaaactttagaatttgtcagccccgggcatgaaaatatttcacttgaaaatgccttttagaaaaatgtaaaattgtattcaaagttcaaacaactttagaccagaaatttcgcaatttcggatttattggtgaccgatatttttttagctttccaaaattgttaaccctgcatatagtctattataccacttttggtttcagtttgtttgtttttttcctccatttgcattagttatcccattggctacaagctaggcctgcacgcttaccgccaaaaatatcccctcgcaccaatcgtctcctcctgcatatgatgacgagacgccaccggaaagcatctccgcctaggcatctctgatctctccagggaggggattttaatctctcaagagctcgtcccctccgttcacatatcacttaaataattacaaaaatactttaaaaagtgtaagaagatatgatatattgcttttacatgtcgcgacgagagccctacctaggctctgtgcactgctggttgttcccatccggaaactgtgcgcgcggaaaacggagcaatccattagcgagtgattaattaagtattagctattttttttaaaaaaaatagattttttaagggcaacagcaatgtttatgaccgagttcggtagtaacgtggacccgcatgtcaggcggtagtagcaggatatgaacgccacattgtatgtgtaagatgattggatataacatgggccccactataaaaactcaccaatcctcagctgccgtgactccaactgcgagaaaacaatacgttgatacttattgacattgtacaaataacataacttattatttgttgctcggtagtagccatatgacctagtagtacttcatccgtttcacaaggtaagactttctagtattgcccacattcatatatatgttaatgaatttaagcatatatatttgtctagattcattaacttctaaataaatatgagtaatgctaaaaagtcttacgaagagagtagctatttactactttcacaatgtatcttacctagtagtaaggatattttaatgcctaatacccacttttcatcaacattgtggatgccctaagtaactttcgtatataaaccttttacaaaaaacactgtttagcagtttgaaaaacgtgtgtacggaatacgatggagaggggttggaaacctgggtgccgaacagacccagtcgttctcttctgccggctcaatttgtcgtcgtcgtcgtcttcctcctcgatccatatatttctctccccattcttcgattcctcggcgaccacctgtgcgcattgcgttagcttttgtgtcgtgttgctggctagctatagcttgctgctgcgccggcgagtgatggaggtggagagccggtacgtcgccgtgaggcaccacgtggaggggctcccgtcggaggacgacttcgaggtgaaggcggcgagggtgaggtggtggccggagtccggcgaggtgctggtccggaacctctacctgtccgtggacccttaccagctcaaccgcatgaagcgccgcagcgcgtcgcacctcgccgtcgacggcatcgtccccggcgaggttatatgctgttcaccctctctatcgcaggctagccttcacacacttcgtcgtcgagctcattttttctcgtgtgttcgtgaagaggatcgacgcgtacggcgccggcgaggtggtggcgtcggcgt

SEQ ID NO: 40258 - DNA, 5866 bp, Oryza sativa
ttgaccgaatgtcggaaagggttctcagacacgaatgaaaaaactaatttcataactcgcctggaaaccacgagacgaatcttttcagcctaattaagccgtcattagcacatgtgggttactgtagcacctatggttaataatggactaattggactcaaaagattcgtctcgggatttccatgcaaactgtgcaattagtttttgtttttatctatatttaatgctctatgcatgtacccaaagattctatgtgacgtttttggaaaaaaaaaattgagaactaaacccggccttagatccaagggtgaaaatttttgccgtgtcacatcagatatacagacacacatttgaagtactccctccgtcccataatataagggattttgagtttttgcttgcactgtttgaccactcatcttattaaaaaattttgtgcaaatataaaaaaaataaaaagttgtgcttaaagtactttggataataaagtaagtaacaaaaaaataaataataattccaaattttgttaattagacgagtggttaaacagtgcaaacaaaaaactcaaaattccttatattatgggacggatggagtattaaacatagtctaataataaaacaaattacagattctgcctgtaaactgcgagacgaatttattaagaccttagttcccaaacaaaaacttttcaccatgtcacatcgaatgttcggacacatgcatagagtataaattatagaaaaaaactgattacacagattgcgtgtaaattgcaagacgaatcttttaagcctaattgtgccatgatttaacaatgtggtgctaagtaaacatttgctaatgacggattaattaggcttaataaattcgtctcgtagtttacaggcggaatctgtaatttgttttgttattatactacgtttaatacttcaaatgtgtgtccgtatatccgatgttacacgcaaaaacttttctcccctcgaactaaacagggcctaagtatttgggaacaaaatttctgaatttgtaatatccttttccgggcgatattatgtggacccagaaatttggaaaagtatttcgatttagtgaaattggttgatattcagtcaatataggttcaaatttctagtttttcttttgttagtcgaagtcaagagtactgaggtgttcctgctacttgcaatcttaacccgcgacagattctctgagaatcagcactaccctgatcatgagatttataaatcaaattcacaggttgacctgctgaaaaataagcttggattcgatgacgctttcaactataaggatgagcctgacatgaaatcagcactgaagaggtcattattctgatcttaccaccgtatgatcttaaaaaattcttcctccattttaaattacttgtcgctttatgtttatagtaagttaactgtatctatttttatcattaatttttagtcatccatatagtttaacaacatgagaattactaatccgtccaaaaaagacaaaccctaactatgaatctagtcacacatgtatccaagttcgtagctaggaattggtttttttgaatgaaggggtatatattatgaaagtatttatcatgatgaattcagaaatatagatatcgtgatatcaaacaatattagtttatataaattaatggtcaaatattagaatattgtaaatttaaaatgatgagtaatttaaaacggtgagtagtaaaatgacaaatcctgccgggtaacgttcttgacagatactttcccgacggtattgacatctactttgacaatgtcggtggcgagacactagaggcggcgctggcgaacatgaacacctacggccgcgtcgccctttgcggcgtcatctccgagtacaccgacgccggccaccgcgccgtgccggacctgctggaggtgatctacaagcgcatcaccatcagaggcttcttcgcctgggatttcctgacgaggttcgccgagttcaccggcgtcatcagtgactggatccgtcagggaaaggtccaggtgatcgaggacatctccgacggcctggagagcgtgccgtcggctttcgcggcgctgttcagcggcgacaacatcggcaagaagatggttaagctggcataggagtacacagccatggccggagaaaagctaatgggcatgtcagtgattcagagtcaaataaaatttaggtgagacttcagaaatttaccgacagtgaaacaaagttgttttcttcaactattgagcatgtcagtgactcggagtcgaataaatttaggtgatttcaggaattactgacagtgaaacaaagttgttttctgaggtagcatagccgcctctgtgactggattgaactcactggtcacaacactctgcaacactgttaactagtagtaccaatcaggtatctgagtgtcggaccaaatcagaaaaaagaacacatggagaaaaaggcaggcagcaggccttgattatcactctgcattctacaatccacctttccagcagtttgatactagtcaagtacacaagtcaagtctaagaaatgaaacccattttggcgttttgaacttcaaaaaaaaaaaaaaacaatgaaagcaccaggctctctgaacatcccaactgcatctactcatttaaaaattgcacataaaacaaaatatatatagtatgcatacccaccagaggggcaagaaaagggagcaagtaattcgctatgctcagcaatgggaaaagggagaagaaatcaaagaatacatgtatgtaatcaaaatgtgccagtttgcccagaagaatccaagttaatacaacgaaatctcaagcgctgcaggttggcaaattgatctggtcagtgctgtgattttctgaacgaataatggaccatcttggacaacccgcagcgcagagagatcaagaagagattattaatggttgggggctgatataatcctctaacataacctaatgagctattagtgctgtataatctccgtgtgctacggccgtggtctcctgtacggtgattcaactcaagtggtttgtgtaaaaagatcacctatctgaccattccatccatgtggaattgatgctatgtgctgctgcttcttcagctagtagatgactagctaatggcgcaacatcctcgaattttgatagtgtaacctaccccagaatcatattactgcaagtttcacaagcaatgcttgtcatcaaagccttcctgggtgagcaagcctgtgacaagtttctttagcctgtctgcaccaggccctgggcggagatcttgtacacgctcaacagtgaacgatcctttcactgttgtcgtgttcaacagatccatccacccacctgccacgaacccgtcaggttggcggcccaataattcctggtcgatcttgtctagtacaggatcttctcttccaaactttcttgcaaagggagcattgctgttaaccataccgtcaaagtcattgagggtgaggtagtgagggtgttgctttggtgggttgtcccaagaaatgaaatgtagatcatgattcacagtggtgttgcggaactctgggacattgcaaatgactgtgtggaagtaaccctctggtgaagaaagaaaattggcataatacatcaggaccgtcctgggaagattgtcccaaccccatatgcagtattcaataaattgatgagtaagcatcatccacgccgagcctagaacatgatacatataaagcatgtattagcattctgtgagtgcaaagtggatgaaaatttaacaaatatgaactccatgcaagataatgaaatttgcaaaataatgaccaaattatacagtcaacataactgttatgcacaattgattggccataggttcataaccagaaagggaaagaagtagcatggtcagtaatacaatgtcccgatactaaagattggccatagttttgtggtcagaacagcttggttcaaggtttcagcaagcaactggaaaaccatagttttgtggtcagaagtaacagtttggttcaaggtagcaagcaactggataaccatagtttgtggtcagaagtaacagtttggttcaagatttcaacaagcaactggactttgactgtccaacaaaagaaaaaaggttaggatcacatgatgttttcagaaatacctagtaagattagcagctgctttgtcacatacaacaaaacgtaaccaatatgagatgggcaagcatatattatagtataggtaaacattatcttagtctatgacctgtgaaatgaggctagcgcactacagttaagaaattggagtgatactatataagacaaaaacatcggtttcaccaatgcaagacaatctgtccaaagtgattttcttggttctggaaagtaaatttggtgctgaatgctgatacaaagcagcaagcaagacgtcattgtactggagagctgcaatgacgctattgagcaccatctcgactgttactaactaccttgctgcgagtgcatgctatcaatagatgccaaaccatagtcccacaccaattgatatcttccaactcgattctttagcacatggtaagttgatagaagagagttgacatcaggactcatggtcgaccaaaataaaaacaagaaataacaccaagaggtcagccggaaaaaaaatatttttccatgtctctagcacggttacatgcaagtaaaacttgattgcaggatgaacaattactcactaataaacatagcatgagacaacgaatgcacggagtaattaatttgcaactgaaatggcaaacgctcaaggtggtgcagataaccaaaaaaaacaagaagagaaagctcatgcagaagcatcaggttagaggaagcatttaccagtgaagagcttgaatgcggttggaacacttcttttctctgtaatccagaaaacatcagatttctgcaggctgtatagcccagggtcaattatcaccggctttgccctctgatacctacagagaaaattttagccacaagcagcttgcatgaacaaaacaaacaatactttcagcgaaattccaatgcttactccttccatccgatgtcactggtatgctcaataaagttaagttgccttggcaagtcagatagaacatacaacagatctgcaaagcacacaagagaagtaagattaacatctatacatgttaattctaacaaacatgtttactgaatttactcaagcctaatccaaacaggccaagaccaatgatctccacgagtaagacaaatcatgaaaaagaaagtagttgtagatcgaaatagaaatataaagcaagatcagagcccaggggagcagagaagtggaagcctccatataaagaaagaacagccaaagattttgcctaccccagataccacctagaaggggcaaaatcaatcgaatcttaccaaattcctagaccagttgggtaaacatgtcataaattaacaaaaaaaatatcactgcataccccaactggcaactgcaaacgtataaaaatcacctctttcccctccaacccttccacccaactaccagtcacaatttgaaatttccaatcccaatccccaatatgctctccagtgagccaaacttagaatcgaatgagcccaattcgatacgaaagcgcaaagatcgcgttcatttttttggatcggagctcgcgtatttgcgcgatccaatcgggggcgattggattgaggcggggtaggagatcgcatcttgggggcgcttaccgtcctgcgtgacgagggggtagtcggaggcggagaggttgatgaaccagtcccactcgccgccctcgcggaggaggatgaacggcggcgtgggggtgc

SEQ ID NO: 40259 - DNA, 1943 bp, Oryza sativa
ctgcacccccgccgccctcgcggaggaggatggcggcggcgtggagcgtgttggccaccatggtcgggccccggtaggtgacgaggttggcgcgggtgaccaccttgacgttgcggaaccgcgagtagaccgggtcggcgcgcaccgcggcggcgagctcggcgcgctcggtggcgggggcctcgaggtcgaggtggacgacgtacatgttcgacgggtggtagagcgccctgagcgtgcggcgcagcgcggcgccgtcgccggcggagccggacacgaggtaggcgatcctcggcacggcgccgcggccgcgcccgcccgacgccgccgcgccgcgcatctgctgctgctggcgcagcttggcctcgacgaagagcggctcggcggatgccgcggaggggagcggggagaaggagaggaggagcgcccgcgacgaagagaagaagagggacgccgcgatgaggagcgacgagagcagcacggacgccagcagcggcgccgcccacctccgatggtacccaccccctgccacccccgccgcccccgccgtccccggcgacggcggcttcgtctccagcatccttccttccttccttccaccgccaccaccggcggcgtggatcgcggcgaggcgaggcgtggattgggatcgggtgcggccgcgcgaggaggaggaggaggcggtggtggtgggattaaatgtggccgttcggttggtgatggatgcgtgtgggggagaaagagaggaagagaagggaaaggaaaaacgcccaaggaaatctgtctctcgtgtgcgctttggtgttgggtgcggggatggatgacgatgagtcgatggtgatgatgaccatgcgtctccgcctgctgctgctgccggtcgcgttgggttggggttggcctgtggccaactcaggattgggacggcaaatctcccttcttttttcccttttttttggaggacgccaagtctctcttctttctggtattttggtcgtggagtatagcgaggggtttggaatatttggagtggatttggtattttgggtgcaatttattttgacttcacgggtatttggttgcgattgaaattttgaaaggagaataatataaaacggtatcctgtttggacggaatgatacatgtaagatatctaatgcatcccgtccgaacgcgataccgttacgtagcatttcccttttgaaaagtaatataaataccattgtgatttgaagggtagtgttatcgaggctaatatttgtatttagactcatgtattgctactttaaataaaaggagttatctgtttgtttctctctcatgtctcatacgccaccacccctccctttaagaaataaccatgatttatgcaatatccatgcaccatacttctaatctatttccagtcacatgggccaatactcctggttaatcctagccatatggccatgaaaaaagaaagttgttgcagtaatgtcatcgagactcgtgttctcaaaatctttcatatattgtgtttgatttgtagtcttgtgttcaatgacaaatatttctaaaattccatggtgtccctaaatacttcactatgtcactcctgatgctcctgaattttgttcgatcttctatatgcatcacccctccctttgttactttaccatcagttcacatccatcattaatttcttaaaacatttgcgttatcccttacctttatcaagataagatccaaattaagagtcaaataactgatcatgctgcattgatgcatggtgcggctgaaacaaacccactaactcgtatagaaaatcattcataccactttctcctgattgacttcaaaaataaaatatcctggtgctattgaggtacacttgttcaataaggattaaataaagcatgcgcaaccgcataatcttgctatgccctaaacaaatcagtgttggggga

SEQ ID NO: 40260 - DNA, 21449 bp, Oryza sativa
taggggtattttggtcatttcgacaaatttgtacagtactaacggagactaaccggacggcgatggtaaattgtagaagttaagcaaaagtcgatggcatattgtagaacatgacaaagtcagtggcaaatcgtagacgtgcgacaaagtcagtggcatataatggattatctctaaaaaaattttatggtgagttggaactgaatcaaaatccaatatataaaacttcagtgtaccaccttatactctgtttggataatgggttaagaggggtgagattgtgatagggatataagtggagggttgagagaaatgagatatgaagaataaacggctaggattaaaagttatccttttagaaggtaggataagatttccccattccattatccaaatatagtattagggttaaaaaaaagaacaatgcatacaaatgaccatttaataccgtagaaaaacaaaagtcacatgtgtcaacgtttatttttaggattggatttattttgggatagagagtaccaaatatgttgatattctttaataatattaaataatataatgatcatttgagaatggagggagtactaattaattaccagttgggatatctgttcgtttaatagtttaggtgcacgattaatccagatctgttgtctgcctaaccaaccacacatctctcagctatactgcatcaacttcacctggcttatcaacggcagaatcgtccgtattagtattccgtgtagaatggtcatgttgatgagttatcccttcgttctaaattaatctacatatagttgttttgaggttatttctaaatgatctacatttttatgtttatttgttaagtgtattcgttatttgcgcattagagtaaatggacattgatacatgcatccatgtacataagtatttataacccacgtgcaatatcttgatttgctattggctaggaaatagtggaaatagtgcatgcatcaagtttgttgttagagtaaatataatatgatagagttattagatttttttttttgtcttggtgtatctagtatatcaatttggaatggatgagtactttggtgtttactccgtacctatcaacagcaactggacaattaatccttaaaaaaacagcaacttgacattttcttatctgcttcctttcacgagagttcggaaaatgtgtgggcccagttgcacgaatagatgacaaatggacggtagatcttggttgttgtctctagtttaatcatgcttagaaattcgagccgtcaaatgcagaattcttggatcatctgagagtgattggcatgtgctacttcgtgctgctccactcgtttgttttgagattctaccacgaggtaagaccgtaggaaaattcagtaatgtgttgttttgtactcctctttttgtccatagattcatggcactattcaaaagcatgcggtgtgaatagttttcactgaatcctgtcaactgcacatgcattaaaatacaacttgtttttttcatgtcgttatttgcaaattatactaatcaaaacaaacggataaacttttagattgaaccatatttgaacgagatgataaggtgggatattcattctcatatgtattagtgctgcagaatcacctttatacgaaatgcataaaacaaacacaaaatacttgaaattcttttcaataaaaggttatcaaaacttataagtgtcatacgaatttttggctgtgttcgtttgggcatgttcccaacccatctccctcgttttccgcgcgcacacttttcaaactactaaacggtgcgattttttttttcaaaaagttgctatacaaaagttgcttaaaaaatcaaattaatccatttttttaaaaaatagctaatgtttaattagtcacgtgttaattaactactccgtttttcgtgcgaaggagatgggttcccaaccctaactaccgaacacccctgggacctcagatataattcaatatcataactttaacaacttcactaagatgagacattatcaaaccgataataatactaattctcttgaactatgattcaaacatggcacgaccgaatttgtcacgaaatagacgattattgctctccaacacgtcgatcctcaaacatggcgtttatccccctgtttgcattttcgattttgattaaaattttggtgatttcaattgtactaaaatttacgatttttttgtgattttaggtatttttggaccgttctttttttgaaattttaactgaatttaaataaactttgatcaaatttaacaaacattcgagaaaatccaaaaattctaatcccacagaacagaacagaatgtcacgtttgattcgatgaaattgccgggttccaaaccgctccggggtaggacagaagaacacacgagaggcaactgggaacgtcgtccacagcagagcagagaccaccctgacgcccgagcccgaggaccatcgcttccgctggccgaaagctgagagcaagtttaatagtacagcttccaaatcatatatagctaatataatagtcaatttatataatactaattgtttagtatattattaatacatgatcctacctgtaatatacatattacgtcttttaagtccgtgctgtagctagctacagatctatagcctgctactattttcttttcctttatttttttaaaattttctgtagctgacttatagcctgattgatgcgctgccgcgcgacgtgtgccgttgtacggatctcggggggcgagacgagacgagacgaccagtgaggagtcgccacggccgcggcctcaggcatggacagaaattctccgtatttcttctccttttcctttgtgatttgatctgtcccctcttctaggtccttctttctcgttgggttttggttgttcttctagcatcaggttctgctggtggtaccacgcatccttgcaacaactttcgcgcacggtcaaccgactgcaggatgagtcgccgggcgagctgcctgatttttttcttcacattttgatctttttaaattttattctataaatagaccttaaaaaatacttatcacaagactagattagttttcttgacgctaaaatcattggcaccattgttcaatatctcaccgtcgagacatcgacacactatcaccgtacgtagtagctaagttacacatgtgaaggggtcagtatcaaaagagattgacattgagaacttatttgtaaaaaaataaaaagggttgcaatgtaaatattttattacaaataggtctttatgtgtattttttggtgaggatctatttgtaataaaaatatttacattttaatcatttttgaattttttatatagatctttgtcttcagactctttgacactgacccctacatatcacgatggctagggtggtgagggtatcgggggcaacgttgttagcgccgaaacattggaccttagcgtcaaggtcactattaccgagaaaggggttcatttctataataagattttcaaaatctatttataaaataagttttcaaaagtgcgaaaacataaaatccaggtgacttgctccttgagctttgctggctaaagaaattgctgagcacacgtatagtcttgtctccacgttcgcaaaattaaaatttaatttataattcataattaattgtttttttctattttccagccttaccctataatctttttcgttgcatggagtccatattgtcctcaactatcgcgtttctaaaagaaagattcaaattaacgtttgaaaccatttattgaccgccaggcgggttcacaaaactgatcagcattttaaaaaccgttgatggttaatttgtcaaaaccggtcggttttagctagttttaatacgatgttatccgaaagtcatcggttttcggcaactctgtgagtatgttttttctagaacaaaaaagtaaaccctgctgccaggtcgtcatacttcaataataaaaatgttattaaaaaatcaggacccacttaccatatctccccttcttataagattcaatggtatgtaaacagttttggtggtaaaaccagtgaggtggtgcctatagtttgctgtttgcttttgacgtgccaatagtttgatgtttgctttggacgtaacgaaacgcgtccgtaggtgcaacttcggagttccccgagcaccataaccgtatcactgatctttagttaattgctggatcactgtccggacagtcggcgtgtggtgtaagcaaaagtgcgatttggtcactgattgcctctcgccccttgctcctgccgatcgtggatcgccgatgcagacgacgcgtgtgccgcttacaataatggagtggagtggggcaaagcttttttttctttttctgaaaagagacaaaaaaatattttttagaaaaaaaaagtagcaaagcaatttattactgtggatttatgatacacgtcatctactgtaataacactatcattataaatatgatgtgtgaaatgataaaaaataaaatccatatatcaatggttgtagtggtagtaccattactacgacagaggatcttcatccggttttagctaatgatgattcagcagcaattgttgtggtgtcaatccttgccggtgaacatgtgtaatgcacgacaacgcggtggttctgcagcgcacaaaagttgcttaactgccattacttcattcaccgttggaaaaatgatcttggctgggtcgactgttttccacaataattccagttctaataagaaccaggactgaagattgtttttagtcccggttataaaaattttgatctttaatcccgattggtactaaagatcatttttttgtcccggttcatggcctatcagagacatctcaggaggtcgaggatctttagttccggttgataagatctttagtcccggttgggagtaaagattatttagatctttaatcctggttgataataccaaccggactaaaaatctatcttcttggttggactccaaccgggagtaaatatttctctcccatatctgattggttaagtcccatacgagacttcctcctcaccaagatatttagataagatcggatcatcccctctcctcttactctttagatctccttcctccttcttccctcccctctcctcgccttcctccccttcctccttctcccctctcctcctcacatccggcgctcggcgtcggcgggcaggctgcgggcggcggggccgcgcacggggcggcaggcgccggccgtggcgagcggcagccacagcggttctctccggctttttttttgataatttgtgattgagagatgtataatttctttcttttagaatttgtgattcattgcatggatctgagatgtataaacgatctgtgatgtatttgatttgtgtgtaatttttttaagatttgtgatgtatttaatttgtgtgtaagtaacttaggatttgtgatgtgaatgatttgggatgttattttggtttggggatttgggtatatgcatggcactcaatttggggatttgatgttcgattttggtatatacatggcactcgatttgggagaaaataaaaagaaaatggaaaatggaccagccgggactgcggactgcccctaccctctctttagtcccggttggtgttactcccggttggtaacactaaccgggactaatctttagtaccggattcgtagtatagggggttacaaaccgagactacaaggggttacaaatcgggagttaagacgatttctccaacagtcccggttggtgttactcccggttggtaacactaaccgagactaatctttagtaccggattcgtagtacagggggttacaacccgagactacaggggttacataccgggagttaagacggtttctccaacagtgattgcttgatgcataggagcgttgtcgaggagtgatcctctctagcgggagatcgtgagacacccctttcgtgagttcggccgggggcagcgggtgagattcgaggatttggtgagcgaaactgtgtgtgtgatcttgatctcggaggctcctccaagacgatgagacaaaagaggtttatacaggttcgggccgctatgaagcgtaacaccctactcctgtgtgtatgattcttctgtgcttagaaagtccctgaatccttggtatgcaagctagggttagacaagctttggctcagggatcctcactccgatcccacttcctcgctaggcatggtcctccttttatactctaaggggataccacatgtgatgcgagtgctacctagggagaagggaaaatattttctatattaattacatgtcttgtgccttagcccagaagctatctgcacgtcggttgctgcgcggggcccatcaaatcatgcagggcgcccttgtcattcgccatttaatagatgaggacttccgggttctcattcacaccaggaaacgggaacccgggtcagttcagagtggttggaccagctctgaccggggtaagaggctttgaagcccctcatcattatgatgagatgggacagagcacaccgctcgccgcctgacacactgacagagcgggggtacacagtcgccgtcccatcggtcattcaaccggtcacagaccggtcagatgcacagcacgccgcataaaatacggcatggcacggttgcatagaccgctttaaatgcagttaggtgggcgttaggcgcgcccacctaaccctgtacacgtgggctgatacgtggagggggtcgaggcaactcgaccctaagcgagggcggcctcctccctctagcttggagggagtagccccgcgccaccccgggctcgacccccctcggggtgagccacgtgggtttaggggcggcccgaccccaagctgggaaggggcagccgccgcaacccccgggctcgacccccctcggggagagccacgtgggtttgagggcggcctcctccctctagctgggagggggtagccaccgctccacctcgggcttgatccccctcgcggggagccacgtgggtttgggggcggcccgaccccaagctgggagggggcagccgccacaacaccccgggctcgacccccctcggggagagccacatgggtttgagggcggcctcctccctctagctgggtgggggtagccaccactccaccccgggcttgatcccccctcgcggggagccacgtgggtttgagggcggcctcctccctctagatgtgatacccccgggcccatatcaccgacagtagcccccggcgttagccctgaccaaaaccttcccccggtggccatggttgacgccactctcctagtctaacgatgtgggcccggtctcttctccattctttgttggcactagggcccatgcgtctttttcgccccaacttgagggcgactcgccggcccgtaccttaggttgtgaacttattttctgtatatattcagcaaacgctgttagattctctcgggcccgcgacttcatgctgcgcacctcgcttgctcctgccttttgttaacctctgttcatgttctacttcatctattcaaacgattattttcgcgtgagtgtgaggactgaactttccatagccagcaatcctcacctgcaatcaagccaagctgtgtgccatagccagtcggcggggccaaagccaactgctacgggagagccagcacagggggccccgggcgtcgacggcgtccaaagctcgacgcagggctaggatagagctaggaatcgtagcccccacacttttagcaaagaatcatttgaatgggtgaagtgaatacaaactttttgttaccaaggggggcaaacgagcgtgcgacacgtgggaatcgtgggaccgcgaggaagagatgggtgagagataaatataagccatgataattttgctgataagcatgaataaagaagatatatacttaaaggaagtattacaaatgctatgctcaaaaagagtccccggccaacgctgagctttcccatagaggtctgctttggtccgggtattgtaacacctcctttgttacctttgtttatccttgtttacacgtcgcgagctttcaaacctttggctcgaagagggctccccaccctgggcttcgaaccctttagggaagcctgcgaccacttaacaaacgaggtcaagctcccatgaacctgcgccccaacgctacacattttgttcgctctttcctttcggtggcttccttccaatctctcttccttcttcatggacgattactttcgcacgagtgtgggagccgaaaaattctagagccagcaatccccgtccacagttgagccggaccgggcaccgtagtcagccggcgggtccaaagccagccgctacggaagagccagcacagggggtcccgggcttcgacggcacccggagctcaactaaaggctaggataaggctagaagacttagcccccacacttagcgaagaatcgttcatgtagatgggagagaggttgggctcttaccaccgaggggccaaacaaatgcgcaacacgcgagcgtcgcagggccatgagaatagaatggggggaaattaaatataagattttaagctaatgaattgaaaaattgaaaatatttgaaacttgaaaggacgatcagttgagccgggccgggcaccgtagccagccggcgggaccaaagccagccgctacagaagagccagcagagggggtcccgggcttcgacggcacccggagctcaaaactgcaagagtcctcccaggagtgaaccgatgcggcagcaggttcatgggccaaccccgcgcttggcccctgagggccatggggaagaggttcaccatgacccagtcgccacccccacccagccgccgcaacccccgggctcgacccccctcggggagagccatgtgggtttgagggcggcctcctccctctagctgggagggggtagccaccgctccaccccgggcttgatcccccctcgtggggagccacgtgggtttggggatggcccgaccccaagctgggagggggcagccgccacaacacctcgggctcgacccccctcggggagagccacgtgggtttgagggcggcctcctccctctagctgggtgggggtagccaccgctccaccccgggcttgatcccccctcgcggggagccacgtgggtttgaggacagcctcctccctctagacgtgatacccccgggcccatatcaccgacaagcgtagatcaaaatcatatctggcagttgttatggcctttaacaaatgattaacagataaagtcagttaaaactgcactacctctatcccaaatataaaaagtaaacattttatatttagaagcggaagtgtaaggtggtgtttggatgcaataacgggactaattttagtctctatcacatcagaagttggaacactaattagaaatattaaacatagactaatgacaaaacccattccataaccttggactaattcgcgagacaaatctattaagcctaattaattcatgattagcctatgtgatgctacagtaaacatgtgctaattatggattaattaggcttaaaaattcacgaattagctctcatttatgcaattagctttattattagtctatgtttaatactcctaactagcgcctaaacatatacggactaaaattagtccctcccatccaaactctccctaactctcttggcatgaaatatttaaagttttctccatgggtacaaatggaagggagttgcagaagagaaatataagaataaccggtgataagcccacacattgctgtggcttcttcatatatagaaaacattactgtacttcttatctgaaaaccgactttaggaaggtttaggtcattttatgatagatttgagcctatctatagtagaactttcaggtagactttttatatttttgctccttttaaaaacttattttacaagtagatcctaaaaaacttattccatagatagacctttttcttaatgctagtaaccttacaccgaggtccaacgtctcggtgtgaacgacgctagcactgacaccctcactccctagcaaccgagatgtagaggggttggcgccaaagaaactagcgttgaggacctatttataaaatattttttaaaatggttaaatgtaaatactcagcgccaaaaagctaccgatgacctatttgtaaagaaaaatatgtttgttttgttcttttggaaattattttataaataggttctcggtactagtcgatccccttcacctcagcgacttaatgtgtgtttggctctctagcccagctagccaagctcggcagcactaaaccatctctttgccagcttgctaaccttgcagtggcttctatgtttggatggttttgcttcatgtataagtattagtggctagctgatgcagatgaattattgttgctgagttcttccgtgaatcatttttccttttagatccagactgattgttcgctgtatttatgagttgatggagagaacaattttcaacaaagcctaagcgagagttcgcaacaaagaaatggaagaagaggctggtaagattgtgcgagtcattgaaaaaatcgctaattttggagaagtatgtgttgccctcgttctaacattttcgcgcaagcagagtttgccatcaaaggagagccgatttggctctccttggctagctagatttttcttaccccacaaagccagattattttaccggttgcaaacgcgtagctttgcttggcgaggctaggatgacacttgcccaggatccaaacatgcccgtagctaccatagaggacaagggtattagcgtcagtgtctttgtcgctgagacattaaacctcgtcgccttgaccctgatctgagaaaaagattgcattcttagaataaatttttctagggtctatttgtaaactatttttaaaaaaggctaaaatataaatatccagaaactttatgtatctctttaggtcgagtgccattgtaacttacatgcggggtactcgatataacgtgaatctatttttcacctcaactaaccaacgtaaaaaagaaaaacaaaaaacggagagagaggaaaaaaaaaacctggttatccgtgtctgtctaatgcccaatgtacacccctacggctcatatcaggatcctctgcagttgaagtcacgtgactttatcactgacatgtggacctaatgaccactagacccatatatcagtgacataggtaccgcgcatttaattgcagactatctcaatccttgtggctcgcctatgccgttgctcctgtgttgccttgctatctgacagcaaagagttattaccatcgtacctacgattagatggaatatttcttagtactacaaatttaaacaagctcagtacttcgaatctggatagactccatatagaaacaatataatactatgaatccagacatgctccttattcagattcgtaaaattaggaactctctgtccaaattcgtagtattgaaaaatgtcacatccaatcctagccttatattctaatacggaggaagtaggttacagtcgctacacgaatcttgaagcaatccaaaaccatcaaaaatcggtccaaacaaaagagaagaaaaagggactgtctaacaatcattcgacagattttctttagaaaatcagtcgaattttcaagccatcaccatgtgctgctcaaatgaaaacgtatcaatgtacgtcagtcactggacattaatcacgtcagtgatgctgctaaaaagaaaaggaaaaataagcaacttacatcaacttacgcatgtaattttttggggttacatatgtaattttgaaacttacgctataaatatattaaaattacatatgtaattttaaaacttacagcgtaaatatattaaaattacatatataattttgaagatttacgatgtaaatacatgccgattattttttttatgaaaaatatgacggcatatatatagtccgaaaatatcaaatcacacctcaaacaattaggttaactacagtacaacaaaacaaccatgagtaaaaaaattaccatccatgtaaaacaaaaattacacctgcatctattaaaaattacactgtaaatgtagtgtacttaactatgaaactgcggtgaaagttttaaaaacgttaggtatagcagcaaagtaatcagtcgcttcttgcacagttggtacgatgcacgtcatgttatcctgacatcatgtggtcgattccatgctctagcggcatttttttttcactcgaaggcacgcgcacaaatctcaaagtaaatcatacggtgaagaaatcgacagatttttaaccaaaaatctgtcgacagatatacagcaattccggaagaaaaaacagtcaacagacaaaaaacgacggcaacataaaaagatataaaaaaaaagaagagaaggaaatattttgagtccaaacaattccaaacccacacaccccacccttcattttcttccccctttcatatcctctttttccctttttccaccctccacagccgcctccttctatcgcccctctgcttcttctgccggagccgccgccgcgccctcctcctcgcctcctcgcgcgcgccgccgccgccgagcgagcgagcccggagggtgcgtggacggcctcctcttcctccgtcctagccttctccgctccctcgcgcgcgggcgcggcgcggcgcggcacggcacggccggcgagcaaagttcggagaggcggcgaggtcggccggcccagccagccagccagcctcgttccgccacctcgggttttttaaggtattccttctccgctactcagtgtccctcttccacctcgtagctagtatcccctcctccttcccaccgcccccgcttcgtagcagtagcatccctcctggtctcctcctaagcggcacctcgtgcggcgtagattggagattcatccggattgggattggtttcgtctcctctgattaatcttattttcctgtgtggtgctgtagtatagcagcttgtttccagtgaaaaaaaagaaaagaaaataaactcttcttttttctaggtttatctcaaccccatgcccccatgttaggtctgcccatgccttgaagggttctttggactttattacagtttgccattgctaattgcttacctagattctttgtttcttccttgcttgatgtatgcttcaaagtaactttagattttgccttttgtaatacatagcgatttctggagagggcgggtaggttcactgaatctgccccatgtttatggtcaagtagtgaaaatgtttaattggtccataaagttgtgattccattgtgctagaattgtggtagtggagatggtagggcacttgatgtattcttcttcgtttccaacttttgggattggtggctgagaatgcggttcttgttgtggctgtcaatgcagtgcagtcgcccgccttcactgtgtgctgtagattgaggcaaaaacattttccaggagatggcagcgacgatggtggcgatgtcggccaagagcaagaacagcgtgctgacattggagaagaagcagggctggtctgtcccacaacttccggagctccggttcccttgggatttgcatgaagacaagggcttctctttgagcttacatggctctgcctcccctcatggtgggctgtttgctagcgtcggtctcaaagtgtccacagctgcaccagcagtggcacccagtcctgccgagcatgacttcaagattccgttcgctgatcattgcataaagtatgtctcctcagcagtggggtaccaagttcctgggactgaggctgaatctgtcaatgaggaagaggtggtggatggcaaggctgtgaagaaagccaagaaacgtgggctgaagctgaaaattaagattgggaacccacatttgaggcggctggttagcggagccgttgcgggagctgtctcgaggacttgtgtggcacctctggagacgattaggacccatttgatggttgggagcaatggggactctatgacagaggtattccagtcaatcatgaagaccgaggggtggacagggctgttccgtgggaactttgtcaatgtcatccgagttgcaccaagcaaggctattgaggtaagttataaatgttggcttatgttgatcctttacaaagtccaaagtcctattgcctaactttattataagaactaatacattttttgtttgaacaaagatgtaactaatgtatattagttgtattggatccaagttgtaactggtgttggcttatgtgagccagacgtccttttaaattttgagcaaactatagtttttttttgaccttccattgagatgctaatgttagatggatgcttaggaaaagacaatttgtattaactactaacttataaccacttcaattttgtggatggcctatcaaaagcagtaaaacaccctatggaaaatggattttccgctattctcaataatatttccgctattctcaataataaggcaatgccacactgtagtcaattttatatgacaatcagccttctatcaataaagtaggtatgcaactaggaaatacacttctaacaaaggagtctgggttcaccacaatggtattttaatgttctccattttttcatggttgactctaatcttcatgactacaaacatctatatgtgtagtgatctcgagactttaagcaagtcaaagtatggactatgtagctttcttatattttttattgtttcattctgatattttgagctcactcgctttatttaagtgtatgctttgttaggcactggctatatgccaaaacatgaatagtaagatgtttaacttctgggaaatgctgacttagtgcgtccaaaataaacttgtgaaaaacagttttgcttttgttaatcttcacttccatggtcttacattgctaaagacatttattttggttttatgaggcggtggatggatacttgttacacttgactttgactgagattatgtgaccacttttttcttatgaattttaggatgtcagaagtacctaggattcgtagcaactaatcagtctctctttgattcacctattaagacatagcaataccttaattcaactgatttttgtcttttgcccaaatgcagctatttgctttcgatacagccaagaaattcttaactccaaaggctgatgagtcccctaagacacccttccctccatcgcttattgctggagcacttgctggggttagctcaacattgtgcacataccccttggaattgatcaagacccgattgactattgaggtgaataaaactccgttaacttacacaagtgcatttctctgtgtacacccacctaaccctacttttttctgcagaaagatgtctataacaacttcctccatgctttcgtcaagatactacgagaggaaggcccctcagagctctaccgcgggctgacaccgagtctgatcggcgtggtgccatacgctgcaaccaattactatgcctacgacaccctgaagaagctctacaggaagacattcaagcaggaggagatcagcaacatcgcgactcttctcatcggttcagccgcgggtgccatctcgagcaccgccaccttccctctcgaggtagctcgcaagcaaatgcaggtcggagcggtaggcggcaggcaggtctacaagaatgtcttccatgctctgtattgcataatggagaatgaagggattggcggcctttacaaggggcttgggccgagctgcatcaagctgatgcctgcggctggaatctcattcatgtgctatgaagcttgcaagaagatactggttgaagatgatcaggatagtgagtgaagcatgtgctcttgaaggaagatgagtcccctagttctttttctttcgttgagaaatgcaagttggatgattaacaatcaaaagtttaggactaagatatttgagatatctgttagatcaaagttttggctttggcttcatgtcaaaggattatttggcttcttttgtgctcgagttcaaatctatgaacaacaatgtcatcctgagcggaagcagttttgtcgtgattttgttctagattatatgcgtattaatgtcgtcgtgtcaagaatattttcgtatcacattgcacgggcatgactagaacatacgatacagaattcaagagaaataaccaagaattattaatatgccatgaactaccattcaaacggatcaaattggcagagcctcacaatgtatgtctcttgtcggccatatttaactgaaacataaacctgctgctaatcaacagttttgagttttgtcacgattttgttcggtcttttatatgcttcccctgctccatcagagcaacctgtttttgtcttcagaaaaactacactctttcttgggtttatctgggaaggattattttcatcttttaaagagaaaaccgagaagctaaaagctttaagcacaacaacattgcaatacacaaaaaataacaaaaataggcaccatgaactatcattcaaacgaatcaaataagcagagctttttgattacacaagataagtctcttgctgaccacaataaacggaaacttaaacctagcaggagtactaaattaaactcaacagccaacttaaaatagtttatttagctagccttgttcctcgccctcagcagcagccgcggcttccctctcctcggcagcagctgccatcagctcatcaaacttctccgtcttcccaagcaaaatttcaatctggacatcgcaacaggatcagaataaggaaatcgttgtcctggtaatgaaacaggcatggaatagaggaaaataaacgaaccttcgccttctgcataggacggctccttgagtcgtctttgacatcaacagttgatgtcatgatctctgcaagaatttgatcgagtagttaagagacattgacttcttagtacaaaaggattccggcgtcgaccaacaggataataaggcagcatgaacttactcttttcaacagcaaggccattattttttagaatttccgcaacagtcaccacagtggcaatggctgaaataataaataagaggtttagctgtttgaaaacatcataacgacaagcatgagcagtggcagctagaagaaacatcagcagattttaacatacaaaatgaaataaaaaactcaatcatggtagaaaatccactaaaattcagatggatgactagaatgaaacaacagcagaaaatacaatgccaattgccaagttacacaggaaattgatgattgtgaagccatgtctatggtcattagtcaatacacgcatattagttgtacattccactgctgacctttcataaagaagttgcacaaggaatcaataaatgatcgtgagatggggcatttgacatgaattgcaaatcaaaattatataatggctattctgtcaccaaacattgacactagagtaggcatataaacagttgtaagtttattccttgcataacagatccatcgcatcaatttgacaacaactacagattgcaactatcaatacaacagatgcatatatactccgaaaggattaataactaagggcgaaagtgcttacccatgccgagcgccgagagctccacctcattatgctgctgcatgtatctctgcaatcatcagaaaaacaacattagctccaactccaaagtatcgtagacatttattgtaatgcgacacaaacatttgctttaccaatacattcataaaagcaaatcacgaacaagaaaacaaaatcgacacttgattcaaaagctaggtctttgaagattaaaatagaaatagatcgatcaaagggcagctttttagggttttagacgaaaaaccccccgacggatcgaagcaccaaaaaggatcttctttgttaggcgggataaggggacaaacaagaatcggtcaaatcaaatcgacgaaacagcagcagcatccactcgctattgcctcatcacaaaccgccacacaaaatccggtaacaaaaaaaaaaaatcgaacagcaacaaggaacagggggaggaatcctgaccttggcgaggttgacgtagaagaagagcggcttcttggtgttggagacctggatccggttcttcttgtgcggctccgtgatggacaggttgctcaccgcctccgtcacctcctccatccccgcccgaaaccctaacgaaacctctccctacctccgaaacaagaaaaccccacgacctagccgccaagaacaaccacaacccggcgcagcgcaacggcgacgagcacgcgaggggagcgaatccggcggcggcgcaagaggaatcgcgagggggagcaaatccggcggcggcagcgagattggggaagaagccctatcgggtggtggccgcttatattgggggaggaagaatacaaggggggtacgggtcgggttcgagttcgagtccggctcggtcggaactcggaagcggtgcggttgcaactctggctcgggagaggccacgcgggtcggagacggactgtgcaggcccagtcgtagctgggcggggtcgttgggcccattgtcgaccaggatattagagagcaattgggttgggtgtagtctggcccaacttggctactttctgatggactgaggtcctgactcctgagcgtttgcccatatttcttcgtaagctaaaacgatttattagaaaataaaattaatttataggtgaaatttttatatatgtattcgtagcgacttaaaactcaatattaaaaaaaatgctacattggaaatatattaaaatcaacttacaagttaagtttgaaaatttaaatttggatactgagaacgaaggagtagcaaaacacagaagatcacatgcactgaaccaaaatctcattacaaggatcctctacagggatcgcgcaagcgacaaccatgaaaaacttgaacggcatgtttggctgctaggtctactgcagccgcagccggcatcaataatgtcgcacacacgctgcagcgctcgcctgccgtacatatgcaaaatcgagacttgtagtgtcctcttcgtaatttatttatataactaatagcttatctaaaagaatttgacatttttttccaggttgcccctgaggcgtgataaacttcatttggacaacagtaccaaattagaatcagtttaatcattgatgtacgttctgtcttgctcggttgtgttataaaaacttttctacatctccttgttttcgtacgtcataattttcttatatattctctgctaaaaaaatgctcgtgcgttgcaacgggtaaatacattttcctagtgatacaacatctattatgaaatgatcaataatttgaaacatcatgattgctttacactataattgaaaaggttaataaaaaaaatttcttggttttgagccaaaagcccattactttttttttccttttcaccccaagcacggtctgatgtctcctacctctctccgctcggactgtctctcttccgtccggttcggtccacaagtggaaccttagacccagctagcacaaccgccccatttagcagcgtcttaaaccttcggaagaaaaatccttttgtgccccgtacgatgacggatccgatcctcccatcaaaaatccagtcgagtcttttttggtctcccaacattggttcagagcttttgattcactcgatctcccccgtacgatgacggggccgatcctccccattaaaatctagttgggtcttttttttatctcccaacattggttgagagcttttgatccactcgatctcctcttttcgtttgctccaaatcggagcaaatccgcaaaactcgggacaaaaagggattggggaagctcgtcggtcggtcatcattgctgaccattaaacgaagattaaatccggcgaagtaaagccaaattgaaaggggaaatcatggaggaaacaatgagagaggagtggggaatcgatttttgcaatcaacggaaagagaaaacgtatggggaggtagatcgatgtggcggcggcgttaggggtcggcctaggcggcggctggagattaaatccgggaaaattaaagccaaatcaaaagaggtagggaatcgattttttaatcaattgaagcaggaaacgtatcaaggtggtggatcgggcaatatacaaagtgacaaaaaaatatagtgcgtagcacgcgtgtggaaaaattggatgagatccaaaaaaagggttgtgggaaacaccggaaaaaaaatcaaagcgggatagaaaaagaaaacagcgaaaaaaatggaccaaaaatattacgagaagccttacttattttttaaataggtatataggtatagatatagatttagcaaacaacgttgaaaatatattaagaacaacttcaaaattaaaatttaaaaatcaaaattttcttattaaggcaatcaattctaaaaattcagaattttcttactaaggcaatcaatgagactccttgtgccatgatcgaagcttaagggtacgaacaaaaacaaaaacgaagagtccttatgtatacgttgtaatcctattaccaatctcttgtttagtgagttcacaataaaaaaaacgattgctttgggtggccttcagttgtaacgggttgggttttagattctacagtcaggaggacgtgtcattccgtgtctggttctactactttttgttgtgccatacatgcatggtggccatggaccaaaatcgtgcacttagtgtccgacgacgatggatcacggattaaggcttttacgtgggcatcatgctgcttcatgcgtgatcgaatcggacacaggcgacgacgtacgaagccatggcaaaaacatcttaaactcttataatagataaagataagcatgataataaaaattgccctggctccttagtttctttcacttgtctattccaaaaaaaaatacagtattagtaaattttgtggtatagaattatagatggctagagatatagattttatatacatataaatatcacacatatatcatcattatattaaccggaacaaaacgctagtataggtgtccctgaatgtgttaactcattactccaactccacggttcaacgtaatcgtgcggggcaaagaaaaactggtgatcatatatcgcacacttaataacaatcaaaacatgactaaataagtcttcctataacttcaacttcaagaaaaagaaaattgaaacgagcttcaagaaaattaaaacatgataagttgagttcaacttcaaggctgtaacaacaagtaatcacgtttcaattgatattttttgtttgacttctggacatcatatatgtggatctcatgcagggaaaaatcagatattttt

SEQ ID NO: 40261 - DNA, 14486 bp, Oryza sativa
  unsure (1)..(14486): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgattaagcataattacataagctaactcctaagaaacatcatcagctctagtcgctgtggctgctaatataagctatgttgttcactattcacttccaagtatgtgcagcagcataaagtagttgtgtatgtacaaaaaggagttgttataaagaacagaagggcatgtcaagtataactgttgtgatataacatgacagttaggaattgtaccagtacgccagcaaagatgtctcaatgatctgatggttatcgcttcatttctgggaaatgaaaattaagagagatgccaccatagcttcaaattctgtcctgaaggcaccgtcttgcacttcaaaaaagtagctacttaaccagtaaaatcatgtatcgtcattatctctacagtcagccatgtcaataaatgatggccgatttgccaaacagctccgtaattcaatcaagggagagatttttcttcattgcttcatacactaggtaggtaatacttgctgcaggcaccactttaagaagatttggtaggattcctttgtagaatccagaaacaccctcatgctgtagcgttctccagaatacatcagacatacctctatatgcagattctgaattggctcgttgagcttgcagtctacaaagatttaaaagtactgttgagaaagagtgtgtgtttgcttcttttctttacaagtcgacaatgcattcttaccttgtcctgataacctgtaaagggtaaacacatgttgcccccaaggctcctgatacagtcccacagcccagttgtactagaggaccaggatctacacaaccatgataaaattcaagaatcaagaaacggagttgaaaagcaaaagggtaggaaacagaaacagtttctgaatggaggctcaccactatccttcaggatatatgtcttggatacgtctttcaatgtctcatatacagcaagatcaattccggcataagggacaataccaagcaaagatggaaccagacctctatagaatgctcgaggaccctcgtgcatcaatatatcccttgacaatgcaccaagactaggtactttaccatccacacatgaataagtctgcagtcgtgttttcactaaatctacgggataaattgctgtttgtgctactgcaccagccaaaccaccagctacaagacgttcagaaggaccaacttcgctcttattttctcctttgctcttcataatatattctttcagcatttcataggcataaaatcttattgcgctttctggagcaactttcacaacattcaatccattccctctaaaaaatgctaacatgccaccctggctccatatatccttaattgaatgcatgactgtagttcgtgtagtctgtacttgcatgatcactttaaggcggtcaagaggtgcagttgcagtacgagatgcagcacctgcaatccctcctgcaatcagatatttacttgcattgaccgacttacttatgccttctggtataacagcctgttcacctatatctacaagacatactctttcccagtgatgataaatattctcaatggttacttcattaggatatagcaaaagaaagtccctccactcttcaaaagtaataattccattgttgtccttgtccacatgctcgacaaaccgtgcaagctcctcatcatcaatctctatacctgcaaacaacaagctgacattgcttgtaagatatattatggatgtgcaaacaataaaatctctaaataacccaactatgaatatatttaagacttcaggcaaagcagaaccaaggaagcaaacaatgtgtatgcttttttaaatttgacagaaggtatatttttggtagaagataccataaattaataaggtatagctaaataatgcaaagtcagattgtgctctcctgcaagctcaacatccataggaaagaaaattatttttggtcatacttgagacaaaaatatgatcacatgaagttaagaacttaagatgatagtgttttcaactctgaatgaagaattgtaatctaatatgaattgctccgtgatatggttgaaattaaaaccatcttaactaaatgtcaatgcaaaaaaaacttcctgaacaaagaccgccctaccacatttaatctttcttctcagccttttgagaaatattctattacaaaaatcatccacgtcaagctttggcatgagaaggtatagctgatataccagttttatcattattagttctcaagtcaagctagtatgttactccgtaccagttcaaaacaaatcataaatataccgcctacctaaattcaccttaaggaattccacttagataatgcattggccagctacaattacctctaaatcgaattcatataccccgtgctaaaatttgaaaaaggaacatggtactcaccatggccatctttcactaattatgcaaggccaaaagtttgggcccaattgattggaagctgcttcagccaccttcttgaagtgattttatcatgtgagaatgcttcgacttcacctgaggcactcaaattcggttgcctatactacgaaagtcttagtatgggaacatagtcttggatctatatgctgtatcaataagggattcagtcttctgaaactaatagagttcgccttgaacagggaataaggaaaataactaaaacgtttgcactcttaaactgcctccagtttttggactctgtgacaatctaatatctaacaagaaactgataagtctttgaggctatatatttgctctcataactatatatcacaagattaacgaagcataaaatccaacattaatcagtcaaaaaatgaggaaccaattcaacttattcagtggaagcaggttattgtaatgaatctaataaaatatggaactcaatatgtggaactgcttaacaagagaggatttaggacaaatgcaacgcatcaataggattggattctatgagcttcaacacttatatatggtagatgaacacctaatatgaaaacctgtgagcggtggcaaatacaaggcttatcctgtttgatgtgatggcaaatacaatgtcttatgttgatcagccctagttccagtgaatctaactacagaataattacattcagcaggcaataatatgcaatactgataggaaaatgatttcagagatccaagttcacattgcactagtgaaacgtgatcccgtaggatcatagtcatgccactactaagtggttaggctcaatccttcctcaaatattgtgggaaaatggacaaaatctagtagcatgttaactgaaaattttcagatgctcccaaggttccactactcaatgtcagtagatgacactgttctaaaactcagccctaggctaggtaccagtgtaccacctaggtgactattgggcgctaggtgcccggtggccgcaccaattaggcattatatggtgctttagtcaaccgaactatccttgagggctcttgtgctcatattttagtgttctattgtcttaacttttatgtgatatgctcactaattgcttggtttcactagtcgcgttggacctaggtactggacatgccgaccatctagtgcctaccgccttattgaatgttccctacaagtaccattaagctccattggtatcagtacattgttcgccgcataaggacttcttcccgtcttcaaacattacaacacacatctacccatcgagtaaaccaaaaccaaaaaaaaggaacaattccaatgtatggctacaaattcaccacgagcatccagcaacaatcaagtaaagtaataatgcgtttgaaaccacatttcgccgaacacgtcagaatacggacagcggagcgacgtgtgacagcacgggaaggaggcgatcaatggctgcggaaggtgagggtgaaggtgaggcgagcgcatacataccagccttgacgagcgcgtcccagagctcctcggggaggatgcagccgttgtgctcgacgtcgatggcctggaagatgcggtagagctcgagctccttgtcgtccatgtaccgcctgaagtcgtcgtacccgacgcggccgtcgcggtcgcggtcgcaggcgcggagcagctcccgcgcgtacttgcactcggcggggatctgcagcgcggcgagcccggcctcgatctgcgcgtagtccagctgcccgcgcccgtccacgtcgaagaaggcgaacatctcccggatccgcgcctccctctccgcctccgtctcgtgcagcgccagcagcacgtgctccatggtcaccgcccccgccttccgcgccggctcgcaccctcccgccgccgccgctgcagccgtcgccgcctccgccttggcgacggggggcggggaggcgccgccccgtgggtccaccgcgtggaccgccgcgccgggcatggcgccggcggcgaggaaggaatgggggtgagggggaggcggcggcggcggcggcgccggtggtggtggtggtgggttgggttggtttggggaatggaatgggaatggaaagaggaggaaaggttggagaaggggaagggaatatacgtggatgtgagaggctgcatacggtatgtatgtatgtatgtatgtatgtatgtatgtatgtatacgtattggaataccgtattttttggggctcatggaatacgggaaaaatccgtatgtgtgggaggggcgcgcggctggatcggtatgggcagccgggtgccgtgcgatgggggacggatggttagatatccacgtggtcacgtggagatcttttctcgaataataaacaatactatttgaaatgaatgaattcttccgcagttccattccaagaagcctggaggtagttttggaaatataaagaaaaaaagacaataaaaacaataatattgcattgacactacaatatttatatcttatatgtttactattttctatataccattattaatcctaaacaacattagacggagtagaaaagattttttttaaaatataatactagcactatgacataatcacatgaaacattttcgataagactttattggcatggttctttttctgactgtgagaaaaaatgaggggttgataaaaattatgctcatgttacatctcgtgtctcgttagacctgtcatggcaccgccacctacatcacttgccattgtccataggacttagctacattggtgtcaccgacacgtcgtgtcacattgaactcgctacccttcactggattgtcttctcctcagtcgctctctaagcatgccatctcccaaacacccttcggaccttcacatcacaaaccctacacgtaaaataccaacccgatagaaccgttgaatagcatcgatagtctaaggtgaacgttttgtatccatagaaagcactcgtcgagacagttcaattgagaggtagaaaagaattagatatttgttggtatgttggtatgttggtatgattcggtagagaagaagcaacctgataaaagaaacaattttagggcccatttgaatcacaggaatgaaaaaacggagaaataggaaaaacataggattctgacaggaatgtaagtgtaaaacagaggattgcaaaacacagaaaaaacataggaatgaccgtttgattggaccacaggaaaaacgtaggaatttgaggagagataaagactcaaaggatttcttccataaggttctacctcttgttaaaattcctccaaaacttatatgggaagaggcattccataggaatttcatatgattccatagggttcattcctttgattcaaagggttttgtaggaaaaattcctataggaataaaatcctctaaaattcctataaatttcctttgaatcaaagggggccttagaaaagaaaatctcatatatttatatttttttcccttgagtgctaagaccacctcctgcatataggtcgggtggatggtccaacctcgtgcgagttgtgaatgctagtagtccccttcgtgtatcttgctggtgtctgaatacatttgatcgagccagcgaagtgcaagtgattctgatttcgagactgatggacagtgatgtatgatggtgtgatcacgagatttgtttctactccctccgtctcataataagtgacgtttttgactttttatttgtaacgtttgactattcgttttatttgaaaaattaatgcaaatataaaaaaagataagtcatatgtaaagtacttttgataataaagcaattgacaaacaaaataaataataattcaattttttttaaataagacaaatgattaaacattgacaaacaaaaactcaaaaagacaagtaatatgggacgcatgtaatagctgctgctaatactacttaaaatacctaccgtcctgtacaaccacctcgtgcttattttcagccccatcgttttgtacgcatgtgagaatgagctgtgatagataggtgcctaattcaagaatcatatctaaggtaggtccaggtactccggttctaatattaaacaaattcctagtacaagtatttcaaatagcaattacaattattttgagctagtatgattgaccaatatcatacttggctgagtctcatattgtaggaaaagttttccacgcacaagaaacgacaaactcattagcacatatttattaagtattaactatagtataaacttaaaaaatagatttatttaatttttttaaataacttatatatagaactttttttttaaaaaacatactatttaacaatttgaaaaacatgataacagaaaagagcagggcctggaaaattttcactctccctgcaaagattacaaataaaccccaaaaatgaaaattcatgatctacatgatgtaggctgagtttttgtttagataatggtgtaggcttcagtttattacaaagaaatattttcaacggggaatccatggttaatagtgacctgacgatcctattcatctcgaacgatctttgtagcgtcctgcccaatttgcaccttaaatatttcccctggaatctcaatcatgccaacgtttggcttattttgtttggaggatgtatggacactgagaaatggggaataaatatggaaagggataggcttaatacagaagaaagggaaatgaccaaagactatggcaaaagcaggaaagctgggaagcatcagctggtccaaagcagagcaggtctggctaccattttctccaaaacttccatgttacaactgaaagaccagatcagcaccaaaatttggtgcaacaagcagcatctgagagggtgacactctgacagggaggttcctctgcaacagagctataacatgagaaaagtgcttcttgatcttcagagaatcacacagcagtgagtaataagcattggcatagtcagaggcaacttcaagccttcaagccaagaatatacttgaattccgacaataggtcagggaaattacaatttacaaggataagcacactggcaaaaggtaatagaagtactaaagcttctgacccaatgtgtcacctattgatttacctaactatccaggagtcaagtcaagtctgaacagctaatgagctagtcactctccatttctccagcaaagcatacctataactttcagtgctccccggatggatcttggttcatgcaaaatgctaggaccggctgaaatcttcagactttcagataagctggctaaccaatttcagactacaagcatagcataggggtgatagggtcagagtaatgcgaggtagctttcactgctgaagctgaatgagcaagtcactcttcaacaaagcatacctacaattttcagtactaccaggatgtatcttggttcaggcaaatgctaggaccagctgaaatcttcagaattccagacaagttggccaaccaaattcagactacaagcagtgcatagaaggtgataggctaactgtaatgtgagatagctttcactgctgaaactatcaatctagaaaaagcaccgacctagtgaaagaaaattcaaggtaaacagttcacttagaaatttcaaattctggtcactggccagtgatatagaaatttcaaattctggtcactggccagtgatattaaaaaggtaaacatgcttctgaaacttactgctcctactaccttttcccagaatgtgacgttgttactgtcaagtatagaaatccttgtccatgtattaaaacttggagaaagcagcatggtttgactcaagattacaagtctgctctgtcttgtccaattcaaagattggaaaggagatatacagttcatgcagaaaaaatttctccagacaggcacattgaccatgtgtagctgacaaccaccactcaaagctgtcttgaatcccacaggtaaaacctactctactaaagtacgtaccaagcttttgacacaatgtgccacaacaccaagttgtccaagacttcagtagtatgtatattcaggtcaaatctccaacaaaacatgcctattatttcagtactcccatgaggaaaatcatgattcgtgcaaaagaatagcatcaactgatcaaccaaattttgactagaaataggcgtgacaccctattattgggctggaaattacatatctagaagcaccacccaacagtgcaaggtttccaattatgcagcacaatctgaatcttgctactctatgtggtgagaaagggaggcaggttccccttcgtgccgatcactggagcctgagtgtcagggaagaatttcgctcctgggagctctgtcaccgtgccttccttcgtaacacgtaccgggtaggtcagcaggtgcccaggaaggtcatcgttaagctcatcgctcgcgtacaggtcccagtacttgtcagccatcttgttcaccctctgaacacactccaggctctctgggttcaggaagttgtcatgcagcatgccaaggtgctcataccacaacgacatccggaaaccgtggatttgtcctcttgcaaccaggcccttggtgttcaggtggcatggctggaatgcacccatggcgatctcggagtctctgcccccatccatggacctctggttgatgttggcagatccaacaatgatgtactcgtcgtcaactgaaacaaaccaaggatattaagttccaacaaatttatctttatcaacatgaagcatgtcatcaaagcacaggtactgaaataagagccagtgacaatatattgtctatcttacaacaaggaatgaagtaattgcgtatgttgcctagtgacaaggaaattgaactgtgatgtaaaagtctttcctaacatgtgggtgtcgaaattggggcaagtagttatgagtgtataaacataaaatgggacattggagatccataagaggtgctgcgattctgatttgtgaattcttaaagatgttaaacaatgcaaaaaagatcatgtgtcagctgcaatctggagtaaatttagagaacttgtgacaataatgtttttaagcatacctatcatcatcttggagtgaacatagatcatgaaccggcgtgccttctgtgccttagcatagtctgtgccatccaaagggcgacctgcaggttcatactcaccattcaactttacttccctgttccctaagcagaagaaggtaaggtaatccctcgggtcagcattgatcctcttcgcctcaagtgcaacggcaatatcatagtacatcatctccattgtcctcctctgccaatccagtattgcctgcactgatccactagcaggaggtccttcaggccacattggcagcacaacatagactgcaaaacgctcaccagcttcaatcttgttcacaatcttcagagaaatctctctgggaatcagatgcaacgcctcaatgtcttctggtctgatgccatcggctttccatgcaaatgagctgccaaggaagtactgattctcgatgtagatgaagttcttggcgcggcgaattgcgtggatgtatgcatcttggatgctcctgtcaatggtgttgttcttgccactgacaaggcctgatcttgcagcagcctctggagtgctagggaagccaaagcaggcgccgccatcgatggaccggaacaactgaacactccaggcctcaccgtcatcggggaacatcaccggagacggcggaataatgaggtcggccatggctttgaggtctaggaggaggtccttgtcaccgccttgcttcctccaccgctgctcgaagttgtagagcacatcccaagccgcggggccttcgatcttggagtggatgtcgtgccatggctccctcggcccgcccttggtgacggccgcgccgtcgaggttgggctggtggaagtcgctgtggtgcgccgtgtcgagcgtccggaagagggagtggaactgcgtgtcgtagcggccgtcgcagaggtcgaggccgccgacgaagctgacgatgcggcggctgccaccgccacgcggcactggcatgtcgtggtcgacgatgacggtcttctggtggtgggtgatcatgtaggcgatctgcgcgcccatgatggcgctccggccggcgtcggggttccgcgggcagaggacgcagcgcacgtcggtgccgcggaagtagtccgccgtctcggcgtcgtgcgtcgacatgaacccccacttcatgccgagcgactcgacggaggtgcggtcgtcccagaccagcaacagcacgcgcacgccctcgctggccttgcgcttgaggagctcgccgagggtggcgtcgccgccggggcgctgccgggtgccgtcacggatgagcgtgatctcggtgtacacggaccagccggtgaggtatatgaggtgcttggcgttgctgatggcgtcgaacacgtcctcccagcaccgcccctgccggtagtacccgccgccggcgagcgggatcctgggcgcgaacgcgtcgggcacgtgcgcgtcctggtacagggtgaccctgcacccggggcgctgcgagaagaaggtgtacggcacgccggggtaccgcgcgccggagacgcccctgccccacccatggcggtcgccggcgacgtcgcggaactgcagccgcacgtgtatcgtcggcccgtgcgagatcctcctcctgccggcgtcgaggatgtcgaggcggcgctcgatggcctcgccggacaggagctccctgacggggaggtaggcgcggccgatgagcgtggcgccgatgggctgcgccgccttgacggagaacaccacgtcggcggcgaagtgggcgcagtagatgtggaacacctcgtaccaccgcgggttcaccggctcgtcgtcgacgacccgcgtccgccccacccgcgcccggccgaggtcgatcgtcgcgtacagccgcgtcgcccccttcccgagccccagcgagtcctcgaacccttccacgaactgcacgaacggattcaaaaatcaaaccaacaccaaaattcgcgcctcctcttggattgctccaaccaaaaatctctcaccactaaattggatcgattttgagctcgaagagagagcgggattcgactgaccttgcggaagatcccgggggcggcgccggtggcgcgggtggggttggagaggtggtcggcctcgaggatggtggcctcgagcgtgccgtgcagcagcaggtgagccatggtcgctcctcctcggctccgccgccgcccgccgccgccgccgccgctgccgctgacgtcacctgctcgcggcgcgtccaatacgagcttccctccgagacgaaggggacagtgcaccaacaaggcgaaaagcgtccaattaggagagggaaatggaaaaggagagattctagccttttattttgatttcctttgctccaaagaaaaagacgtggcgtttgggatagttattaatgtcggatcggaaaatcccgtaaaaaaagttggaacagaaaatatttgggaaattggaaagaagttaaagggagaattttgggaagaagttaagggctgcttcatacagaatattaactaatttatgtggagtttctactatgtaaataagttagtacaataacagactataagccagctataaacatatatggagtaaataaatgagaagagataagagcagcggacaatagatttgtagccacctgtagcacagactataagacgcaatgtgtgtatcataggtgggaccagatattacttgtatagtagtatatgtttataggtaactattgtatgaattaactattttatgatttagagtcagtagttggctatactattaaacttgctctaatatagaggatttggggacggatcaagacaagaaactaataaaacatgggaaggctttggtaaaagaaaaatacaatattggcagggattaaactttgttgtctttgaaccattttgaaccattttaacaaaccaattaacttaagtcctatttggcatgccttcgaatttgatattcggggtagatttaaagtttgtatgctaaattatattgtgtaaaagaaaaaaaaattctaaacttcatataaaataggaatgaaatgatttattcaaatgttatcaatgtaattgaaaatctagatccataaatttgtaaagctagtaatatccaacttaaaacaaaaatgagtccaaagccgtgctaaagatgggtgagggttgtgaacactgaacactcaccttccgacatagaaaactgagcaatgaattagtgcacgattaattaaatattagctaaaaattaaaaattgggttaatatgattttttaaaaacaactttcatataaaatttaatgtaaaaacacacagtttagcagtttggaaagcgtgcgcgtgtggaaaacgaaggagagaagtttggaacacccacagacgaactcagcttttattggggagttaagacctttgatctccttcccgtttgcatggttataatttatgggacagtagaaataccccgtagcaagtcactatagtaacatgcaacgacgatgataacttaaacacactagtcatatccatattcatatctagaagtggttttgttaacgacgagtatctactgatggacccacattccatattattccatagattcgccgctatgtctcatgacctaaagttgtattctataaatacgtcgtttcctattgttgaaattgactaatgagtactccctccgaaaaactatatcctaggtcaagattatcatatcttgatctaggttgatttttttgacggagagagtatccaaattcattgttttaagtggtatcaaatccttatcttgattgtttttttttaacggtggaagtactgagtagtgattactcggagatgagaaaaatcggtggaaatgtgcccactaaccacgcatctaatcatctaggagtatcacactatcacacacacacacaccaccgtgacaccaggtcaccaacaaagtgtcaaccacaagacagacaaagaccaccagaaggcacaattggggggtccaggactgcccaccacgagcataaacgaggcgtacgcatccgcatcgcaatcgcaatcgcaaccacatgccgttcagtcgctgtagatcgtggagctggaggtcaagctcggtgtagtacgagattcgccaccacgcacagctcccggtgcacaagaaagcagaacggagcccatgcatggaaaaacgatcagaattcacaagaacacaggtgtgtgtacctgtgacactgtgagcttttgattcgcatgttgattgatctgctgcacatgttaattaaccgtgtggcatgaacgcatgcatgatgagcaaacgcttcacaggaggaaattaacgatgcattttatagtggatgcagcgtggaggaactggccgatcggagcaatagtttcttattcccaaagacggggagacagacgtaaaggaatccaatgacttgcgctttcggtatctagcttgggtctattcttcagagttattaaaagattgtgagaatttagttgactagtgagaacttagaaaggactactttctcagtttcaagttataaaattttctattacccacatttacatatatgttaatgaatatatgtcagtatttattaacatatatatgaaatggaggtaatagtaaattgttatgcatagtacgtccaatcaataggtccgggctgcaggaatt

SEQ ID NO: 40262 - DNA, 8054 bp, Oryza sativa
atccactaaaacatagaacacatcatcatccactaacaataattacatatcaaatctcgtgcaagcatacaacatcatcatctacaatttgttgaattctacaaatcaaaatacaagcatatttaatcatcacccccacatcatttccataatattttaacatatctatttattatttttataatatttagaatatattcatacatatattccgtagcaagacacctcagtatctcacttagtggttgaaaaaaacaaggcaaaatgaataatttaacctcatgtttcccatcatataactaaatctgaaatctcctaaccgctctatatttttttacaacccagagtaatccagcattcaccgttttaccccagaatttccaccaaatgtcatataggactagcaaatccagtaaattttaaagccatccaagccagtgtaatgtaacatatgctcgacagcaattaaaaaaaaactgatacattactcctagcctcctaggatgactaatgcttgctaaaaagactatgaccaagctaaaactttcaagagtgattttgctatgaggtataagaagctaatacatttttataatgcaagatttagtacaacccagcattggtttcttaggtaacactgtaacaggaggtatagggtgtgtttagttcctgaaaaaaattgaaagtttgggaaaagttgggagtttcgaaaaatagttggaagtttatgtgtgtaggaaagtttttgatgtgatatgatgtaatggaaagttagaaattttgggtagttgaggtgaactaaacacggccataaaacaaattgttacctcccaagaatcgtaaaattcataaactgtcaacttgaaataagccgatgaacataattcatattagaacagaacactacatagagctgtagaattcaaccggagatagattacattgcttgaaacaacaaactctgcccaaacccaaagcagagcaacactctagcagtgtgcaggaatggcaactcgatcacacactcagagcaacactctacgacgtgaggtaggggatcatgtacgccgacgacgccaatgtcccgatcaccttcgcctccgtgtccgggaagaactcggcgcccgggagcgccgtcacggcgccgccgtccttctcgacggcgaccgggtaggtgagcaggtgtccggggaggtcgccgtggagctcctcgccggcgtacagctgccagtgcctgtcggccatcgcgttcactctccggacacactccaggctccccgggtgcacgaagtcgtcgtgcagcatccccaggtgctcgtaccacagcgacatccggaagccatggatctggcctctcgcagcctgcccattgacgttcaggtggtgtggctggaacgctcccatggcgatctccgagtcccgcccgccgtccatcgaccgctggttgatgttggccgacccgacgatgatgtactcatcatcaactgataaaagaaaaacattgaattcggtgtgaaatttagagcgagtttaaccgtagtggttgaaatttgcaactagtagttgttgttacctatcatcatcttggagtggacatagatcatgaagcggcgcgcgttctgcgccttggcgtagtctgtgtcttgatccgggcgatgtgcaggcacgtactcgccatggctcttggcctccctgttccccaagcagaagaaggtgaggtaatccctcgggtcggcgtcgctgtgattggccttgagcgcgacggcgatgtcgtagtacatcatctccatcgtcctcctctgccagtcgaggatggcctgcatggcctcgttgccagggtggccctcgggccacatcggcaccacgacgtagacggcgaaccgctcgccggcggcgatcttgctcacgatcttgagggagagctccctcgggatcaggttcaccgcctcgacgtcctccggcctgacgccgccgccgggcctccacccgtaggagctcccgatgaagtactggttctcgatgtagatgaagtccctggcgcggcggatggcgtggatgtacgcgtcctggatgctccgctcgatcacgttgttcttcccgctcacgaggtcgaggcgcgccgccgcctccgggctgctcgggaagccgtcgcacgcgccgccgtcgatggagcggaagagctgcacgttccatgcgtcgtcgtggtggtcgtcgttgttggtgccggggagcttcaccggggacggcggcgtgatgaggtgctcgagggcggtgaggttgacgaggaggtcggcgtggccgctctgcttccgccaccgctgctcgaagttgtagaggacgtcccaggcgatggggccctcgagcttggagtggatgtcgtgccatggctccctcggcccgcccttggcgagctcggcgtcgtcgatgctcggctggtggaagtccttgtggtgcgcggcgtcgagcgtccggaagagggagtgggactgcgtgtcgtagcggccgtcgcagaggtcgaggccgccgacgaagctgacgatgcagcggatgtcggagccgccgccgccggtgccggccggcatgtcgtggtcgacgatgacggtcttctggtggtgggtggccaagagtgagaccttcgtgcccatgatgaagctgctgccggcggcggcgtcggcttgccgcgggcagaggacgcagtgcacgtcggagtcctcgaagtaggcgagcgtgtcctcgtcgtgcgtctgcgcgacgctgagcttgatgccgatggcgtggagcgcctggatggaggagacgtcgttccagaccagcatgagcacgcggacgccctcgctggccttgcgcttgaggagctcgccgatggtggcgtcgccgccggggcgctgccgggacgggtcgcggatgagcgtgatgtcggtgaacaccgaccagccgcgtgatgtatatgaggtgcttggcgttgctgatggcgtcgaacaggtcctcccagcaccgcccctgctggtagtgcgcgccccggcgagcgggatcctcggcgcgaacgtgtccggcgcgtgcgcgtcctggtacaggtgaccctgcacccggcgtgctgcttgaagtaggtgcacggcacgccggggtacgccgcgtcgccgacgccgccgccccaccacttcccgccgccgtcggcggccacgtccttgaactgcagccggacgtggatggtcggaccgtgggggagcttcttcttgtcgtcgccgaggatgtcgagcttgcgctcgacggcctcgccggacaggaggtccctgacggggaggtaggcgcggccgatgagcttggcatcgacggacagcgcgaccttgacggagaagacgacgttctcggcgaagtgggcgcagtagaagtggaagcgctcgtcccaccgcgggctcaccggctcgtcgtcgatcacccgcgtccggccgagccgcgccctgccgaggtccaccgtcgcgtacagcctcgtcccgccggggccaagcccggtcgtcttctccaacccgttctccagcccttcccaccactgcaaacaccaacaccaaccaagcacaaagattcagaaacacagcaagaatcagggaaaaaatgtcggcgaggtggatgatcgctatggatggcatcgacgagtgaccttgcggaagccctcgggggcgttgccggtgaggcgggtggggttggtgaggttggtggcctcgaagatggtggcgtcgagcgtgccgtgcatcagcaggtgagccattgctgctgctccttcagtttcagtgtgtggctgtgtgcacttgacaaggctgggaagaagctcgcaaaacaatggtgtggcatgaggcttgacgggctgccaatttataggcaggcgctgctgcacatcgcggagctgaccgcgtacgtgctagattcagaatttcagaggatcaatcacaacagttactaaaacacacacacacacaaaagatcaacggcaacagcacacaagctcgtgaagcacgttcgatcgtactaggaaaatatagtaaattggtggggtcaatgcccaatgagatgttctgtagtttgttcactacagacttgcaggcttcgaagttcaaagtgtatatgtctctgacatctcagttttctcggtgtatagttttcttctgcctcttgacccgtcttccccctccgatttcggtggttcgccaccggcgagggtcggaggacgggtccaaccgtcatcgtcgggtcccttaatagtatagtgtagttaggttggttctttctcgtcgggtcttttatgtaagttgggttcttctcgagttgggaatctgctggtgagattccatggttgttagagtggatggcagcggcggttggtggcggtggagatgtgggaatatactatctgtggaggaatcaggcggtagaggcatcacctctaggcggcggtggcttctcatggcgccggcttgatgtcttctcggctagtagttcaggcctctgtcctagaagttctggtggtggcggtcaaaggcacctactatgcggccccttagcctgatcgtagtccaggatctcctgacccgtggggttggcaattggggcgtcttcggttacatcgcccgaaggttttggcggtggcggttggcggcgcctgctgtggctaccgttctacttggttagaggttgggatctcctgaccggtgaggttggtggcttagaatgacctcgactgttgcagctacttatggtggccagcgacttactaatggagagtacaatggtgacggtggatgggaacttccactggctaggttctagccgtcgggatatgcaggtttcctcatttccaacctcatgtgtcggcctaagtagacaacagttcattcgccatcattcgagttcttcggtgtttatgggtggctggatttggattcttcctctttgtttcctagcagtagtatccatgtagggtttgttgttcaggttgagctcaagctcctcaaatttaatggcgaactccatggagaattcctgctaagctcggcgaagcccataccaaaatctatggctcagcaacaagcctccaattttatgttgtttctgtggaggcaaccaaacggaatcactggttcgtcaagcggtgtgcacgtcaaaggagacccaagatgcaatcatcgcagcaatgtcgcatctcactgtcaatttgcacctctgctactgcttagattcaataggaagtttgttacattaggctgtgttcttttctcctctttcccaactcacttccctcgtttttcatgcgcacgctttttaaactgttcaacggtgtattttttttgcaaaatttatatatataaaagttactttaaacaatcatataaatccattttcaagttttttaggctaatatttaattaatctcactataatcacgtgttttgttttccgtgctgggaggcaagcttgagaacctaccctcccgaacacagccttagtgcagtttcttgtcatttggaaatagatggttcgatgctttttagctaatcggtttggtgatgtgctagagcttgttcccctgaactttatcgttattaatgaatgtttatgttttaaaaaggaaactgaggaattttagagaatttaatgataataaactaatttctatgaaaatcctgtaaaatttatacgttctaaataagcatagattgcacatagtcgagaccaaaggtgaggtaatgcataccacaaaccaaaactagtttgcttgaaccttgtatctcaatgggaatgggcgagataggtgtgctttgtgctatgactagaggcattatctaccgaaattgacacacgctagactgatttgccggtggaatcagccgaactaaaagaaaacaaacattacaaagcacatatgaccacgatttgttgatagggaattcgacgataggaatactttcatgggagtcaaatcagacaactccatcctctaagaattcatttctattctcaatcattcaaaaatgcataaggattagcaacatattctatgctgagtggtttatagatctcgactcgacctcaagtccttatcgactcaaacatgagccactaccgcaatgacttacatcatccacaagaccacaaagtgtaacctataaatattccatatctcttcattcatcatccatagggaatcatgcgtgctaatatctactatctccgtcttaaaatatactcgctctatttcatattgcaataagttgctttgattttttaaaactatttaaatttgatcaagttcataaacaaatttaataacatctaaaacactaaattagtttcgttaaatctaatattgaataaattttaataatatatttgttttgtgctgaaaatactactatgttttttataaacctatagttaaacttaaaagagtttgacttaatataaaacgaaaaaaataataacctgatactgaaccaactttataacttttttagtcatattgccataagatttctccggatatacttttatatactcttgcataaattgttatggaactttggatgcgcccctaaaacaactgaaagttgcattgcacgggaatgatcacatcacatggacgcggaaactgccgggcagcatagaaatattataacacgttgatctagaattctagatccaagcttgccgctcgtgtaaagcgtggggggtggcctggatcgagtaacagcaacgacctgcatgcagattggaatattggatttggatatgataaaaatgcagatagcagcatttgacgaggtgcccacttggacactcgcaacgctttctctattggcggagaggaatattgtaataagcgctgcattggcattttgtttgtttattggattgatgatgcattggcatttggcagttttggtatggttctctgcagctgcgcttcgcctattggtgccaatcctatgcaagttggcacttggcacagtggaagtccagtgccttttttttttttttggagaactcagtccaatgcaagtagactgcaagatccccccctatcctcgcccaattgggcccatgaaaacaaacactatgttggaaatggagaaaggtgatgcatggttgaacgtgattatattattgattggatgaagagaggtttagtactagtatataataacagatacaatagcagactataagctagctctaaacacatattgagaagatgaaagaatatagagatgagcgacgggctacacatttgtagccatctgcagcatgaactctaagatgtaatgtctgtatgataggtatgaccagataatatataatagtatatatatttataggtaactattgtatgaattggctattaaattgactatatatgacttagagttagtagttggctacttggctatactattaaacatgctttaaatacctaacggtgactattaaaactttcacatgctaactactgaatttggagtatatattactagatgtcagtcttatttttttccccctttccttttcctagcaataagtcaaatttcatttcctgttatttcaaatagtgcacagctcaaatagacacatcaaacatgtgtagtataggaatggcactttgtacaatgtaatcatggaaaatgatcacgcaacaccacacatatacgcacacccgggattgtattttcgtgttttcttaacacaagctcaaactgacggagacagagagcagagataaaatccattaatttcgcttagaaaatccctaataaaaatatacatacatatatataatctaaacataattaatggtcattcctaatgtaataaaacatatatagctgaccagtaaaataacatatccatatgtctcaaaagataataaaatagacactgatagttgttttgtttcccgtatggcagaatggcacacgttttatgattttaagttaaaaaatggttatgaactacaattatttgtacatgttaattgaccttttatttcaaagtagacgccatgcacctac

SEQ ID NO: 40263 - DNA, 897 bp, Oryza sativa
tacagcagctagctgaaagactgaatcactgaaacaagaggctttacctaacattgaaagacaccagtcaatgcactgttcattgaatcgttgactgactagaaggtggggccgtctcaattaaagacagaaagaaaaaggaaaggatgagaagaagaagccaataaagataagtattggtgcatctcccctcctatagtcctagggagtctatgttgctagttggatcctacaataacatgcatttctgatcatttcaaagatcaactcagaaaggggaggcaaccatggatgcacactctgctttcatgtttctcctcactttgatccatcttcttttgcagatatcagctcgtgatttcctctcacctggttcctctctctcagtagagcgcagttctgatgtgctctactcaccagatggtactttcgcctgcgggttctacaacatctcccccaattcctccatcttcgcagtttggttctccaactcagctgaaaagacagttgtgtggagtgcaaatcttggtcgtcctgtgtacacctggggatccaagatcaagttaaacatcgacggaaatatggttttacaagactacggtggtcagattgtgtggacaaacaatgtgagctcttcaaatgtccaagaggctcggttattggagagaggaaacctcatcgtgaaaggccaaggtgatacaattctatggcaaagctttgcttctccaactgatactttgctacccaatcagattattaatggtactataaaactggtatctagtactagtagtaatagattacttgttcctggccactacagctttcattttgatgatcaacatttgcttacattgtttgatgacgagaaggatatctcttttatctattggccaa

SEQ ID NO: 40264 - DNA, 704 bp, Oryza sativa
tgtacccattacagatgcaaatactattatgccctgaaaataacaggttattcagttagctccaatagttgtcatgaagcaataagaagcaggtaatctgaaatctgaaaactctggaattttgtctagatcattttagtatctctagcataaagcacagcttaagttcggagtaatgcaaaactgataaaagagaacagattttaattaaccgagtcattaccactggctgcattcgtctcttcccaattggatagctatacttgttgggctttttcatagcatgtgcagtaaaccagagtatgaaacctgacaaaagatccagtagggagtccagtgtcgatgctattactgccatcgataaactttcaactgatgcaagaactttcccaatgaaaagaatcagattgatgatattcgacaggttgatggccaatcgttcgccctttgccatttgcctcaactcttcctaacaaaacaacatgaagatatacttcatatcactatgtgtatagaagacaaaaaaaaaaagaaatatacagcatccaatttatagttacaaatctggcaattgcatattgcattgaggaaatgtgttctcttaacaagattttacctcagtaggagcattctgatctaaggaaccaatctcattcatggtttccatctcgctgaaatccttcaggagattttcctgcttcttg

SEQ ID NO: 40265 - DNA, 830 bp, Oryza sativa
ataaaataattaataatttcaaaaaattttaaataagacgagtggtcaaacgttgcaagcaaaaactcaaaatcccttatattatgggacggagggagtagttaactatggagtagatgcttggagggaaagattgatattgtgatatatatatacaactactctatctatcttgttagtactctctccgttctaaaatataagcattttcagcatagtaccaaatcaaccattttttaactttgactattaatagcaaaaaaaaataaaaaagatcaataatgtcaaattgatgttactagatttatcattaatcaaattattataatatgcaactctttttatttaaaacattttatttttatagatatcgtttatcaaagtagtatctccaacactgtgtccagatttaaaaatatttatatactacgacacatgaataacataacaagtactatgtttgcattgtccaggggaaatatggctttgtttcaatagccacaattatactccctatattaggggttcaatcccatctcttatgaaagaatggacttcgaccttgagtatcaaactgaatttaaaaattgatagctcagtctgcttcgtcgcatattgctgactcaaagcaaaaactctattatatctagctccttaccatttaaaaatcacataaataattcttacattctggaccgctctcatatagtacagatccatcagcacgaataaacatagactttttaactcccggccaggcggctagcccacgaggatataggaatagtagtctggaccacattccagccgtgtgcccctaccatcgcccc

SEQ ID NO: 40266 - DNA, 4013 bp, Oryza sativa
  unsure (1)..(4013): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtatccagattttttttttgaaagaacaaaatcaaaaaaaaaagaccaagttgtcagtcaaagtaaaaactgtcctgaaactaactatacaaagaaggggtataatagaagaatattacatggatttgcttagctagctagttgaggcagtattccatttccacctagttggtgctcaattagtggacctagcatgtttgtatataaacttgcaatgctagtcatagatgcttatttaactgttaataaagggttcagctttaatttcttcgcacacactctatatgcatacctaacttaacagttcacaagttgttacataaaagaacagttggcatctccccttctagatatcaaataaaaatgataaggtcacttgccacagaatcacagaagctgccagttgacataataattctccaattgtggatggaacctaacaaacatattaaatgtgtgatactctaccttacaatttgcagctagagtgacagggaaatggtgttacggattacataatattttccaaaatattcttaggcacattccttggtcactgtatcgatttttcagtgttagttttatccatccacctgttcttaaaaagaaattatgatcgtaaaaaatatcttagaaccacatgttataccatagcataaattactctagttcctagaaaaagaattgccttcggtcataaatattagacgttgagaacaagattttatcaaactctttaaacattgatcatcaataatttcttaaaattatttgtttaaaagaaaaaaagttgtatgtcaatttgccttgaagggttatacatttatactacctccattctaaaatatatagtaacctattattggacatgacagggatctagtactaggttgttatatattttatggcagagataatatatcataatttcatagaacctaataaaattttatatacttattttaatacgagactgattgttaaagttttaaaaatttaattaaataattatttaatcacgagccagagatgagggaagataaatagacttcgcctgagaaatccttggcccaacctactggcccaacttggcctgcgaacaaaagtgacggacgcgaaagcaaagcaccggctccgcctccaggctatgccgcgtaagccgggggctatgtattggcggcccatctggctcggaccccgcaccgatcaatccgggctcgtgccaccgcatccatcgccgagcgcgaggagagctgggtttttcccgtgagcgagagcgagtgatggcggcggggaaagggaaggggaaggagggagagtgcgacatggcggcggcggcggcggaggcggagaagaagggagagggctcgacggtgtcgcgcggagcggcgggggagcgggtggtggaggacagcggcggcggcaggaggacgatccacctcaagagcaaggatggcaagcagcatgatgtgacggaggcgtcggcgaggctgtccaagaccatcgccgggatgattctcgccggcggcggcggcggcggcgccgaccagtgcatcccgacccccgacatcgaccacgataccctccgcgtggtgatgcagtactgcgacaagcacgccgccgacgacgccgacgaggaggatctcaaggagtgggacgaagacttcgtcgacgagctggaccaggacgccctcttcgatgtcatcgcggccgccaactacctcgacatcgatggcctcctcgacctcacctgcaagagggtcgccgacacgatcaagggcaagacccccgaggagatccgcaaggagttcaacatcgtcaacgacctcagtaaggaggaggaggaggagatccgccgggagaacccctgggccttcgagcagtagtactcactttctttctcttaacccgtagtgtttctcgtcgtgtgatggcggttgtctcgtagttgtgtgtgttgtgtctctctcgtagattcagatcgaatcggggagttcgtgcattgcatcctgtccaagaagaacagagtcgatcggctgtgtcgttgaatgctttgaactgctggatcgcgatcgcttgcatgaagtgaatatttcgccccgcaaattgtttgctgcgtgcctctctccgcttggttttcatgcagtttgaattctgttgtgaattgaatatgaatagagaagggaaaaactgtctgaaattctgaatgctgcatttcgtttcagatgcatggactgatccatcagttctgacgccttagtatttcagtatgttgtttggctaactaaagtactaaaccaactacctgcatgtctgaattcttctacacctgaagcatttcgttcgagtctttgaaatatgcatgtggactgatacccaccagtatgttgcattcttcagcatctgaagaatttcatttcagatatgtgtggacttactgaattggtgggttaagttaaactcaattcttccttgcatgtgttctgctttcttccgcatcatgtagcggatttatagctagttgtgtttgctcactcaactagttgtctagtgcatcgtgtttgtaacttgcaatgctaggtgtttttagtttttactggttaatttggaatgcatgattttatatggtttttgtacgtgtgaattgattagtttcagttaccataaatatcctgtaagatttctgcatttcataaggggactaactactaaagattcttttggggggactatcaacaaattaattaagatcagttgccaactgaagataataatatttcctagaaagaaaattggttaagctcgggaaaaacatggtctgacatgatcacaattcacaaactcttgcggctttgcatactcttggtgcatatgacaagctctagctacagtctactggttttcatggcttctcagcgttttctgttgctggttatttatcgattccttgtaataatgtaatctcctgaacagtgcgttgtttttttctgctttctcatatatcaataaaatggcagagctcctgccccttcactcgatgaaaaaaatatggtgtcacagaatatttactaaaatatccttattactcctagtaattaggcaagttccttggttgccccagtgattccagtgtgttagttttatcaacctattcttagaaggaaattaagacggtgaaaattctcctaattatgaaccacttgttagttgttacatcgtcaattattagtccattcaatttgccggagccggagttgatttaaatcttataagtggtgatacgatcctcaacgaacatggaagagaaaaatatatactgtagtataaataaattagtagtttttagtatgagaaaaaaaaattcaaaacatgtaaacatgaagagatttaacaaccgacaaatacttctcccaggggaaaaaagggaagaaaataggacattgtcctcacaaatgggcctaatcccttacaaatcctcagcccataagccacaaccttctggcccaacacagcctgaaaaagagaaaactctcgtccatgcctagctggctcagcctcccggcgacgccgctgacccgaacccgtacgccggcggttatatataccggcgactccgacgtcgcaccaatcaatccggctcgtgccaaaccatccacgcggcgagcgctagctaggtagtcggtgcaaggagagctagggctctgtgaggagcgagagcgagtgatggcggcggggaacggcggagaggccgcggtggtgggggagggagagggcgcgacggcgtcggaggtggtggagaagatggtgtcgcaggcggttg
